United States Patent 11,260,081 (ENGINEERED PARASITES FOR DELIVERING PROTEIN TO THE CENTRAL NERVOUS SYSTEM (CNS)) - sequence listing, part 4

SEQ ID NO: 3233 - DNA, 553 bp, Toxoplasma gondii
aagagcacacaataaaaggaggaacggcggactgcttcccttcaaaggcgaggcgctgcccgtccaccatcttggagacaccgcagcctgcgcgtttcgcgcagaggagaaacgccaaggtgttcgacgtggaagaactccagagaggagaggagcagagagagctgcgcgagggagagaactcgagagtccaaactcccagggcgcgcgtacgggcgcgaaggagatatagacagaaagcacgtcctcaagagaggagaagcgcgagcggaggcaacaacgtgagcacaagctctcagaggcgatcaagacaaacgactcgaggaccagtgaacgaaggcagtttctttcgatgacaacagagacaggtcaccgcaagcagacgcgccttcgaggcttgtcagcagttgtagacaaaagaaataacaacgacggactgggtgttcacgggactctgtggcattcgcgcgctgggccatctctctccgtccattcgcttggctccctaacaagccataggcctcttgtctacggagcagatgagctcgatgca

SEQ ID NO: 3234 - DNA, 2680 bp, Toxoplasma gondii
gacagttcgtcgaagtgtcgtagatttccactgttccattcgttcgcgcgacagccaaccaccgactgtcaggactcgccgccagcgactccacgccgactgccttcacctccacgcatctgaggaagcaagccgcaagaaacaggacgcattctctgaaagaaacctagaagaggtaacgaaggaaatctccaagagaagaagaaagaaagcttcgtgaggaaagagcggcatgagtgagggctaaagactaaagactaaacgaatgttaatcagatgctagtaagagtagggaacaaagatggtggaaaagagccttgagtgtcaggtttctactgacggtaaaagccaacagttgttgaactagaaaagactgagacgaacactgcgttcgtgtcctcggcaaacatcgcgagacttctgtcgtcaacgacgggctgctccgtggaagaagggcctcgactctgtccgtctctgaggctgtttcttttgaattctgaggaggaaagtctctcttttcggtgaaacgcggggaacggcaaagggatggaacctcttacctgcagcaaacgacgtcggtctccatcgcgggcgacgcgcaagaggaagagttggtcccccttttcgtctcgcctgcagacgccgcggtaaacggcgggggcgaacgagagagggaagagagcgaaaggaggcgctctcgcgccctctcgaagagcggcagtgtgtgacaggcaaaagcaagtgcgaaaaatcggcctctacttgagtggccgtgtcgtggagaaatagggtggaacgggacgaagatttctaacggcgtgcacgagaaaaaactccggaacttcactttagcaggaaggaacacgtagaaaaaaggaaaacgcaggatacaaaggcgctgaccctaggaaacgcgagagaatcaaatacgcgcagagagagaaagggcatgcagtatacggggcttgtcgaccccacaaaaagcgaaaaaaaagaaaggcgctcaatcacacagaaatgagttaggaagcgagcattgaccgcgaaccaagcgaggaaagatgtgccaaagaaaccggagagggtcgccaccgaaagcgtgccccatgatccgcaagaaaacgccggaaacagagcagagaacggcgtggggacaaccgggccggcaagagaaaaaaacgcgctgactctttttcgcggcgaggctgcgcgagaagtggcgagttgcagagacatgagaaaaaaatcggagtcgcctgaccttgctgcagggaattcggcgaaaatgagatcgaaggacgcccttttctccgcgagtcttcttccgtgaatcaacgcgatcgttcgaaggcggcgccccaaagccagtcccgcaaatcgccagctcgcaagactcgtttcacatgtgtgtgccacagctcttgcctgtgctgtcaatgccagcgaaacgcggacgcgaagagacggcgggcacacatgcacgaactggattttcggaaaaaacaactagtctatgcatctggaccgtagtgccgctgtcacgctcgaactccggtttgccttggacgccttcggaaaccacggaaaaacgccagaaaggttttgcggaacactggacgaacggaggagggcggcctgcggagatgcaggaagcctttcgccggcgcgaaagtcgcaaagaagcaactccgccgcgacgatgaccaatggtcgaccagtcgagaagccgcgacgacagagaaaaggacgcgaaagtggcgcccgacgccagcaaatccagctaaatgtgtgtcccggtgcatatctgtgctggaaatggagggagttttcagctgtctgtacacctcgagctgacgacagcgcctcgacacaatccgcaagtccgttatacttcaaccctctcatcgcacttttacgccagtttacagggcttgggacagctgtcatccatcacgccttctgatttgtttgaatgatcactcattcttctctgtcaggctctctggatactctctgttgcccgtctgtgtcgggatcttgtttctaagcttctgacgccgagcaggaacagctgtggttctcatttcgcagcggaagagtttgaaaacgtgacggagaaagggcgagaagcgacagcagagaagcaagagccgaaggaaattcccctcggtctgatttttcggttgcttccagttcctccgaaaaaaaacgcggaggggcgtcgagttccagctgcggtcccggtccgcccaggtcgttgccgcctctgaccgatgtagaagtcggggcaaacagaacggaaaacgcctctacagatatcgtgctttcttcgcacgcacagggagagggaaggtttcaaaaataggtacggtggtattctcagattcacggcagacgatacgagtaacgtttccttcgtcatttgacccccgagccggagaagggtttgccgtcaacgggaataacgacaaattgcggcaacaaaagcttttcagtcctgcagtctccagataggctctctatctctctctggcgcaaaacgaagatacgtttgttttctcgatcccctttcgttctcagtacgtcacaaatcctttccttctccgtgcagccgtcggtgaccagcgcttctcccagtccgccgtttctctcgcgcatctccttttcttcgtctggataa

SEQ ID NO: 3235 - DNA, 3117 bp, Toxoplasma gondii
tcccttcgcttcgcattcgagagaatggagaggcaacagaagaaggcgtcttcccgggagaagagctgagagtgaggaggccctcggctgtctgacagagacacgcgaatgcggctgcgacggcaggtcccctggtctccacctcgccagcgtgtggagggcggtcgctcttaggggggttcgactccagtctctgagcgcagaggccgcatcggtcggcacctgtgaaacgtcccactcctgctctcctgtggtgagactggaaacctcgccacgatcaagaagctctctgtttcctgggaggaacgagggcgcgaaagcgtgaagttcatgtccatgtcccgtgcagctccaccaattgtctctctctctgcacccagctgggcgacacaagcttctccctacccggtgtttttctttgggaacgcgacggcgcatctgtgcatatgcaaaaggtccatcaggttcttcactcactgcccgagaaccgcatgcagtgacgaaggtgaaaggcgcccgatttgtccgacgcttgccccgcttccctctgacagacaacgaggaaaaaaggggactcaattcgctgggagagaaggcgatataccatgcgtcggactgcccctccaggctgtggagtttggggagagcacggggaggaacggaggagttgttcccctcatcttcgccggtgcaagtctctgaaactgcacaccccggagagcgaagggaaggaggctgggacggagaaaggcgaagcggggaagcgcaggatgagcgaatctgaaggaaactcagcagtgctaaggctctgcaggtggggagagtagacgagagaggaggacgacccagacgcgagaaggaaggaaacctggacggagactgtgtctccgtcacaggaggcagtgaggaagcgcgaagggaagaagagagagaagaagagccagaggaaagtccatgctgagggagaggaaccgcgtgagtcgcttctgatgcaagaaagaagtacagcacgaaaaacgcgagagtaggaacgaaactcttgacaagcgaccggggcacacagcgacacccgggagacccgagcgaaacgtcaactctcccttcaatccaaccggagagagaagaaagggacatctcgctcttctgtcttctcccgataatcgataaagggagaaaagctgttgaggctgaaagatgcgattcctgggtcgcatgcaatttgtacggtggcccggaaacgaagacgagcggagagtcggaaagcgtcgatacagcagggtagtgtcagagacagagcgaatcaataaaaagaaaaagggagaaatccacgtgaaagttttctgtctccttcgtggacgcggtcactcgctgaccacctgaacggagaatcgcgtctgtagaattcgcagcacgaaagaaaccgaagttccgcaattgtccttacccctcttcgaggtaaaacagtgtagatcgacgaaaggagaagaaaaattgttctcgttctgtctctgttctcgctctggcgagaaggccgcccccccccccctctcccaccaagagcgcaaaggtgtggaagaaggagcggcgtgtgggccaagatcgtcgttttccgcgccggtccacaaacgaagaggtaagaagaagtgaagctgaaggagaggaagaaagagaagggaagaaagagaaaacgcgagaaggagcaaagcgcagcctctcgatccctcaagtcgattttcctttgtttgcctccggctcagtctcgagctttttctcaatgtctttactgcatgcaacacgagacaagacacgagactcaggaaggatatggtggtcaggtactccattattttcttggaaacggaaatcgtcctaaaagatgcaaatgcccggtactacagacgcgtataaaatacgctagctaccttgttttcatgttcctgacggcgacgtctctgccagcgtctgcgatttcgacgcatacacggtgtctgatgtattaaatgtgtcctgtcaactcgttgctcttgctctgtccacacgagcatagcacctcaacattctggacagacgagcggatttatgactaacgcgggtgctcggttattcaagcttctcgtccgtgcgtgcaattcaacactggggaatctctgaggcaaataccactgtaaaaagcatctgctcagagatatacagatgcgtagatacaagtgtagttgtgtagtctctgcggacagcgccagcgtgttttctcgtgggcgaaagcgagagaaacgccgccaatcttgaaatgtgtaaagtaggagtttccccagacgtgtggtctctctctctctctctatatatatatatatataattacatatatatactttcaaaactacatgcatacaaatgcatgctggatgtgcatctgtatctatgccaagcggcaataactcgccttaagcgtcactggcagggacaagttcattgctgcttttacactcgcagtgtgtctgccattccacaggtgaggtcgtcgacgtggcaagcttttcagagtctaagattcgtttcttcatctcgaatcgtggtgcattctttcgtggagcttagacgccgagaaggcggcatgaaaaagagtttcactgtcccgcatggatgtggaacgctggcttttatcacttgcagcccgtgtggcacagcaaaagaaagaaacggctaatacagaaatacagacgagcaacgagattcccaatggagacacgacaatagagagaagtagtttgcgaacggagcaagacgccggaacagaaaagcgttttagcgaaaactcgagagagtgaaaatccaaaagcaacgagaggataggggggaagcggacttcacgatagaggcacagaggccgagaatgtgacggacagtgaaacgcagaacaagggatatagcgggaagaagagagtgttcgaggttgaaattcggcctccttaccacgcggtgtacctacggacatatttttatgctctgttagttatgggcagctacttgtgaagggttccgagctacgtaggatccttgtgtgacctctgctgtgggctgcctgctcttccaaaaaacgctttggccacttggtgagca

SEQ ID NO: 3236 - DNA, 4819 bp, Toxoplasma gondii
agaatcctgctgatccaatttccagaccctcgtgagaacaataggcaattgggggagtccctaaataggaaaggcttcattaactcggacttcctccgagtgttgcttgtgtgttgtgacgattttttccgtcaggcgcgcaatgcagcgtcacgaccaattaactacatttccaagtgattgcgacatcggaaagacgagacagccagacggaaatataggctgaaccgctaggtgaagcagtggttgagaccgagcgacgcttcctgtttatcctgttcgattaccagtggttcgtcttcgtcgcttatgtccccggccggtgttgggcgagaagatggaggaaggtgacgtgacaaagtccataatgaaaaaacttgaatgacaaaatcgtcagaacaggtatcatcaaaaaacgtgtgatccttcttaccgtggtcagcattgtactaaccggcgtccgcatagagtggagaaaaaggagaacttttttttctgtgtgtgtgtcgctgtacggtacaacattcttcgtacaattttttatgtgcatggtaagaacactcccctttttttgcctgctggtcgaatagaaaccaaacgaacctcgcgatgctgtgataacagcgtcttgcttaactgtcagtggaacaacagtgcacacgtggcgactcctgcaactgcgtctgtctttgaagaagtacagacacatgtttttgtagcctgcccagaaaaaagacttatgatatgaaagcggagggtagtctaaaatgaaagaagtcttgagtctgaaacgggtcttgtacgagtcgagtcgtgaatatccctaatcacacatgtagacacctcaacagcgcgttttgtcacgaagaaacaacgcggttaatctaggtaagcgactcacttttcgtgaactgtctctggcagacggatgcttggagatagatacaaccggcggttgttacgtttgtaggtcgaatgcttctgatcctgtccacgacccaccaggaaccgatatgtccctaagcaccataactaaaagatgtcaccaacgagaaacagtcatgcaataggaaagaggcacacacggttgccagctaccccgtccattgcgacttgtaaggtcctggtctgcggatttagggttttaggttgtttgcggcgacaaacgttcggacagaatggtcgaaacgattccaccgttccacgtcagatggcgcttccacgcgaggaaggttgaggaggttctttataccgccagagagcgttgttgcggaacacgagtggactaaatcgtaacggtcagggtgatgatgacccggattcccatttccatgaggcacgttacgccacgagacttcgtatagcacgcttccacccgaaacactccatcggaggccgtcgccatgttggcagcagcaggctaaccagcatgacgggcaagggtcacgtgaagccaaggtgatggttttaagtaagtataaccgctgcgtttattgcagtatcaggacggttagaggactgttgctgtggctgggaaacagacgggctctgtgagctttggcgcgtacagttccggtaaatattttgtctaagaatgccgcatcccgttaccccccctgtgcacgtaccgtgcggcggaccgatcacttggttttcctttgaacatgaaagtggtattggacgtcggtgtttcgccactttaccgtagtttttctctacgtttcaaagagacagtccgttgcgtttcctacgatgaatatcagcatttcgcttccgttaaatgaacgctcctgatggggctcattgtggctagtttcagaggcacacggtgattcttttgcacagcatgtacactctctggagaagtgttttgttgctgcgcgaatctgccaactggtttcgggcgagtgtgacaaagagactatcggactccacaggaagcacaaactgttggcactgttggcatgcatccccaagtgtctgaacctgtttagggtttcgggctcgcttttaggggttagggacttcttttacattttaaggttgccctgtagggttcagggtttgaagccatcgcgctccgtaaaacccgaggctaaatgtgcaaaggcagccgataacagaaaacggatcagcacaacatggtttgttagggtgtagggtaacgtttcgagttcggtttattgtttaacgtagtgtttagtgtaggatcaggaatgaggggtgtagggtcgccgcgtcccccaactgtcagacaccgacatcggagacgctcttgaagaggttgctgacctcacgagtctcgcatattgtgcggcttgtgtttgggagggtggatggcctagatgcatgccacgtgtttttacgaagtggggtgctacgccccatactggacctaaatgtgcacgagctctggcatgaatatgctatggatggtcgcttaattgtatgcccagcggcgggtctgccagttccaccaagaaatctaaagtttactctggttatacccgttgtgcgttttcggcacaccgggacggtgagagtcaggacaaagtaatttcatgatttggaggaggtgcggctttgcgaaccattcatgtctctggtgttgtgtctgttgatggtgtttgaatcgcagggaatgtgtatcgtcagggatgctaggcgtaaacgaagttgcaggaaatggttcttagagcggttgatagttggagggagcgtttcgataggggccatgggcggtcgctagaagcgacatccccggtacacacttaacggataaacgccgtgttgacaagccatcggttctcgaggcgtgtgaaagctgggttgtctgagggaggcacgtgaggcattcgtgacacctcatggtcttactgaattggcatcggctcgcccgctgtaaatgcgattggtgtttgaaaagccgatgtggtacctcgtttgtattcactaagaattgcccacctctcttttctatctcattcccgggcgctgtgacgcttcgggttcattttgtcgggcacttcccgtgtctatgtcttgctgcggtaaccagaggctggatcccacctggagtcaatagaaaatgccatctgtggtggagctaatgaagctatccaattataggctcaggagcacccaaggaaaccgtcgacggatttaccttgcgtggcgaaactcaatcttggctaccgtgttgttcagcggaaaaacgcctctgcgtcgctattgactcggtcatacaaagcgaaaataaaagtaacgtcgccacacatgtctcttgcgcagtacgaagaaagctgcgccaagagcagacaaaccgtattcgacaaggattatcgcgtgaaatatcattgcgtttatcgaggtacttttcaaattctgtttcatgtgtcgactgaacatactttagagataggtatcgctctgcgaaattcttaaaacggaacccttctatgtctcgctgcgtttgcccgcaatgagtgatgggatacgagacatcaatcttacaagagttcgtacaacgttggacctgtgacggctggcgtcacggccaactgtgcggatggcgtcctttccatggacgtgcttcgacttcaaagaggttcttgctttctatcttggtcagacgttctggacaggactgctcggcagtcattcaatcgcgcagtaagctggaagggagttcattttcaagtaacggtatcgtcttggcttcatggaggcaacaaatttccgaacgttgttaccatcagtagtggaagcccccttgccttctgcggacgaacactgaattatcgtcatccgcacatgctccattaggatagcatatagtcgtatacgatggagctatctcaattatcatgactgatgggtgcagtattactgcactggttcagcgcagtgaagtcctgcttccgcgtttcgcgtagctttctgccttaaggggtaaccaattaaatgggtagtgaagtgatatacacacatcgaaagagcaaatgtgatggttgcggcctgctgtaaaacactatctgggtatattttacatcaatggcaagacacatgcctatactactttgtgaaacgaagtgactacactggaatacggtagacaaaggatctgtcgctttttctgatgttgaatcggacagtttgctttttgcaccagactccagaccgattcaggtcgccgccctctttgttcttcagctgttttaatgctggaggagatccaatttgccttctgttgtcgttggccggagcacagcatgtgccttctacgcgaacgtgtgagcacgcggacacggggcccatggggcctcggtcacccgccggggccagcagccattcgacgctgtgtgcggccgcatcactcgttgctgcttccaggacagcgcaaacttcgcactcattccgttgaccggacggagatacatgcacacttaagggtgttcatctggaaattaatcatatttgcagtactcacctcaaaaccatctgcggatttctataagcctaaatgattagggcagacgaagtcattcggtttgactcaatccctcgtaggcgatgttgccggcagagaagtgtttcatgaattgaaaagcactgaacgctttcctggtgagcgagccactttcccttgtatctctacggatactcgtgcaatcatcccatttcggaaccgttttcgcaacaaagcaggagcctgtgcttgttttccccgtgtcgtgccgctgaggttcagcgcaaacgacgacgcctacacccgatagggtcgtcggatctccggaggtaaccagcggtgaaaagacaa

SEQ ID NO: 3237 - DNA, 2831 bp, Toxoplasma gondii
gaggcaactggaactccagaaaaggtttgtgtcgacacagctggatctgtcgcggaaacagctggagctgaggccactggaactccagaaatggtttgtgtcgacacagccggatttgtcgcggaaacagctggagctgaggccactggaactccagaaatggtttgtgtcgacacagccggatctgtcgcggaaacggctggagctgaggccactggaactccagaaatggtttgtgtcgagacagctagatctgccgcggcggaaccaagcttttgggcggagagtgtcgctacagcgggaggaggagtagcggctgtgaggaagtttgtgtttccggttagatcagagagacgttgggcgacttgcgaatctcgggaacttggttgttgcgctgcaaaggccttctgtaaatctgcttgcaggggaaggcgtggaactccagttggcagttgaagagcggggacggcaacgggcgcgagcggcgcagaaaagcgctggataggcgtcgccgtgaaattggggatcggctgcggaggcacagagtctgcagtcgccgacgagcgagcgggcgcctcggtctggggtagaggtacacccgaagcaggcaaggtagaaggcgcgggagctaccacagtttggggtgcagccacagaaggatctgcagaaggcacagaagcaagaagtgaaggcgatgttggtttgctgaggccaggcatcgattcggtcacgcgggagaagggtgcaggtggagggtggaggacgaggtcgggagaaaaggacggggaaggaatgtgcgcgggagatgagagggtcgacgcgcgggcaggttctgaaggaagcttctgaacctcaggaacgcttcgaacgaggatgtcacgcgcgactgtcgccggcatagtgctggcgtcaaccgcgtagagaccagcagcgtaaacggggtaagagctgtcggcggcgcctgcaggtgaagggggaagtctggaaagagaagcagcaccgtgatccagaacagaaactctgtttttcgaaggatcaacgaccgcgggagcgagtcgccgcaacgctccgtccccgtcgcgctgcactgcagtccgccagcggacggcgcagccctctcggggcgcggcgaggctcgcaaccaggaagaaaaaaatgcatcgacagacgccggaggcccggtggatggagcccgccatcttgcacaacctctgggaagatttgaagaaaagcagtcgagacttgggcgaactgcagacgcagaaaacgtctgcagagcgtcttccgtgcagcgggttctacgctctaccggtctcaaaacgtcgtcacacgggggttttaccaccgtcgaagcggggactcccagactcggcgtggtgttccaaagtgtgaaatccgaaccagaatacacacacaaacagacgaaacggggaatgcctcaaaaactcgaaaagctgcgatcggacagcttgcccagcgacgccgcagcgacaccacacccgtccagctggatacagtgcgcctctcggctctgtacgcgacgcgccagttaaaagctctggaggggaatttacgggtgaaaatcgaattgggaagcgacgcgcgtggaaagagggaggaaacgcgggggaaactggaaatgaaaactgccgagtgcacgccagaacgatggagaaaccgacggcagagacggcgcagcgtcgctttgcccggcggtgggtagaatcgatacgacgtggactcgcgctcgaaaccccgatgtttgccgccgactgccgttcatcagatgaggacacaaaagtggaaagcgtggaaacaatgtgtaattaaagtccgccacaaaaaagcatctatgcatccccctaaatcgagaaacggcagcgaaagacagctagcccccaacctcgggtgtacgtacgtacacccgagaggatccagcacgcgctgtcgggaatcgagacgatcggccggaacgagttcctgcgcaaaagagacgtgcatttcactggattttcccagagaagtgtgctgtccctagagttgtatggacagggaaaaaatggaaagacttgtcttccttcaggaaattcgcgcagtctgcaaaagcgacgcaccaccgctccttgtcttttgcttttttgccgacggcactgtacactacacccgccagagaccgatctgcgcatgcacagaagagatgaaagcgcgcgctggcaatcgacatgcacagaagcagcaagcaaagcgaaaagcaggaggatctgcctacgcatccacggaggaagaaagtttttctcgagatttcctcgcttttataggcacctgatcgatagacgcttcacttgggggactgtcgacttggggtgatctacgctggagttgacctttgctcgcgttcttttctcggctgtttcttcttgtcccagggtgtaatgcaaccatttgaaagcggcaattttgaacaagcctctagcctgttttcgtctttttccctcgtttctctccaggattatctcccttcctttcaccctccataatcggggctcgtctggtcctcctccacgcactgtctcctcacctgtagccgtttctattcgcgactagctttctgttttcttgacttcccttgtccgttttttctcccccctcccctgaggtctcgccctccgttttccactggcaaatctctccgttctctcgtcgtttcccccccgtcctgtcctcccttttctccgttcccctctacaaagtgcggcggcccaaagacgacgacttcgcatctggcttttccttgtttccagcgaagcgcttctctttcttgactgtccaga

SEQ ID NO: 3238 - DNA, 2939 bp, Toxoplasma gondii
tttgaggagagtgccgtcggcttgcgacgacttgtgttggagttgcgcggaaggtcgtgatctctttttccgcgaaggagagtgtcgtaggtgagacattctcctgaatagtttcgctagccaagagctgaaggaacttcgttttggagaacgggtgtgatactgttgtcgacagaagaccgcctggaagaagcttcacacacaaaattgctgccggcagttcgcagccgcatcgcgatctaggcaaatcgtaggcgaaattcagccccatcatttcgttttcggcttacgttctttactcaccgatctacagccgtgatttgcttccagaaatcgagtaatgcgtagcaagttacgtttctcgttttaccgacgcagggatagttacacaggtgccaccactttgacgtttttgtaggtcgctgtagattcgacttccattcctaagtatccggaatcgctagaagggaatgtcggaacgcgcccgactgtcgctgcgcgcgagttttcactttttacgaacgttcagataagagttcacctactgcgacacaccaaccatcacgccactgctccttccgcctgtcgcggactctgtttaccacggaaaagtcgcacaacagaactccacgccttctgcctggaggtttatgacgttccggacagttgctggggaaaggaacgttggaaacttggtcaagaagtggaggatggactcgagaatccacgtccgtcttacagatttgtgtcccttcctttcactatctcaagctggttcgggaggtcagtgtcgccgggaagataacgccagcttagaggcacatagatggacacagacagtccttgaaacctctcgaggaggtgggccgacttgggctgcggaacgctccagaaggaactcgacgttttccagaggaagaaccactccggaaaaaaaaaagctgcgcacaatcgtttccatagcattctttctttcaaaagcctcgagttacctgcagctgtcggcacacggggtcgagttgcttcacctctttctctgtttctgacggactcttttcttagacaggaagttgatgctcggaataacgcgtcgagcagcaacacttcgtcagtccaaagtcttcaagatgtgcatcggagggtctcgcggaagcctcctctcccgacaggcgacgcttgtctgagactgcactgacgaatcctcctggatgactgcagtctcggtttcagttattttggacgctgagagtcaagttcgcggtgtgaccttttaaaaggcaaatcagcgtctgtttgcagacccagtcgctgcttcattgaaacgatgggtacctgctggactccgcagtgtgaagttccccgtgtccaagtcagacaacggccgtaagatgcagtcacgccgaactgtctgcatctcggaactcgaatcaccttcaccctattcactctcctaggcaatatgatgccagaagaaccacggagaacgcacactactcagtagagaacatcgcagtctggactgaagaactcacgccttcacagagtcggggtagtctcagtggttttctgaagaagcaacgccgtagcgcactgtgagttccacagctccagcccagattccgccatgcctctctcgcgcgaaccggcacttcaaagcgccgaacatctgcattcacgtggaaaaaaactggagtttcccggaacccctctctgagcacgagctcactggtttctccgggacaaagcgacacacttcaccactttcatggacatctgaatgcatgtcgaacggccatttcagagaggactcgcggcgttctatgcctcgacgcgagctgtctgtttagcgccggttctcatgagcactccgtggaggaccgttcagagagccactgacgagcaagagactctttgtgttacgacttgacaagtggaccttctcgacagttcacggctgcgtctaccgtttcggagccgttcagagatctctctgttgtaaattgttttcttccatcggaccgggcctcgcgtctgcagtctctgtgtgtctgcctgtgtgtctgcccgtgtgtttgtgtgcactggcggcgagagaggcgctgagtgtcagttgtttctcaacaaaaagtgggcatccttcgagctccagttccctcgactctctctttttcagtgtggctgcactgcactctttcaggcctcgccgttctgccctcctttctcggtttttctcccccgcacactcgcctggcctggaagtcgcctcgagaggcgcctcgggcgcgaatctcggcctttctacgcatcccatttttccggcggcgtgacttctcgagtcctcgcgcgcctcaaaaaaggtttagacagaactgtcattggcctccggtgtccgagctgccatgcgagaaaaagaggccgaagcgtttcctctcgacagagttgccgcactgtcacttccctgcgcatctgcatcagtgtccacgcgttttcgacgactcgaaaacgacgattttctctgtgtcccgccccgtttttggctgcgctggcgccgaacctcgtggtgtttctccgagcgcgaaaagtcacgtaagacaccgcatgtgaacagcgatccgcagagcaacagcaactcagtctttgctttctcagcttgtcaaggttttttccccgtcacttcttgcgcttccctccagatcctctttctcctctctctgtcactcgtcctcgccgttcatctgtgtgtcttccgcgccgccttcctctctcgtcctttccttcaacgaccgcgtttgtccgctcgagattcttttctcctttctctcgtcctttcttgccttcttcttcttctttctctcttccttctttctctcatccgtctttctctgcttcttccgtctctgcttcttcgtctacctctggattgcccggttcgcgagcga

SEQ ID NO: 3239 - DNA, 1972 bp, Toxoplasma gondii
gccggtgatgctggtgcttaccaccatcttgcagagcctttgttattctgagaaaactccggaacgaaagggaggcaggagactccaaaggttcctgtttcctcccttggacaaggacaggatttccacaggaggcgcagcaggagaaagtgaacaggcacaggcgtctgtcccaatttcgacagcaggctgatagagacagaaaaaatcctcagattgcttcacagttcctttcttcgccgttcgggcagtgtgttgtttgctgatggctatgccgcgagaattcgagctttgaaactttgcgcatgcagaaggcaaaacagagaggagagagagcatacagaagtccataaaacagcaggtactgactatagaagagacagcgcaagcagagcggggcctttgaggtgagaaaagagaagatgatgaagaagaggacagaaggaagaggaagcagcgagaggaagctgtctagcagctgagaggagggacgatagaatcgactcagtgtcgtgaaaggggaacgggtctgtgtcctcccttcgaaatccagcaaaaagagagaaacaacgaagcgccagaaaggcgacggattttcacagggctccagatggacgcacggaaaaaggaaggcaagaagcgaaggaaaacgagaagaagagacagagcggcgaggaagaagacagagacgaaaaaggtgcagagaaagagggagaacaagaagaacaagaaagagaatgctggacgttctttgtcgtgcaactctcgctacggtacgtgggcaacgtgtatcgatgagcgaaagggagaacctaagagaggaggaagagaggggaagaaacgcagagaaagagaaagaaaaaggagggaaagcgtttagagagttagaagggtttcgtgacgcagatgcagagtggagagagggagaaacgcccgagaacgcggccgacagacgagcagcagatgttgccaccgacggagggggaaatggcagcaggggcgtttgggagagggagagaggaagactggagggcacaacgaggaattgaagaaggcagaaaatggaagccgcttgggtcccgtacacggattttatcgctggaagaaaaagcagagaaaaggagaaaagaaggacgcgtgcttttttcgtgcatgcggctcgcgactgaggctcaaactggcgctggactacgcggtgagggcgggtgcgtagacactcgatggaaagatcgagttttcttttttccgtctcttcctgaacacacacattgcaaataactgggacaaaggaaagggagggatgagcggggaagaacttccgtgagaaacgaagtgaaaaacgcgagttcctccatttctcgctgaccctgagaggcgggtctttgtgagccacacgaggccgtctacacctcagtgggaggcctcttttccagtggctgtctcttgcgtcttgtcggtgtttcttcttatccttctcgcttttctctgttgtcttagatgctcgcttttctgtttcaatggcttgtcgcgcaagccatcttgttgcggcgggtcttgtctatggacagcacatttccgttgtaggccgcgggcgcgtttcccgttgtgtgcggtcatctcgcgcttcttctttttcttcggccgttcctcttcatttgttcaattagcatcctcttctctcttttccgtttgcgtgtcattctcttcctttcttctctcacctctatcttccggtctgcacgtttttttccatctcctccggcttctctcttctcttctctcgtctcgtttcgtatcttttcttctttcctcatctcctctttcttcttgcccctcattcagtccttctgtgctcctgtttaccgtctcgcacggtctgtatcttcttttctcacctctctcttctcgcggcgtctgatcgtcttctctcgcctggtttttacctctcctctctctctctctctgcgctcga

SEQ ID NO: 3240 - DNA, 4504 bp, Toxoplasma gondii
tattttatctgacaacacaacttaccttcaggtgaaggaggctgtccagcgggcccttttctggtagccgggctgaatggaatagcttctctcgcaaggcagacagatgcggtgactgaagcagataaacattcggtcatagaggtaacatcggctgtattttatataccttgagtccctccagaggggcttgctccgcttcactgaatacacagtgaggttcgacgctcccaagccagaaggcagaagccactatttactttcgttttccagttgcgtctagcgcagacctgaggccgaagcgtcagagactagcataggatcaggcaataactttatatgatccagcctacttagcatgttttgcatctccagtctccggggccaacatcgctgcgggtggaaaagaatgttttgatgtacacattggcttgcgtcatcgggacagccaccttttagcgttttcttgccgtcggagaacgttagagatacagtgatcggtccaccttccgcagcgtcattgtttgcaaaaggtagcagagtctgttcctccaactcagttcttaaccgagaaacgcatgcctcttctttgcgtaggatttctttctcttccgatagctacgggatatgaaacgtcatagatgcttcttctgtcgtgatgaatacaagatctaccttttttctagcttcttcgaccttctgtgacagctccgaacgcagacgagttgactctgctcggaacattgcgtcgcactctgccacctgctaccacgtgatacggtttccgatcgcatccataaacgttttttacttcgcgctgctccagtgctgtcctaacaatggaattcggtgccatgatttcttcgatctttttagtgtgttccttagtcagagctggtgaccaccaatgatttgctgcagtcaggttcacaaactgtgctcgcaaggcccaccttcttttactctgttgtatctgtcatgcacctcggctataagcatctcctgtttctcctgaattcgatccggtacagggttgtttggtcaagtatctctggtgtgctgtataccttttctgttttcgtttgctcggcaagacgttgcaacttgaccagctcctccaaagcatgttccttcgtggtaatttccgcctgcagcgtttggagacgctcggccgtcatatttgaacagctgaccatgcactctttaatcgaacttcacaacagcagaatccaagtccttacactcttctcgcttcctccatacacaacgaaacagcttccgactcttgaatttcacgtgccaccacgtcaatttctgaaaggaaaagttaaagttgtgttggtgttctgcctccaagtatgactcaccctcctttagcgccatgtcgccggattctgtgcgtttgatagcatcaagaaggcaatgatatgcttgctcttgttggagaatctgaagcgtttctagcataaggcacttctaagtcgctttgatcttgtattagtcacctcctttcccaacgcggtcaatgtttctgctgctcggtcgactacattgcccgaaagggctagcgtcacacctgcctcagtcggaagcgccaacagaaagtcctcctgaattcactggcgatgagatgccctctcacggggagtctctagccaaccagaccttctcaattttgaggctttgtagcagctccagttctgacctaatttcttcggcttgcattgacaaattctcgctttgcccgtgacgctggtggagcatttgcaccagtgcagcgttttcttcgtgaagctgaacattcctttgctccttttcctgagtgcttctgctttgcgaattagtctctcgaagctgcacccatcacaccaccagagcttacaggcggatattggtgagcgtctcctcacaaagatatatctgcaattaaataacccggttggtgtcaggcggtctgccccggactagcaaagtcatggttacctcctttctaactcctggaagttccgatgcagaagcatttaaagttttcgacagctcatttaactctgtttgcagatctgtgagagtctgcaacgctcgagcctcatgtaagtggccttcacatctattaaagacgctgcacctgttgaagcgatggaaaatcggtttccatatcagttatccttttgtcaaggagcgtcagacagaatgcttgactgtcggtttggcatttgatcatgctcaaggacgcgcgatcccgctgcagtatatcctcaacctctgtcagtttctgaacaagggacaacgcctcctcgctcttcaggcaatttgcgtgcctcacggagtcgagttgcttgtgctggttctagtataagcatcatttgacaccagagagcaattgaacgtggaaataccagttctcccaacaggactgctttcatctgtttctctttttcggctcctagtttggctgcttccaggtttgtttgcagagagtttatgtcgcgctccctggcacaacatttcgcctccagctcttcacattgttggcatctctcccgagcctgagcaaaaccttttgggagtgtgaagctacgtagcgttgcctgattctccttaccatctcagcaagggaggtacaagagtgaagcagatgttcttgttcttgaattctttctttggcgtgctgggatatttttttgatttcctgttttatctgtggatttcgttagttcaagttaggtgaagggagacgtcagctgcgtcgaacctcacctgcttaacttctccttgattgctattcataagagcagcggcttcctccacttgttcctttaagcggtctcttttcaccgacagactgtcccgttttttaaacactgtatctattacgctgcgcacttcggatgcggtttccaccattttctccgtcagtaggacacttggaaggattcccgctgacgaatctgagctgctcccgaccagattttcgagcgataagagaagaggcttgcaggctttctccactgcagcctcaaacttctcagcagcggccagctctcttcggatttctagcagatgcttctgaagacgtgcattcaaagggttggctgaaaaactaccgatgtaaaaccagcatgtcctaatcacagactgaggattaccttcgacggcatgatttttgatggtcaatgacaacgagtggatactggctcccacagattccaaacagttgtgtgactccggtgagttgtcagtgtgcagtctgagctttttgctgcccggacaggggctaggcagcaaacggccctgtccattggaggtcgtatgtataacatccatgataaacaacagctggcgttcccaatctaacaacagggaccaaggaaagcacgtacgcaactatggttcgaggtgtcgtaaatgaggtcgttttttttgagtgacagtgtggttgtctcgtacagagttatagacaaagcgggacccacggcgacacgaggcttttgtaatgacgactcgggtgtatatacagcttaggatgtgagtggtgacatttcaaccagcacggtatttgacttgctgtcgcgcaggagtggtcagtgactgtcaggccacagtcaagacaagcagcaccacaagctccgtcactggcgaatccggttattcgtttagcaatgcccaatccgattgtgtgcatcactcgctcgcaggtgtgggttaagtctcgtcgtttcatgtcaaacacttggaggtggcagaggctcgtacgaagaagactcgcgcgaacggacaccgagtgacctgttctcaaagcatgactgtcggtgctggctccgtgcgccggaatgcccgcgtgtcgtgatggaggcgttgtgaaaccaacaattcttcaatgatgtcggaagaaagaacttcagctagggaaaaagtaattaaatcttgaggaaaggatatgcgacaagaaaggcgcggtaccggctgggatcgaaccagcgaccttgtggttaacagccacacgctctaaccggctgagctacggaacctggaaggcgatatcttccggatgtctccacttatttcgcatgcaagtcgtcgggatttcgctttcgtggagggcttgtcttgtcagagtgcactgtgtaaaacgatagtgtcacagaatctgcgtcgctgttcatcttcatccatacacttggaagcgtctattcttaggcaaatgggacgtttttgagttggtttttgcctttcgacttctctgtccacagttcgagttgagtcccgtcccatttccccccatttttcccccttgggtgtaaagcagggccacggctttctccaatttctttgcggaccgtccctcctctgcgttccgttgaatttcggcgttctgctcgtttccgtagcgctcaaaaatgccacggcaactcgactgcgtctatcgctgaggctcgcaactgcatacacgcttgagtaacgcacgcccccacccgatggtgtcctgccgaaagaacagacgcga

SEQ ID NO: 3241 - DNA, 1800 bp, Toxoplasma gondii
cgtgcggtatcggattacacttggacaccggaaacatagacatcgagccgctctgtcagcttgtgatctgcatgcagtgacgcagcccttttggcgagttctttgaggtgcagagacaaagcacgaggaacgaacgggtcgtagaagagggcctggcccagctccgcgtaccggaaggagacgcgagagggaattgtactccatgttgcttgcgcctggccacagagacagagtattcagtgtgaaagcgcacgcgaaggccgccctgccctcggtgaagccttcagttccacgtcaacaaaaagtctcactcattttcggactcagatcgacacgtctcgcgacgggtcacagcgcagcgaggctcaggtgtatgtacacccgacggacgcagggaagaacgcggaaggaaatgatgttcttcacgtccaatctgagtcaacggaaaagagaagacgtcggggaatccctcgtttccagaccagaagacacagaaagacgagagaaagcgacgaatgcgaaaaacagaggacaacccggcgacaaaaagagatagaaacgtgacagagggataaaaaaggaatggagataaaggaggaaacgagaggggcagaaagggatagagaagagaacacgaaggagaaagaaaggcagatggaagagaaaacaagggagaaagaaagggagaaagaggaagggagaaagaaaaacagacaaggggagagaatcgttttctacaccactcagtgtactgcaaattgggtggttagggaatctgcgaaaggacttgtctctccaggccgttctcctacgtattgttagactgcatgcacgatgagaacaacgcgggggcgatgcatcatggagaaagaatctgcatcgcatatctttctacttccccaacagactccacgtgccgagaaagaggatatcgattgttcttcaaggtctctggacgcatgcagacaaagtcaagggcgggactttcgcggtgtctcgacagtggatcatgggagacagcgaggacaagaacagtggagccgaacggagaaaagtgagagttgagagaacgtaacctccccgttgagtgaagaaagaaaagagaggagagcagaaagaatttgcaggagtttatctctagagtggagaaggagatttgtgagagaacgcagaaaaacgcatgcagaggagacacacagcatgaaaaaacgcgtgttctttacgcgttcaaccgtccctcggataggattcttcaagaggcgattgccagatggttttgaaagacatgttttctgttttccaggtgtcaatacactcgtgcggtttcttgattgtcggatgttcttgttttcctgtccgccaccttttgtcggttttccccttttcggcggtgttcgacactgcacacatctcgtctttgttcgtttgcccgtttttctgggttttctgtcacttgcttcctccgcagtttcctttctcccgtcgtgaagctggctctcgatgtatctgtcgccccttctcccccgtttttcctcggaaagcatcaaacacgcacgaagcacaggcgagacaggagacagagaggacgctcgtcttgagtagcgaaacgagacagaaagaagaagagagaaggaaaaagaggaccagcaagacggatgaaaagaaggacagggaagaagaggaggaaggcgaagaaaaggacggcgaaaaacaggaaggaggcacagaagtgaagagcggagaggaaggagaaggaaactaggacgaggaagataacggagtgaagagagaaaagcgaga

SEQ ID NO: 3242 - DNA, 1627 bp, Toxoplasma gondii
gcgtttgtgtgtgccagaaagcctggagagttgcgtggaaagaaggaggcagcagtcaacgcgagacctcgtctggggtgtacatccagagctccacccctgttgcaccagtggtcgactttccctctgcgctttttctactgcgctgcggtgctccgtaaacgctaaagtcactctaagtcttggccagaaaacagtgtcttccagtgtacgagtgcatgcgcatacatacatatatatattcatgcatacatacgtacatacatgcatacacgtgaattcatagtgttacattctttcaaccaagtagatgcatctattatttctacatacatagatctgtacatatatatatatatatatctgtatgtacatacgagtatagacatgtattcatatgcttatataaactgttaccgaagacagaccaggctggacggttcccggtcgacaggagacagcagaggagggcgcagggagagaacggaaggaaagggaagccgagaagatggacgaagaaggaaatcggaaaactacggttttttagcaagacgccgcgttcatgtcgtcgaactggtgcgatcgactcgctgtttctccactggagctctgctctgcacagaatggcgacgcagacctcaagaaacgcagaggtcacagagaacgcgggcagagaagaaatggcaagagagacaagaaagctgtcggagtcaggaggagagagggaacgcgagggaaaggcaaatggcgcctgagagcgaggaaacgcaaaaacctaaccgagaaggcgaggaaaaacgaaagcagcagacgggagagagacgaccggaccgtgagatgaggagaaaaggcaggggagcgcgcggcgccatcatgacaaaggaaccaaggagtagcaggaggcgtgtgtgaagacaggaagtgagggagatccgtggagacagcgtttcaagtagaccttcttcgcgacaaagtacagattaatacgtctccacagggtagaaacgtcttcatttttttgtgcaggagagaaagagtcgaagctaaagcgaccttcaccagaccggcttctctcggcgatccagagaggcgacgcatgcgagagagacatgagtcttttgccgcatgcatgccttttttttgcaactctttcaaactgtttaaagcagaaactctagcctcttcttccagggaaacgagcttcggtgaagttttctttgtctgtctggatgtttgttccccggagccggggacggagaggagaaggatctcgcgtttttctccgtcctttcctcgcagaacagcgggcgagctctctcacatgcaaatctttttcctgagaccatgtcttgattttttctcctccgttcctctctccaccaggctttctcgagtctcccgctccgtcgaactggtgtctccgtcgtattccttccggtcctcgtaatcgccgcttcacgatgggcgtcttctagagaaaggggagcacaagggagcgagagagaaagagaaacagcgagaaagaggacgagagaaacccagagagaaagaggaaagagggactgactccgtggcatctcgccatggatgtttcatcgatgctgccatccttcgtcaatcctcaaaa

SEQ ID NO: 3243 - DNA, 4179 bp, Toxoplasma gondii
tttcgctcttgcccgtcactcgccctcagtgcggcgtttcttcttctccttctttcctttcttctcttcttttcgcttcttcttctccttcacctcgcggtgtcgctccgcgccactgcctccaggcccgagccccgcaggcgcaggtccgccggggggggcactcagggcgctgcatgcgctgccgacggcggaggcggcgcggcgactctccgcagtcgcgaacttctgcgccaagacgctgctgctgcgtccgtcctctgcacctgcaggccgcgggaagctgcccgcctgggccgcggcctgaccctggggaaacgcggtgggcgccaaaccacgcggaagacgcccgcgcggcccccccgcgccgcgaggtggacatacacccaggcgccccgggtgtacgtacactgcggggtaggcgggggctggtgtatgtacacctgggcccgagaggcgggagacgccggagaggctgcgggcgaaggagacggcgctttgaccgctggcatctgcattcgtgccggcgaggccgcggctcgattcactcacgcgggagacagagacttgcgaggctgctctggaggccttgcggtccagctggcggagacggtgaggcgcgacggccgacgcgggaggtccggcaagcaggaaggcggcgaggctccccgcgaccttcttcgtctcgctcgaggcgtctttctgggcgcccgcgagctccgcgaagacgggtgcctggtcggctcgcgcctcgggcctggaggagactgcctgcgtgaggtccgcatccaaaagctggttcagagaaaacgtctgataccggtaaggctctgggaggagcgtcaggggaggcagcggctggtggagggcgaagacccggcgctggtgcggcagacaattcgagagaagacccgggccgtaaactgcatgcggagcctggtgagagcgcagagccttctgttgcgagtgccgagcgacatgggcaagcagcgacaatctggaggcaagaaaccacacgctggaacttaggggagctgggatgcacagagagagaggggtggaggcgaggcgaaggagaaagacgaacgcgggcgagggagaagagaggcgcaacaaggtcacagcgaagaacagagatttgaaggtgagaggagaagagaaaagtgaggagaggagaaaagaacggacgaagaggacaggaaagacaaggcgaaaaaaggcagaaaggcgacagatggagggaacaggaaggaaacaagatgagaacagagaagagaggagggggacatgagggggggcagaaaagatgaagaacaagggaagatgagagcggaaaagtcggcagaaagcgcagaagataaaacaaagaatgaggaaaaagggatgagaagaaaaaaacagaaaagagaaacaacctacctttcaggcgccgaactgaggaggtcgtcgagcgccgagagaccccgcggagtctcaaggtcgggagacgcgacaatttcgcaaaaaaaggaaggcgcttcttcgcacgggtgtctctccagctcgttgactgcggagtctgcgcgtcggccctctttcgtctcttcctccgcagccatgtctcgaaattcaggggacgagggagaccagctgacacaaaaaggttggaagaaaagagcggaaagaaaagggtgctcggctgcgctgtatagacaggcaggcacctacgcccaagacgcgtcttcctgccgaccttgtttccccttgaaagacgagagagaaggagcggagaatgcaagaaaagagaccgcaaagcaagcgaaaacgtggaccaaaaactgagcaaagaagcgagggaaaaagaagacaaacgaggaccaatatcgaagcggcccgaggtccgtctggtcagccgcccgaaggcggtcgagagggaagagaaagcaggggaaggcttccaggaaaaagaagagcaaaaagaaaggaagacgaaaggcgtttccacgccttggcagaaaacgcaaagatttgtctgcaggactcaacggcggcgccgtctttttttggtgcatgctgcgctttatgcgtacacatttttctcgccttcccaggtgagtcggcatttcgaggagactcgcgagttttcacacacacataaacacagagagtggacattcggaaaaagagaagcgagagggcaacggggactcgagagagaaagagagagacagaaagcgggtggaagagcgacaaagaaggcgaataagagagaggcagacgggaggcggagacacagagcagagaagagagatccttcgaactcaacatgggtctacctgcttttgtttgtcgatgttttccttaactttgacagttgcgcagaaaaagacgatcccggaaaaaacagacgcatgcaagtatctacatcagagaattttctccgtttgagagtccagacaccaatgccattcttctgtgaaaacagtgtgcgctttcagacgttctgtttgctcagggcccagccgcagtgcttttgttacgagacccacacatcttcaaagtcttgaaagatacctccaaactccacttttacacatttctgatacagcttttaggaaagaacaagtcttcctttactgctggttacctacatacgtactccgtcgtcgcgaaatatgaatttacaaagatctctcgatgcatatccgacgtctctcttttttcctctatccatttacatatatatatgcatatatatatatatatgcgtgtaaatatatatatatatatatatatttgtatgtgtatatgtatagatatactgtgtatctatcagtccttctcgctctctctccatatagaggtccatattatgtctagatgggaatctggtaaacacggcgtcagtatgaatagccatcttccttactcgttgggtaaatacaagcataaatgtgtgtgcagtgagggactgagagagaagcccgaatagaaaatcgtggatcccgcaagagacgagtttccacagaagaagaagtggactggtagagcagataggctgataggactcagcgaaaaagaattttacgaaaacgttctggctagggagatagattgaactctgtgtgtgtgtgtctgtcacgtttgcacacccagagaaaacgtatttatcaagaacggatgttggcccccgtttatccggtggaacgacgaaacacccgttggaaacgacacacacacacagacatatagtagacctaaatatttataggagtatggatacatgaatatttggatagaataccaacgtgtatgtgtgaagatgcaaacacagtagatttttatcgcagatagaagcagatttaatacatgatctcgcttacagagaggctctctgcatctgcgcatgtaaaacgactgagatgcattatattcattcatataaatgcataaatatgcatatatgcatataaatatatatatatatataaatatatataaatatatatatatatatatcacatgtatacatatacataagtgatgagtgtcgaagtgctgaagactgtatactggagagacgcttcagagcgttttcaaactgtggagttttcgggagaacatctcttcacctccctccactgggtggacggggaagtgtgactgctgtcgaagccgtgaccgcagttttctcgttttgccggattaaagaaattcctttcttccctaagagtccacagaggcagtctgcagcgacatcgagaagcgtttacagccacacacctttcttgtccttcttggtctctcctgctggcgcgactcgaaaacacagctgcttgagtccttctttttgtccttcttttatccctttttcgccttcgtcagctttctcttttatttctcccggctttctctatcgtctgtgcctttttatttgtttttcctctttttacaagtcttttttgcgctcgcatgcagttgctgtggaaatcctcctcccccccgagagtgaacgcgtcacggtttgagtctccgagagcagtggggcgccgctattcccctttgcgtctcctgctgctctgcgctgccgctttccggcaccttttcttttccttcttttcgtctcccgcttttcttttctcgctgcacttttacctcgttggcgcaggagtcctcttccgagtgaggtgtgtgcaccca

SEQ ID NO: 3244 - DNA, 1830 bp, Toxoplasma gondii
gagtttacggtactgtatgccactgtctccgcttgcacgacagagacgagcgttgctctggtctagtttgcgatgaattgtctgtttgctatactgaattaaccaagtcaacatagaagattcagttcgcaaatgctgtctcgctggcttattggattcaaagcgctcgttacttgtggaaggcttgctgttttcagtaatatattgcacatcagctgcaaagaggaggggaacagtttccagctctatgtttcaaggcaaatttaggagagtgccgatcactgcatccgaaatctaatgaccatatcactaatttgcaaaccgcgagctctacgagtcactgaatgtataatacggtgaggcggcaaaaaaaagagtggtccttccagtactcgcatggaaccgcgtaaatgcctctcttcaaagtgcgcgatatcaagaagtcagtcctcctctattgttttcgaagtcattcactgtcatgtaagagcatctcttgtttcaaagggcattgatcgctgtcacggttgatgtcggtgctgcaataagcacactattcgtgaccgtcgatccacttggataaacgaatccaccagcatctggagcaatttaatcctgcttggtcacatcatctgcatagacaacctcagcctctggtgaagttgatcgcgggagcgagtagccacgcaacgctacagggtcttcccttcgcttggtgcagcgggttttcttcatggggttccttgctgagtggagtttgtatcaatgatcagtcgcctcaaacctgccaaatcgaaatgcgtagaaggcaccctaaaagtgcctggtaatgccaccgggcaacgactggtaaacgaaaattgtgccgctgctttaaaggtcatgcagtggcttgggctggggccgcaagtggggcaaccttgcgacgactttgttgtcctcaattttcaaacatggcaccggcagtaggagtgggcgttgtccactgctgtaataagtcgccgggttttttgcaagactatcaccttcgtgaggcactagagcaacccttgtatatattggtggcttctgcgtataatttccgttccacgtgttctatcacatgggtgaatgctaacgtgtaccgaaggtgtcccaggacgcaaaaagctctgtccatgtgaatacacagaaatagactgttcgattgaatttgcatgatgtgctcttaagaggcgaacacataacagagcgcgttatagttcagtaagagagcaataccttatgaatgtggtatccctgcagatccatgtcaacaaatgccactacctttgccgcagtcacaccgtcggctgtttctcaaaatcggaagactcgccatacacttcgcaacaagcggaaaagactttagaagcaaaccctctccgaaacggcgccttgccagctttcggtctgcgcgatattactatagtgattcccggattctttaaaagggacaagactcgaaactgtgagacactttccgttttgaaagcctctcgaatgaattgcttcatcaatgtaaaacagaatcaagatctgccccacgcaaaattgactttcttccaatcgaaattgtgattcatcacggcctaccgttctacatttcgtttgcgtacgaacacgataagcctggtgagttccgtagaagtaaacttccacagtaacgcaaaggcttgtgttatgaggggctgcttcggcgtcgactgatgcagaccaactgttcgagcgccaagactattttgtcgccacgcaactgttggattctgtgattccttcgaggcactggtaggggggaagctttggtcacaa

SEQ ID NO: 3245 - DNA, 1778 bp, Toxoplasma gondii
ttgagtcgatgtagtgggcgatgtcttctctttgtatgcctgttttctgaacgtgttttgtaggtgaaaccaatctgaagaggcctgaagaggaggttctctgtgtcaatccaactcttttgagtgacgaaaaaacacttgtgagacgttggctttggggatatctccatcatgaacggccgtaaattcaattccttcaaaggaggacgaacccatcgagtcacaaagcgcgtttccgagaagaaaaactggcggcgaaagaaacgttgttgcgtcatgtttttgcgtatccggcaagcggcacagctcacacaccacttggatcaacgatgagccatagcacagatgtcagtgcagaaagcttccagttgttgctataccacactgttctttgtaaaccctacgcgcatgttgaccttgagaacgccaatcgctgagaagttctcattcgtacatatgatgccccgatgtacaaaataagactgttcgtcaatcatggtctatttgacgctgattgactgagacagagcgagttttcctttcgtataaaccaatgactacatacgcgtgtgcttgcaacaccacagactgcgccacgccaatcaagtgcagtcgcacccctgtggaaagggcacaaccagtttcatatctgagtttgaggagggctctgcacggcctgtggagggccttctaatcaataagatacatgtagaaaatggacggcagcaactctaaaattgtctttaatagtgaatcacaaacgaatacagcgcaatccgtctgccacttttcgtgtgctggcggcagctagatccaaaccagcagggagcactggcggtgaggaagttacgaactgatgtacgcaactttccagagagacagagagggtctagccacactggatatgaaacgcaatagtcaaaagtgcttgtttcggaggtcgctagctcttttggggagcgtactcggagccacgcctgggtcccctatatcagggcattttttatctgcagcgttgactcctgagtccgtttgatgcttaccgagagctgtggttcaagcttccctctggtacacattaaagttggcaaaaaagcaggaggggaagaaggggaacgagatccaaagaagactaatgactacctgatctgtctgtcgaggctctggagaccagacggtcacaagtctctctcgacagtgcatgcacgtccccgcatgcagccactctgtggtcgttcgcatgtaaactcgctcgatttctcgggtctgtgaacgtgtggggctgaaaataacattggaaaacggaagttcatgccccgtgtctttattcttcctcactctttacatttttctacatgaacctgcttcatcctttgcaggcagcccgtctgttagtgttgacaccgcttcggcttcctccagtggactgccgagggtccactcaactcacggtcaacacttcatctcccgttaagtaggatttacagctgaaagaaccgctgatcagctgccttttcctctaatccatatatcggcccacagcttttctgtactgtttgtgtgctactcatactcgtctgactgacacaggtggcggcgctgaaggcactcggcgatacatttggacgaaagagcgaactggttgtgaactgccgagtgacagcaacttcccgtttaacgttatgactgcgtagttgttactcgaaagtacatacattggacagccacggttgccaatcatccgagaacctcgctcttcatcagacggccacgcacca

SEQ ID NO: 3246 - DNA, 2023 bp, Toxoplasma gondii
cgcaaacgcgcttttgcataccagctgtacagatacgatattcactttggtagtctcgtttctgtgaggagatcgtacggtccagccagacggcacgagaaacttgatctgaaattgaggatcaacttagttgacagtcgtgtggctatgataaggacgaaaatacacaatggagtatcagctgtacattgttggggtggtgggggggggggggggagattcatttaggccttcaactttattgaatagtgtcacttctgccaagtgcgagtgtgtccaagtggagtgtcgaggagcaaatcgcaaacaggagtgcagcaggtacttgtagggcggcggcatccgctattttggtcatagcgaacatactggaatatccgactcgacagctttcttcgaggtattttagactcgaacgagattcccacaactaaacgcctgctctgcttattcttggaggtgcctttttttatagaaaacatggactctgtatgagctcctcgagatccagtggattgcctgtaggggcaggcagggctgttcctgcgtagattgacaagaacggaacgacttaagatcggtgggtacagactgccgaactaaacaagcattagtcgagttaaatgatacagggctgaattcttggagacaaattacatgaaatcgatgccgaccttcgttttgctgctctcttacatgtgtttgcttcgaagaagacatcgactgatcactctgtagcgcggtgtcatgtgtcaggctttccctacgcaaatcaacgaacactaagcagccaggaaagagatttctcgcgtagaatgcgacatcgatgctccggaactgccccgaccacgaaacagcctgaaagatatttgttgttcacggaaggactcgggaatcttcgccttacgttgcttctctgaaaaccgacaaagtggccgctatgtaatgcagagaaacgtcactgaacctggatatcgaatagacggaagccagaattcgatccctgttaaacctgcagaccagccagtctatcacttcacaggagttccgcatgctttccgtcaagtatgcatgctgtttcgctcgtccacgttttttgtctagcatccacgaatcgaaggatcggtgagatcccttgccttttttcttgttattaagaagcagtcttgtcagaatgagaaaaccgaacggggactggccacgacggatccccgggaagctttttcgccggtagttgactcgacgcaagcaagcgactccgctgagccaccttggctgccgttaccagctacatgtgttttctttagcaaaagtgcggcgcttctggatttcgaggtccccgtgcttcagccgacaaacatgttgagttcacgtgccgatagcgctttccaaaaacatgcgtgttcccgtctgatatctctcgtgggtctacctcctgtgctggaactgtaggccagcgtgccgttgtttcagacgttttcaccgtcttagtcgtttctctccaagctgattgtaccttcatcgtcgcgttccttctagtaaaaagagttggtttgcttgccagtgaaagttattggaagaaactgtcaaagttgcgtatgggccgccagtgcgtgtcggtgtgcgcgaactagagcgtagctgagtagcccccccagggttccacaacgctagaaaggaaacgtttttgtgtgtttcgcagttgacgcggttgcatttgaaaccacacacgagctttaactcccactcactctgaaagcagtgacagttcaaggcaatgtaacgccaaaatattggcggctctctccctcccgaggtgccaggctcgcgtgcccactgccagtttcctctccccttcattttttccgacattcgatgggggaacttccccgtttcaaccatcgtcgccggagttgaatttcccttttactcgctagtctaccactgttaccgaatgtgaattccttttctcccggtgccgtcccgcttcgactcttgtcaccgaactgagtttcctcaagta

SEQ ID NO: 3247 - DNA, 2192 bp, Toxoplasma gondii
tgtatgcgacgaagtttcaaagaatggcggaagccctgcgttgctcccaccgcgcagtcacggttgcctatgcggcgggagccggccttgagaggagtggtagataaacagaaggacaatccggccttctcagacgaccgcccggtcactaaagcagtttcttcgagtcagagaggagcaacacccccggaacgaacctggcaaaccggttcctatgtggctgggaatgacaggcaggttaccgcgtttacaggggctcgggtgcagaagcagccagaggcaaggaagatgaaagacgcagcggatcgcacgtctctctttgttttcgggtcgggtaacaaagaattcgaaacagtccagcgaagatggcagaactagcatgcacattatagttaacagggacaccttttcgtggggggcgttcggtcaaccatcctcttaccaaagaaacaccaggtgtatagacagcttatgcttggaacagacatctcgtaaaacgagtttgccgtctttttacgcgactgaaaggagggggagatgggctgagagaagaactgggacgcatctatggtgctgcactgaaacggatatcccaaggacctgagaaagtgtccatagtgtagcatctgtctcctgaaggtgggagcgacgaacaagacactactatggaaatagttgtcaacgcgaaataacaatggacatcatcagagtcgcggtcgcgtgttgccgcgtggctttttaatatggtagacacagtacagcgataagtttatcgcctgtgacactgcatagcggagaagtgctccctccgccgctggttggtcaagtttaccatggtgaattgaagtggaatatcaagttctttgcacgggggttcgttaagttccgtaccttaagtcttcacatatcgggagccggctgtgacgagacaagccgtctaactagatgaaagcgcgttcaggatcggctgtacaaacgatattttcataaatctgtttcttgtgcaccgtccggaactgcggtggaactgcagttgcttttattgtgatgaacacagagtttttcaagggtaatccacttgtagcaaactggctgtctcggcgacagtaacgtctcgatcatgacttcgtcgagaagcgagatgcatgttcgcatccgcagaatagacaagtaattatacagcgcaaggctcgcgggcgttgccatgcgtttgtcgattatgtgtgtctgccacttcctagatagtcacgcgtgctgccgaccacattggaacgcgactggcattgcctgatttttgcttcactgggtgtaagctacgctcgttgaaggcttcctcgcagtgaagccttcacattggagccacagttccgtacaggcaggcgaagggtgaagaaagtggaaaccgttgcaatctgaaacggcggggagatgctttgagatcgtacagaacgcatacacgagccagtcgatcggcttggcgtgaagcacaggggagcgtaaagtgacaaccgggtcagaagaccgaattgctgtgtagccgtgctgatggatagtcctcctgttcaaactgttattacaatttgcttcaaacgttgacggacatgggaagccgccactgcataaaacgtggagttgagactattgggaaactatgtttccagaggcggcttcaaaaaacactgtttgtgcatggtcgcgacagttcaaaccaggactttttgtctgccttctgatatccgcttgcttggcggcgaaacgaaacggataacctttctcccgattcgaagcctctgctgcttcgcccgagcaggaatgctccgcaagcgacagctctcacacagtcagctggcaggagccgactgcgcaagtgtagcactttgttgccatttttttcattcaacacatagcatgcaacgctttcgacggcgtaatgtatgtcatatctatgtaaatcgacgcggtccgtggcgggaaccaatccaaggttcgtcttaccagtagctcaataatgctaatgacactgttcctatctttttatttatatcaccatccaagcaatcgaacctgcgaaaaattcagccgtctcccagtcctcccccaattggccaggcataccatcagatgcgcgttgtggcgcttaccatgtgcgtgcatctgcttcgttattagcgcgctctgtatatcttcaggaa

SEQ ID NO: 3248 - DNA, 4938 bp, Toxoplasma gondii
tattttcgtcatggttctcatgaatttttcgtcgagacaccgcgcaaagtccacgccgaggttgccgacggccatggcgaccagttcgatcgcagcgagcatcaccgggccgtccgccgagaggcgcagcttctcctccacgagagccgcgaggacgcggcctttctcgtagctcgagctgcactcgtcgatcgcctgcacagctgcggcgagggcctcctcggagcgccccgaagcggcgaaggccaccgccgacaatacgcgctcgacgaacgcggggaagcgccctgccagcgccagtccatccattgagaaaacctggagaatgggggaggaaggaagacgaaggaacgagagagaggaagagaggcggccgaggaggcggacagacagagagaaaaaacagaggcagaaagaaacacggagatccagcaagagagagaaagaggaagagcaagttgaagaaagaggagagagagaaagaggagagagaggaagagaaggagactgagtctcttatgtctgacgaattgatcgggcagagaaagaacggagagcagaggtgaccgtaggtccgagaagagctccaaagggtcgaaacgcgtctgaaggagctgaggagactcggaggaaaagtgaaatctccaagaaagactggagccgctttattggacagagaagagagagaagacgagaaaagactttgtgcgggaaggctcttagaggtctcgagagctccagcgagctccaacgcccattttaagtctggaagaatgcagaagacatctgtcgaaaggcagagagcaacaagacggagagacaggcgtcgacagagtcgaaggcaggaaacggcatacgaagaaccggaaagatctgctgcgcggacgccgcgggagtgacctggcgctcgcaggtttcgcgtcttccaagcgctggtgtgtgccgggaacagcaacgcagcgaggtttcggaacggagcaaaaaagtctcgccgttgaaaaacagcgtgagaaggcaagggtgcagacaaaacggacgaaggagcctttaggtcggcacagaccccgcgttgctgggctgcgatggcgaggaacgcggtgtttctcgacagggaacggcgacgggggagaaccagagagttcaggagacgccgaacgaagagcgcggacgagaacgcgttgcctgaagtttctccacagcgacagaaacgaagggaaagcggctaacgcacgctaagacattttctgcggtcgtcgaaaacgacgcacagagcagagagcgttgatgaccgcgaggtctcctcctctcgacagctgaaaacggtgtggcgagaaaccttcgcgttcggcgcgctcgttcccccgtgagttgagtagaaaaagctctttgaggatatcggtgctgagttgtggaagagaaaaacgcggtttcagaaggtacactctttgcgagtcgcgaaactgttgcgtaaagcagcagcaccgctgccgacatgtgccgcagcctgtttggggaagacagctcttctgaaaagtcgcgcaattgcagtcttttgttcgtgcaacgcgggagttttttgccggttgtgtgctcagagagacgaacaaggtgcacagactatgtcatttaccctgcacttcgagctggactgcggcatcgtccttcaggaactcccagaaaaatctcctttaggcactgaagaccgcaaaacgacaacgcgaacgcgtcacatacagaaaccatcattgttcatgcacagacggaatgactcatccctttcggtttccacctacttcactcctgaatgtgagttgtttcgagggctccgagtcgtccgccgctctccgctgccgtttcaacagagcaaacgcagctgaaaaaactggcatgatcctccacccgtttgcacagaagaccctttgctgttaaccgagctctccattgttggacactcggccgtttgcgtcctaaaactgccacgctcgacggttgtttcgaacgaggcgcaggtcggagcaggactgtccaggtcggatcatcgacctcaagacatgtcgttggggaggaactgctcccccacagaaaaacgagcaagaaaggaggcaaacgaacagcttcctgcggagaagaaatcggttccgtacagtgttagctgcagtggggacagggggaggaatgaagcgcagcttctctgccgcattctgccgtcgtcgtgcctcgagggaagctttccagtaaccgtcgcgagcagatatagcgatacacgaaaaaaactcacggatttgtgccgacacaagctgctgtaaagcaggcagatgcctctttatctactgcccgccatagtatgctactttgtgcgaccgcggaaagctttgctaaaagattaactgagttgctctaacctcccccgggcatgcgcagctccgtcatcacagttgcggacctcgaggaaacacagctggaaagtcgactcgcgaaaactgctgggtccgtgtcgaagaactgaaagggcactttgatttcaacgcgccgcgtggtggtgacgttcgtctgtacggaattgacagatcggatgcagacacaaaagaacttggaagagtattcgaagtccccctagggaacacagtcacggaatgacgacaacggagagtgatgtgcatgttcgtcaccctcgctaggtccggaagacaaagaagcgcctcttgtcgatctctctttagggtccggaagtggaaaaggaagtggaagcgcgctttttccccaatgaagaagccgtccgttcgtggagagtgagatgcacttcttgccgggacagtagccacacaccggtgatgcgacctcaattctgttcctgtctatcttctgtgttcgagccttcacaattcctcgtgtgtctgccagcggggagcgaactgggaatgcagaacggaatccactgttcggctgtcgtttttctgtcttgtaaactctgtgcgtgtttgccagctttattgagcgggaggttggagtctatgttccacccgaaccgtcactgtggtgtctcgtttgctaaataatcccccttccgcacagtgctggccaagttcctcgaatctctttagctcactgcgcaccgaggatccactagagaaaactcacgactggctctaccgcgtggacgtctgacttggtcgttcgtcgactcaccgtagccgctgcttgcctcggagaggtactacgttgggaactaggaaacaggaggtcgcatgagttattggcaaaacagtttttcacactcgaaaggacgccgcgcgtgcacactccgagttgggctcctgttccgctcccctcgagtgacctggagaggctctcgactctttcagaacgcgtggtatttatgactgctctgctcttccccactcggttcgcatgctctctgaggttgccaagtcctcaactctacgtcgagtgctacgtcacgaatctctgtctcctttgcacaacttcagaaacggagcgaacagctgctctctacaccagttaccgtctgggcgctatatgctctgctaacacacactgtcagttgcatccgttgaacaagaagacgagagcgaaaccgagagttcaaaatgggcaaggtggagaacctgtcttcacatggaagaggtttagcgcggttctccagaaaaatatctctctatccttgctcgagaatagcctctggatgccacgagcttcgacatcgaggtgccgaaccggtctgactgcagcgaaaaattcgggaactgtttctctcctctgcaccacgggcgccgcatttctccggaaaaagcttgtgtctcgacgcgactcacctcggtgtctccagaatccttctcctcaagaaatgtctggcgaaaaagagctcaatctgcctccggaacgccttttgtcgcacaactttccgcgccaggtgtctgtaatacacgcgaaacgctcgagagcgcttgacctggttggaggcgcctactcctcaagaaaagctttcgaaattgacacaatgtgaccgccaggcactgcctgcactgaactcggagttcttcgctctctcccctagctcgaagcgcaaacagctgagagtctctcctcgcccggcgctcgagcgtcggccagatgtccacggcgatctttcgcacttgtctttgcggtttctctcgggtgggtcctcagtcgcccccaaatctctccttcttctgcagcgtcggcctgcgatctccgtttctttctctttccagcttctctctctcgagacacaaacaacgaagatccgcggacggcgagacgtcgtgactgctccgtcaagagcacctttgcggctaccagcccccctctcacaccagctgttctgtctcgtcctgttttctaatttcgcgtgccaacaaacgatttggccatatgtttttcaccttctcctcgagattcgattccttttttctctcctaagaatcctcaagcgcctctctccagcctctccagccgggggccctccggtcaggtcccgctgtgctgctcgacgtcgcctcgtttccttctgtctccttcccgctcgcttttttcttctcttctgcggcatcgcaggttttccagcttcactctcttcctagttgcctctctcttcatggttttcgtcctccgtctcctccctagttcctctgcctttttctctcgctcttgccgtctcttttcctcgccgcgcgtccacctccacttggccagctctgttttcttccctgccaactcctctgcagacccgttctctctgtacctctgagctgtcgacctcgttccgccgctctccatcttctccctcggttcctctcgcctccttgcgtagagcaacctcccgttgtcttctgaagagtcttttttccgctgctctttcccctccgtccccctcctcctctcccccctgcacacaaa

SEQ ID NO: 3249 - DNA, 3600 bp, Toxoplasma gondii
tcttggcattgcttgcatgcagtcttctgcaacgtctgttcaagaggcgaaggagagaactctcaacctccgtcggaaggcaggcacagcattaggtcgcgaggaaaaagcgtcttctccgctcagaaggaggcgcccaggaagaaagaggcaacggaagagacagggaagatccaggagagagtgatcacgaggaaacgaaggggaacgtagagcggaggaagcgagcttctgtttaccaccgcgcccctgcggcagcgcaaggatgtccaaacgctcgaatctcctcgagactcaacagattggactacggatttacttttatggtggtagccgaaaagccaactgtgaatccgcagatgtgattcttttgtccaaaggaaggcttcgttgtcagcatgaaacgctacacttcggagcgaggggaaactcctgtcgccgccattgaaacacagaagacagagaaatggagggacgctgatatgaagagcgacacacagagaggcaagagagagtgaaagaaagacgagaatgcgaagacgctccagagaacgagacaagaacgcggagagagagacggttctccgacgcaggtagcgcaagccccattcgccagtggttccgcccccgtgcctttctagaaaggacaaggctccttccaaccttgttcagcgacgaaatgctacagagagtgccatcctcacggccgtctggagagaagaagttggcctctgcttttcctctccgctgacggaaatccctgacagcggcaggctgcgcgcggaggcaggagaggccgtcggaaagccagggcgacaggaacggcgaggagtacttctgagaccaggaggaaaagtttgggtggttgagaaaagcaggcactctttctccgctctcggcagatggagagaaactcaaacacaggtggaagcgacggtgtgcactggctgcgaggcggccgcgatttgcgcgatttgcgcctggcagggacgcggccagcgtggaaaactgcttgtcagggcagaactggaagaaactgaacacggtcgtttcggcctgcgcctccagttcgctttccgaacaagagaaaagcttgcttcttcgcttcctcgcggaagaatgcacgaagtccagctggctaggaagccgccaaccgtttgcatgcacgcgcgccagatgcgccaggtggacatacacccgacgcgcgcgtagcaagctgcgagtcccggcgtcctttttttctccgcgcgtcgccgagaggcggaagcgcgtcgatgggaaaaacgcgagaaaaaagcgcagagaacgcacaaagcgaacggagactgaagacggagaagaagcggtcgacgaacagaaaaagcgaagaggcttccgctcttggcaggaccgcaaacatcacgccgcgcgacaccgggaaaaagcggagcctcgcggtgtcaccgtgtgcagcggaagacttgacaaaataaaaaagacatgcccgacgtgaaaagaccccaaaaaacaaaaaaaacaaaacgtacacatgtcaacaggtccagagataaaccttatatccgatagccatgcatgcacacaaaaatatatacacagtcggaataccacgcatatacatatatataaattaatgaggaaggcactgcctgccctgggtagaggttcctggattggactgtctttttcaaacacacaaaagcaagacgtatacgtgtatacatacctatgtatacatatacatacatatatatatagtgtatatattgtatatatattggaggctcgagtgattcagaggcgcatttcgctgcagggaatgtgccaagcctcctttcattcgtaagacgctttccgacactcgtgactccagtttcgctggagacaggcaaatgagaaaaagattgaattccgacattgcccactgtcattgcgagagagtccagtgcggtggcctgtcagtgtagagaacttggttttctttattttatggccggagtcacctggttcgtctccggcagcaaagaagtcacctgtgctgatttttttcaggcgcttcacagatcttaactccatatatacaccaagcagaaagaattcggttgaatctcgcaactgctttgccgtagattctgaatcatcggtgacttctctcatcggtcgtcagaaagtcaagttgcgaaagggcagtgaactctcgattttctgaggcgccgccatgtgcgttgcttcccagcgaagcacaacgcatctcttttcttcttcgctctgtcctctcttgtctgttctcgtccctgtctcttctgcaccattttctctttttttttgtcttgttctgtgcgaggcagcgtttgaatcctgcgagagacctgagtgctctggcgcgttccacgccattttttcgacgcatttccgccgtgtgttcccatttttgcgatcgttactgtgtctctgccgtatcctctccactcgtccgcaagcggccttcggtttctgtccgcaagcggccttcggtttctgcgcgcttctctggaaagtacgtcctctgcacggaaggcgccgatccttctgttcgcgttcatgcgccagttcttcctcaagaaagcgagtgaatccactaaaaacagttgaaagtctccctccggcacttcgcagagtgcgttttcaacgtcatcagtgacggcgcaaaacgttgtgtgaacttcctcccgcctccccggccagtctttccgggctgtctgtacacctgaagggtcgcgagaccattatatattgggatggagatgaggagaagatgtgtgaagcaggacatgttttttatgttttagaaagggacctcaggaaaaccttgccttgcctgcttgccaagagagtagttcgtctctgcgttggacgcatgttgtgttttcaggtgcagatgccccagatgttttttgggaggcaaaggaggggaaaggcggagaatcaagagagaagtttgatgcctttctacgcaaatctcgaaacgtggaccgcttggaggaaaaggcctcaactgtcttgccaagtccaaagggtgtgcacactgttggttgcggtgtgcacagccgctggagcctgcatgcatgtgcatgcgcttcgggtgtatcgacagctagctcctgcctcgaaagcggcggacccgcgcgagcgccgagaggagaaaaaccaacgcagagaaatccagtctcttggacaacctttctccaaagaattgcatgtagcgagcgagacagacgatctgcccctgtttgaaaagaggaaggagggaaacgctgcaagcgctgctgcggcagcgcaggaggttggcgtctccgcgagacacgggcgcgcagacaagagaaaaaaagatcctttcgcattctcgacgtgaatcaaatgggacttttgcgtttgcctgcatgcacttgagagtttcaatcgaaaaaagcagatttgccgcgagtctcgcgcttcttcgccggctgccatggacataacagaagcgacactccagccttttttctcctcaaaaagggagatttctctctcggaggacgagactgcagatctcttctttgcttgaccaagacttttcttcagtta

SEQ ID NO: 3250 - DNA, 2273 bp, Toxoplasma gondii
aggtacagacggacagaaaagctgaattttggtgggcgtagacgcatgccgatgggaggcgaggtggaaggtcgtgcctgccacgagaaacctgcgcggctctgtgggtgtccgtgtaactctctatggcccacgtcaggaaacatgaagagaagcggagtctactctgttctgtgatgcaaggaagcagtcaaggttccattaccgaccgaaaaaaggaactagaaaacagtgctactttgtttgtaggtgtggtcgcaaaagtagcgatacgcctgcaggaatgggacacgaaaaaaatatgtgcttcatgcttgttgtccggctcgcatgctcttggtttttgtcacgacctcttctaatcgcgttttattttgttgattatgcgttttattttcgcgcaagtggcttctcagttacggcgtttcaaagtgcattttttaccttttctggaaacgtgtgttttctccatgttttccgcaaaccatactgccaccgccgaattgactggcgagacgttgcggctcccgcgcatcgaagaaaaactcgatgtagcgtgcttacgctcgcgttttaaaatcaagtgcttccttcaacttaaactcggagtatagagaatgacggcgtctgcgactcactgcagacctaaaatcagaagtcggctgcagacttcgtgcttaccgcgcgactgcaactttaaactagaatgataatttctcgtaaggaaagaagtaagacgcatcagagtcggcaaaagcgttaacgttgcattttcatctgccacgcagagtttcgacccctgtcctccgtaaagtagacggaaagcgtcaaacagagcgtctacgccgcagttttcttttataaatgctttgagaaacatcgaaccgaagcttgttctccacaaaaaaattcggagatatccggcacttcgttacactcagcaacctctagagttattaccttggagatgaagcagttcatccgactgtagcaaagaaattcttctgttgcttcgtaaatttgtgcatctcgctacagtataactacgtattcgttctaggagaaccattgtatctgttctacaacctggggacgtggagagtcactatattcattaagctaatatgatggaccaaatgaatgcaggtaccatagtttctcccaagatgccccccaaccgtcgcgttgtgaggaaaaataagtgtcgctgtaacaggcgcccttcacttgggcgggcggttgacccctgaatgagtagcgcagtgggtagctccattcgggaaatgcttgcccacttgctccctggcaaggcagtatacctcgtgttacctggtattctgtgatgatagtgcgatggagtggttacggtcgcttaataaggtattgggttaatctggagaagagttacgtagaagtcctggtaggcagtcgcaagttgtttaacctctcattaccatgtgtgttgttcagcctcggacgactgtgaagagcggttctaatcccaacaaccgagagacggagagcaaaattatgtcagaggcttactggcacaactgggtgagttcctgcggtgtttttaacccggcacgcagggtggaaggcaacatctcagagaacaggaactacggcttgtgttattctttgactggtcaccaccgtatactatgcatttgccagctttttctggggactctgtactacgagttgaactgcgaatttagatcttgatgtctttgtttaggggatccgcgttctattgtgcctgtaaagggggacgcagacatccccgtactgccacaacggcccacaccagttgctgtttctcagcagcctaccgcaacataaaatagacacgatcgcggttcgagtatcgacgtatgtgcacagactgacataattaatccttgcacggtatgtaaaaagcaaagggcaccggcgctcgttcttccctttcagtgaatttccagagggtacaccttgacaacgtaccctctgtttcgaatttcagaatgtcaaaactttgggggctcaccggagaatacgctctccgcggggtgtacagctgcgccttcggcctaccacttttcctggccctttctcacaaaaacacggtcacaccaagcactgggatgcctcgttgcttgagcgtcatttttggttcttcaaccgtccaactccaccttttgagacgccaacggcatcttgagtctctgccgaattttcgtgggaggttgtcacgctcacaaaaactcgactcagttctttgggaacga

SEQ ID NO: 3251 - DNA, 2164 bp, Toxoplasma gondii
gtaagcttggctgcgttgtaccttcctgctatcccgtcttatccccttctgaagtgcaggcggtacgccgttttttcatatttatgctcactgagtttcttctaccgtcagaggaaatgtcgaagcaaggattgcgccatccagggcccggaacacggcggcgtccttccagtcttgctgctgtagaagaagactcagaagctctttgttcgttggaatggaggcgggaagcataggggacgatgtggtactactctcgtaaggagcgcaaaatccgtctcttccagctgcactactgacaggtccaacggatggggacgatgacctcgtcgctgcgagggccgcgctaaatgctgccattgtgttccaccagagaaaccatcaggggcttggtgacccaacggctccgggcacaggaaaagagtgtctgaacaaagcctgtaccggtgatagcgcagctgagggctggcacatccagaagagcccacccgccctcctttgtgctggacgactccgagctctgtttttaaaaattgtggatcgttccagtttcggtcttcacaacttcttccacaatttgaactttatatggtgggtttctttgacatcagaagacaggcgtttgctgtggaaaactcaaagccacaacgcaagacataccgatatgccgctatctcccgcgttgagtgccaccccagctccttcgttaaattttcgacaaaaggttctgtccgtcgttgcagaactgacccggaatacgccaacgaagcagaggagtcgaattacaacctaatccgtagcagagagagcagacatttcagcattcgtctttgtggtcgccgattctaaaggtggagatacagctgactccacagacgcgcctctccgcacgtacacctgaaatgctgttaacagttgtgcaaagaaggtttcgcagtcactgttctggtgcacaggcaatgaggacctaaaaaagagtggaatgtgaggcaacacggagcgcatggcgatcgaaaatacagggtcactccagcgagctcaccggtgcctcgtatacgcggacacaagctcgtgtaagagaccgattccagaagaaaccgccacgcacatgatatatccagcaacagccctcttcctgtcgtcgaccaactctttttgaatcaggacggaaaaaatcgcttgtacttgtcgattagaaaagccatgtaacggcatcggtctgaagtgctgcctggttcgcctaatcctgtccagcaaggcgttgcatgcatgcattccgaggaagctgctgagttctcaccagcaaaccatgtggggccgctcgaagacaaactaacagctaacatcatgtttcgccctgcttcacatgagcttgggaaatgtatatgtcccacttttcttctggatctgaacggtttcaggaggcattgctcgtcttccgtggtatgccccggagtctgatgaacgcttctctcgtctggcggagattacgcctgctctccgttctgcgcaagtctttttttagtatccgcgtacatagtgaaacaacatttttttctttcacatccaatcgccgcgcatttgccgcggttcgatgggcggagctgtggcgtggcatctgctgcgctccgtacactaccgctgtgctgctctttgcgttgacgtcaacttgattctcgtctgacctgtgattcgcgttattggtcagtcgtgacttggcaaatcacacggtgtttacatgagtagcggtggcgtcagcgaaagcccgagtggaagtatcgcgagttgggcggtcgctgcggatacctgttggactcttcggcaaggccgcttcttcccgctggctctactcgtttgagaggcatccagcagcctaagaattattggtggaaaaaggactcctgcatgtatttcgaccacgtatccacagtttccagttaaatgcgtttatgaaccaccgatatatcgtgtgatgactcctgtatcagttgccttgttcattcaatcacgctcaggacgtcacatagtacgtttttttgccaattgttgcttatttgtatcccccgtgactccgtctttccacagcatctgcgtaatctgtgtatccacgcgagcgcgctgctgtttctgaggcggtggtaaagagtcaaatttcccgtagcca

SEQ ID NO: 3252 - DNA, 1708 bp, Toxoplasma gondii
gagaagacggacaggcatggtggagagactccagacagagacggtcgccatgggagggccgagaagaagcgcgaggaggtgagagatgaaagagaggcagtggaggagaaagaggtgagagagaggagtccgacgaagaagcagtcgactgagagggcgaaggaggtgacagggaagaagcgagacacggagagaagagcgaagagaaagatgtagaagaaggagacgaaggagaagcgagagaagccgaagaaagaggagaggaaaccgaacgtgagggcagcgaaggatggggatcgtcggcgcccgtgtgagacagccagggcaaggacgagtcctccatgctggcgagaaggatcggggaaacgaggaaacgcagaaaatgccggacggagaaagaaggggacccacccaatccgagacaagagagaaggaaaggcagtctagaaaacgaaagagaccggcgaaggaaaccagccggaagagaaaggaagaggaggaagcagtaggaaggcgaggataaggaaggagagttactgacaaagtaccgacgtgttttgaagagattgatgagaaaacttggaagagagaggcgcgaagcccaatgataagggaaatgttcccaaaccgccggatcgtgttggctaggtgaattgatcaggtttcatagagacaatcagtgactgttcttgtgattttcatgaacggagtggtttttcgcagtttgaaatcgtactaacggcgagaagggaagttcatttcaaagaaagggacgggagagagggcaggagcaatgcatgccgaagtgtacacctatttataactcgactcgctctgatatacaagcgactacatttaattctgtatggaggctgaggggtgagaaggtggaaaatgcagcagcagcagcggacagaagcagcgagagaatgcaacgtggagtgtgttccgtgtagaaagccgctggagtgaatttgaacgagcggagcacaaggaaaaaaaacgagaagcgaagagatccttctgcctccaagtcagtagcaacctttcatgttctcgtctttgccggcgacgctgtctgcatctggttgcgcctttttctcccttggcttgtcttgctgcgtcacccgccaaagaactgtcgtcgcacatgcaggtaccgacgaaaggcgagacgctcgacggggaaattcgagagtttcagttttcctttttgtaaaactaaccgtgcctttctgcttctgcccgtggagccttcctctttctcgcatttttgccagcttgcatgcagaatgcgtttctgcaacatccgttgtctctccgcacccgttttgagcgcttctccttttagcgagactctcctcagtggaagcgcggaaactccagttgcactgttgtggtctgacacggggacgaagcgagggaagaaagagaaggaatcaaggttaccagccaggcgcttctctgtcctctgtccgcgtcctgcgacagcagctcgaaaagctccagacgaggacgagtgtcgacgttggcgccttgagagggaagcgcaaaggacgagggaggagacgagagaagctgcgcctcagaaatcggagagaaaggaaagcgtaaagggagactatacaacggtgtagccttgtgtcagaggtcgttcgctcagcaaacggggacgtcctcctctgctcttggccgtcgcctctcatca

SEQ ID NO: 3253 - DNA, 2256 bp, Toxoplasma gondii
tttcttctccaaaatatcctcgtcctctgtgtagacacactcgtcgaagacgcgcgtgtctaaggcaacttcttcggcatcccccagatgcttcacaggctcttctgcctgccgttcctcagctggacgggcgtccccagccccagcggaaagcacggcctccctctctcctccatctccaacctgtgcggtctcgacgaagtgccctggaccagcacgcaaacagctgctgtgggcgaaacgtccgtctcttgcagaaaatagtgggatgaccgaaggaggtttccagcttgcaaaagaagtcactgcgttgattcctgacagtccagacaacgagttgcggtagaagacatgggaagaccgctgtgacgcgtggcgggagtcgccgacttccagtgtatggtggagaagcctgggggcactcggcctgactccacgtggcagcgtcgacaactccacgaactgtctgaaactgttggattcgcgtgaagcagacacgtgaccctcggttgctcgctcctctggagaaaaagcgacttcagcgtcgcggtagggggtcgcagaaaaacactcgtgccggtggccgtctcggactgtccgtctaaaaggccgcggtgtctgtactgcggacgcaagtttccgtagtctggaatgcgacttcattgtcgcgcttgcttcgcttccacgcgaggtagacggcgcacggcactgtttccggtctcccccttgtcagtcctctggcaacagccatggacacttccatgcacagagatttggatttcgctttcatgtggcgatttacatgcattgagttgtatttatactttctgcatgctctcgcttcagcccccggccacagccgttctcagttcggtcttcgccttccccctcggttcgggcggcacaagccagaggggctttccacacacttctcttgctaccctggtgaacggacttctttgctccgacagaacatgaaagaggcaaacacggaccgcagaacggaaagcggtgtgctctcggggtcgttgttgtaaggaggcagtcccagtaggcaaggtaaaagctaatatttctctagcgcgtcgttgcgaatggccttgagcggcagcattcacccgcaaaaaccagccagtgagacccggcacgtccctcatgaagaaataatgcaaaaactgcgcgtgcggcagagctggtgaccaggaagtcctgaaaagagcgagcggcaaagagcgagcagcagagtacagatttgactggaatcactttcccccttgtgtgcctttcgtgaggccacgtggtgcgatggacagcctaagggtgctgcatagatgagaaatgatccgatcaaatgaacgaggacgcaagctaaggcacataagtcaggagttctagaggctgagcattcgcgagagagaattgagttcgagcacctttacgattgcgtctgcatgcatcaccaccgccgcacagaagcgtgcgcgtgttcgggctctcgtgaaggactgcagttttttcctcggagagagggtcgtttcagcatatttgatggaaattcaccggcgttgcgctactgtgtggggaaatcgggaaaagaacaagtttcttgaggacttgaagcggttttggcgggtggcaaacggctcgtcacgtctgccattcctgtcagctgtgctttgtgtagacacactgctgcacgtgcaggcaatccactttttttcttctgagccttctcgtttttccctactttttctcctagtcctccgctgtgctgacggcgcttttctttcctgtgcttcttcgacgtcagttggcgttgtcttttccgcaaacgcaggagactctgcagcgcctgtagcgtcgcgtttgtgtgtacaccccggtaatcctgttttttccacagttatttgcgtccatttgcaacctccggtcgggtttcccctcgtcttggtcatcgaagtaagccactttcttccatgctcgtgctttaggtgggccgtgacttttccttgctctttgcaaagtcgtctttctgcggttcccggggaaggagtggtgtctctgccgtgctgccatttgcgccgactctccccgtggcaattttgtcggctgtcctgcagtagtgtgccgttctctgtggataaagtggaagttgattggtatcccttttgtctcttcggcacgcttgccgcgaatttgcatcttacctgacacactggcagctctcgctgtgctcttccataagacgaagcaaaa

SEQ ID NO: 3254 - DNA, 3166 bp, Toxoplasma gondii
gaatcacgacgtgactgaacagctgagagcaacagcttattagacagggttttcttgccttagacatcgaaacgcagtcacgaggagtgctgatatatgagagcctcgttcgcttgtcagctggcatcccacaattcctaaacagctctttctggaacgcgtgctttgtcggctctcaaacttccgaatgagccctctgtttcttgtacaaccacgctggacacaggaaaggctctcgtttcgcagtcactccgttggcgttggttaccatcgatatgtatatatatatatatatatattgttgcgtgcaaaggcatacgcatacaatcatagatacgactaggctggaacaaagtcttttgtcttggcatatattttggatgaacctgtctatcatgtcaaaactaccggcggagtcacaaggggcggggggacgcagcgccgtgtgtcaaaaaaaagggagtgctgcttcagcggagttttgtacgtggcttctcttccgagatcaagtggttctggtcacagcgtgtggtacggactgtggatcggtttttcggagcgtaaggcagtttcaaccgaactaggctaccaaggatggttgctgtcgcaacgaagaatttcaagacaccgcgccttctttagtaactattaagtggtgtctcttctcacgaataagcatcctctgcaaggaaccgtgtggggtcatcttggagtcacccagaggacacagaaaagagaaactcagccgcctggaaacggatgaggttcctcttggatccaggtcaattgacttgcgtgtggatgccaatgggcgagcagagttctgtcccctggtgttgtgcagtcgccggcatccctactgagatagagaaagaagagagattatttcctcgtggcgacctagaaagagcgaaaccgctgtcgcctaaaccctggcgcggtttccggtaagtatgtactgttgcaaatataaaggcaccgtttgagacttcggaactttctgttgacctgctggttgttgaggagcgagaaacaggatcagcggaagtgaccgtgtggatctgcttactccgccggtgcacacagcctcccatcaacttctggatttctacggaaaagcgcgtgtactgatgatagaaatagatcagaggctctctttgatgatataacatatgcatgtatacatccgcaggcagttatatatatatatatatatatatatatatacatatttgtaaggtgtaggggtacttgtttgatattacagataccgcgaaggaataggagccacagtggtcttccgctgagacattttcccagtgcttgctgcggaggcaccaaacagcctatttaactgggctccctgacgtgagagcaccacagagtgaggtcagatatccgagagcttggtgggctctcgcttagtttcattcactcgtactacactttccatgtctactacgtgtgctacaacatttaggagggaagtggcatataagactggtgagaaacgaacacggcccccccaaaagtcagctgtgtgccgttcattgacagaggcagccttaaaaatcttctagtcgtcacactattaaatttcggtgtcattctctcgtattacaggcatctcagttcgctcgcagacgtctgaactcatctcaaagcatcgtagacagctgtgtgattcctggcccctcccagtgaccatgggggggaggagaaaacaaagctgcgtacaatgaccgaatttttgatgtagcaggggaacctaagtaacgtattggtggtattgctgtttcacacttttcgtggcaaaaagtaggaaaccgagagacataaaggcggtgatcttcacaaattcggactgaaattcttgagggtggatatagacgaaggaaccctgtgaaattcctttattccgtggacactttcgaacagttttggctgcctcagcacaacccttgatttcagccaagaactgcctgcctagcatccggcaaacctacgtcttggacacaaagaatgttgcttttactcacactgccagatcactttcgaagatcgtgtaccggttttgccacttttgagaagaggactgcttctcaggcggactcaagtgatggagactgtcagtgctgaaatcgttattagcgtcagttcaacgcagcagtttcatagaaccaccacagtacttgagacaccgagcgatcgaacagtagcttccacaacacaggcagaccaagagaccaaggggccgtcccacaaactgttgctgcgcctaagaggctgatacgtgtctctgcgaaattgcgtgcagtttgtgtgaccaaggccacccaaccatttgggctcatcgcagtacagcagagggcccgtaccatcgagcagtgctgttccttcgttcgcgtctctgttggggtcggtattatattgtacggttctgttccgatacaggtagtgctacacatttggcataccggtgtagtatcatatttttatgtgaaactccctgcgttttctcccttggctgcttgagtgtgcacgctcaaagcgtaacaagctgtcatctcacgttcgttgatagcatctcccgccagccaaatcgctcgaaaaacggcaaaaaagcgctggctacgcggaagcccagcgtgcgtattgtgttaactttccagtatgatcaagactgccaaaaccgtgttttttcgtcgtaaacttgtggtgaagacgaatttcagagaggcggactttatagatagctgattaatgcttcatggattgcctgtctattccgcgctcaaatagttacgttcgtcctatttggaaaattgatcccctttgatacagattccgtctcgacggcaataaccctcctttcgtttacaaacagaatatccgatggcacaagttcatattggtcatcttgaatgaaccacgggtttatagtgacccgcgaggcgttgacggggaaagtgctttttgtcgtggatgcaatttcctctcgaaacagttgatttgcccaacagactggctgctatgtttttccttgactttcgtgttgttgtcacgcatcatgaaacgtaggttgacgccctctcgacgaattcgagaaccctgtcatttcttttggaacgtggactgttcgtagggatgtgaccgaaagcaataa

SEQ ID NO: 3255 - DNA, 3009 bp, Toxoplasma gondii
tgctgaaaggtgtgaagacagcgtccgtgtttttgctgggtcacgttttcttctgtcacctccaggtaagacaacgtggaaggacccgcacaaaacttggtagtgtacgcaccatgcagatttctgcaaatagctcttgtccagtgaaacgtgtgctgtcgcagcttgtggctgtctgcagcaactcgagtgtcgagagcaggggcggacgggaaagagacaaggtggtagggaagcaacaagcgcatacgttagccccagcggtgttgagtcacatgtgtttcggacacgtttcaggaatcacagtgtttgaacccggtaaaaacggtttcagccactgtctgcgtgggcggcgtcgtcctttactacgtcgccacgtcacaagcacgacaattgccagcgaaaaactctggctgtaccaagtcttctctataattgtccacccaaatggcaagcacgttggctttaacatcagacgagcgcggctcgctggctgaggagtgttgattttgctggcgccgaaggcggcctaagaaacggtttttacctctggcaggttacctggttgtcttctgctgaagaggaattacttaaagactggcccaacaaaacagcttgcaacccaaagaaatatgcgaagtcgcagctgaactcttcaaccaacatggatagaagcactttcctgtcgtggcacgaacaacgcaaacgcatgtctttcctaagcactgtagttaacggcatctgatcaagtctgatgaaagggtgtggcgctcagaggcaggcgaacacgacggctcgcatttgaaaaggtatcttctgcgcaagcctgccatcgcaggattgagacagtttgaacaacatgtgtccgctcatgtgtgatgtttttttccgtctcatcacgtcacgagaatgaagcaaatgcggcatttggacaaactcccgctggctctcggtaggagagaacaccgtccacagcgggcgcacgtagcaggctatgtagtgtgtgtagcaccttttcagttccccttccgatagcctctactttgctccgattttgaggcttctgcgctggtcatggcaagtgcggtgccacagaggcgcctgtcttcgttgtagacaaaccggatataggagctggagattctccagcaatttgctttgcgtcgtgtaatgttgtattttgtgtcccttcggcaaataatcgactggttccaacgttacataagggaactgccgtgcatgattcgaagccgggatattttccgtctgtcgccatttacacgcgagaaaaggacattcgaggtttttctgaatcactcgctctacccgcaaaggcgttgtggcgttaatcgcgatttcgggtttctttgtcagagacctttctttgacgttcctgcgtaaggacacaaagatttgttttttctgggaaactgtttatccagtcgatcacctgccaatgatttgaaattgacgggcagcattatgtgtagtgcttgcgttctacatgctgatttcgaattttcaaattcaaccctctgcacgctgagacaggaccggagcccaggaaatcttgttgcacttttgaatgaacatttcgtatcaccaccaccccgatggactgtacagggcagctgaagtgttcggattcagtatgctgcttcagcttggcaaagcgcaaacacggcgatctgtcagtgaggtgtatgaggaaaggttcacgaacagttcctcctgtggcaatgcgagcatctccctttgaagaatcatttcagatcagagctcactggcaagaacacacgttcacctgaaaagcgaatcgtcaatattgtacatcatgtttaaaggccgacagtcgtcttttttggaagtttcggatcccaaatcagcgaaccatgaacacagtcaccaaggatggaatgctgtgtcgagttcctcgcaacatacacggttcatgtagaaagagcaccacgctgagactcgcagggattgtttgtgagcacggcgagcatttacattccctacttcgttttacccgtacatctgtgtgggtgctatatgagttcctccattgggtttcgaccggcttgtcactggcagccgcttagcacgagaaaaaaagttaattcctacctgcgaagtcaaagatacgcaggttttttagtggggatgcgtttgtctagtccttctgcctacagtaaccgctaagacagtccgggtcggaacgaggaccttcactgcgtagacggggtgcaagttcgattgtgtctgcgagggtaatgctttagaaggagttcccacatacgatcgacggatagttttgcctttcacgccagatgcgacgctcccatccaacttgcggtacatgctagtgcgcccagaacgcgtgctgcctgtaactgggcacccgcgatgcacggcgctgaatttgcatttggaaacgccggcaacagcgagacttccctcttcaggtcgtctcttcctcatcccacaaaccagacacaagcgcctgactccttcctctccatttttttgtagcagtccacaagccgcgtctcttccccaacccttctggctcgcggtcgtaacagagtcactccttctgggccacttcgcaagtgtctccctgggtggccggctttgccgcccacctataagtccttctgctcgcgcttctgctctttgcgcaggaaatcaagcagaagaaagatcgccacgtcgtctgagtgtttagcttcgcgtcacaaagccgcctttcccgtccttactttttcgttggcgtcgtcctgctcctttcggtcacgtcacttccttgtctgtcacgtcgtctgcccgcgggggtgtcgccagcggcattcgtcgtacgcactcgttgtgagccaaatcgaaagccgtttttcttgggagtcttctttcgttttcgtagactcttttcgaggactgaagaggtcccctattttttcagcagttctagggacgcagcagccaacggcaaatacgccttcgccacaa

SEQ ID NO: 3256 - DNA, 2924 bp, Toxoplasma gondii
atttggttagtgaagaagggcaccggagtcccgattgaattcagtggcagcagaacggttgaggggctgcagaagtttgtttcggattacgcgagtgtgagcgggttgtttgatgttactcgggatgaactgtaaattgtttttaggatctggtcaagcagtcacggcgaagtatatgctattattttataggagcataagtggtgtttcccagaaggcatgcattatgtgtgggattgctgttgtcccctctttttgtacgttatatactgcgcgtgcggttcaaaagcatcgtttgttaagattctggttggtactaatcgcgtgtctttgcggggtcacatttatgtggtaacggcgtcagaatgattcagtcacctttcaaaagcaagaacttcagttgagccacagcggccggcactatgatgtggattgaagtttcatcatatcgatgtagctcgcgaggctgacgacggtatcaagaaattttagttgtctataaacattatcaatatttgggtatcctaccacggaatgcggtgtctgtggcaggaacttggatatatactaaggcatggcgcccagttcaagattgctacctaactcttccatggatagaaactggctcgctgccagaatgcttcatttttcgataactcacttaagattggccagcctcgcgcgagtgagtacatgtatccaaaactgtatcagtcgtcctccgttggcttccacatcggtggccagtagcataacttccacgttgtcactgatgcgaaaagctgccgcagtcgttcacagagctattgatagcgtcaagccacaaacttaaaagcaaatccacccgttgattcgaagcctcccgttgccaggcagcgtcttcttaccagtgctcgcaaatgataaaaacgaggtgcttctagatttgttcaactgtaactgacgggaagcaacacgcgaagcagaagcttcccaacacgtccgggtttcctctccttaagatattctctgttgtgtggtggcagttcactgcctcggaagtggcaggagcgagcctctctgtccagaaaacgaggcatgctgtaggttataatttagtagcttgtgcagccccgttcacagtatcgagagtggacatgaatgtggaaagcgtgacacaaacaacgaagttgccgtgagccggcggcaacagaaagaagtgttttgcccgtgcatcagctagttctatgaaggctagcgcaatttcgggtactaccattcccccctcgctggtatccaaacgggagggcctgaggttcaaacccaccagtttgttattggatggcttggttcaaaccaccatccttcctggcctttttccgcactgttcagttgcacaccacggaagtactcgtccagcaacagacagacagctaccgggtgcaccgggtgtctaaatcggcggtgtgccggcagcaaaaaccgtgaattagagaccgactccgtacccgaccggcccgtagttcgatgaccaagcttccgtccgcttgttcccagagcaaagaaaaactgtgagggtaagggggggcaagatggggttcccgtgcagcgtcgctccgcgcgcacgcttccccaggtttggggagctcggcaagagaaaagtggtaactggaactgcggctgaggggcgacttctgttgaactgctttccacagccgtgcacaggaggggaaacagtgcaggtgttcgaattatttactgtttcatccggcggccagattgccagctttcttcggctgagggggggacgagtccgagtacagtggtggaccggccgcccctcagaatctaccatcgaaggtgtgacggcatgtgctcttcaaaaaaagagtttttcttcccgtactcccacccagaagcgcttacgcactcttgccgcatccgcggaaaaattgctggctcttttttcgggttgttgtgcgttctgggttcctaaagccgtgctcactcatcaaagcgcgtccacgcacagacccgcgccacgtctgtcggtttttgaagcccaccacaaagaaagcgcagtgtgtttgtatagttttgagatagtgttgccccccaaaaagaggacaaatcgttcaacagagaagagcgaaggcgttcttccttcgaagacacgcgtccacccgcaacagaggtatcaaccgtcccgagcaaactgttgcgactgtgccttgaatgcaagtaagcgttttgcgtgattcggaaatgctcggtgccatatacctcctagagaggacgggcagtcacggagctgtaaagcctccaccctgcattccacggacagagcgttgcggcctgtctctgttcctggttgagtgtgtctaccggtcgtcgcggaacggccctcctgggttgttcccgtgttttttgaagttggtaatgccccgctgcgtttcatgcgtcgaagtgaaatacagtcggagaccaaaccatctcgatggaaatcgaataacgcagcaagctgctgtcggcgtccccaagccgttgctctgtggccgccgttttcaaccctcgattttcaactctaggttgtatcattcctcgacgaacccccgtgttcgtccaacaagttcttcaacattcgtgaaatcaactgcggaacgtgcgcggatttttcgtctccatcccccaccaacgagaccccttgtatctcctcgtattggacccgcgtctaggttccgggaagtcgttgcattcccctttcggcctgggtttcaagcaaagttaactcgactgagcccgcatctagcggactgagccttggacagttgcgcatttgcgtctgctcctttgtacattttacctgcactctgcctctggtccgcatctcgaaacgcaagttcctgccaaccccctccctttcgctttctgcccgtcgcatgcga

SEQ ID NO: 3257 - DNA, 1503 bp, Toxoplasma gondii
agtgtgagcggagcactagggatgtctgttttctaagcgtcttttgctgcgtgagcatccatgggtccggtacgccttcttctttttctccatgggctggtatggaagcttgatcagagcatcgacagaaatccgatttcgtgtttttgctacactttctcttctcactatcctgttcgagttcattggttggagtacgtggcatgcaactctgagtacctgagtggttgtccccaatgccactattgtggtccaggagaaaagcttggttgcagtgtgccctgctattgatgaggactagcggggaaagtctgtactcagtgctggcgccgccctggccagaacctcaatgcagaacccctagatccacaggtagacttttccttcagaaaagaagctgaccattctaaaacgctgcgtttcgacggcctgttactgtggcacagctttctgctctttgctagtaatgtaacttgtaagccattagacaaccagcgggcgagctggtgtcggggatcggcgagacttcactgccacacagtccacctatgcacgatctggcagcaatggaattaatcaccgactggatgtgactccttgtgcgtatccagaggaatgctctggtgacagtcgactgtgtgcaacaacgtgtgctgcatttagtgtttcacttttcacgctctctagaaaagcgggcaacctagactagtgcggtaccggcataacgtagggaacgaaacatctccactttcatagtcgcatacatgcagtggcatacgagatgcatcagttttgctaccacacgtttcgtgcgacggtcgtgctgcaaacgtggttccagcgaaaatgctcagagtgaggcactgctcggtctgtaactacttgcaaagagcatctgtatgatgcgttgtatgacgaagagtctgttttcgatagtttcacatgctctcggaactgttggtgtattgcttcacgtccgctatactccgtacaaagctgccaatcgacgaaaagaagtcccgagacagcgcatgcagcgacgggcaagtctcctcaacaaggtgcttgctttccacataaacttcgcctgtgcaagggcctgtagatacctttggtttgaggttttggacgtgtgtcgatttcgctgcacatgtcgacgttagatttctttcgatcttcaaacaaacggagagagtctcgcatgtgtagctgtcttgtttggcacacaccaagaaagcggcatcgactgttcgagccgacagtttttcttgcacagtcttttcccggagcggatcctgactgaattcttcatctacaaacactcgttggcaccgtttgttgtcgcgtgtctcagacgcaagaggcgcagacaaatgacaccaacgcatgcaggctttgttggagtgtcggcgcatggagtcaacttttggtcttgagctcggcaagagtcgtcttttttcacaatcctgacccccgctgctgtgctcagatcttttcgatcga

SEQ ID NO: 3258 - DNA, 4218 bp, Toxoplasma gondii
ccgcaactctcaactagaactaacgtacatttctgtacatgcgcacatgcatgtatatatatatatatatatatatatatgcatgcacgtactgtctcttgcatgtttaatgcatggagaggaaaggggacgcgggcgaggcgacggggatgattgcgcaactgtcttgcgtcgttgtttgtctgctttctacaatcactttaaaagagatgttgtattgtgcacgcggtgtgtggcaacttttcggttcttccactcgcatgaacgaaaatcccttcgtgaggtttgcctgcgtttggcgttggttttcttgcgctggctgccgtagggaaattacaacgtctgtgcatcgggtaaactgagaggctcttgtgtgtcatcagaaagggggtcaaatggcgacagcttatcgccgatcatggcatgagctaggcacagtcaagcgttgaatgaggatagtgaaggcaggggaaacaaaggaagcgagaaggtagacaggaaatattaaggggaagatgaaaggtgatcgttttctgtttccgcactcgcagacctgtttgttgctgcattttccttttttcggatattctcttaccatcgacggatacttcttggatgacagaaccgtaacgtagcatccgtcaagcaactctaattcacttgcgtgtagtacgtatgaacgaagttatctacatgaatcactgacaagcatgtacacttaccgtacaccgcctgcgcctcggattcagggataattgcgggacaagaaatggccatcgtgaattcttgactgctaaaaccgatgcaggagtgaaaccgcctcgtgtcattcacctcaaaagtacgtgcattgtgagccgcactgcttctcccgcattcagtgactacactcataggataacgcgatgccacgaaaacgttcctttctcgggattgacaccacgctcttttctaaggttcctgttctactgtcctctgtgtgcgtctacgggtgcgctgggcctcaccgatccacagcttgtcgctccaaaagaacatcgcataagcattcttcactcctgtcccttacaaagccgaaaagcgggcctgagtatctctgaaacgtccgataatttttggtaagataaacctttttgttacgtggaaatctgcactaggatattcgtcagacttctgcagctaatcgtcaattcagccacaactgcaccttcctgttccctctacaagtgtcgggccgttcccaagatgcagtagagtgcgcagaagccagcgagcgcactgccagttcgtttgtcttgtgtcagttgacgcagactcgcaaatgccatacaaaacacatcagagggcaccaagctcgcagttactctcgtgaaaataaatcgtacaaaagagttccctggggaggaacaaagtatcaacgggcttccgtctgctgtactcaatcgcgggagaaacgaaaactgtcctagttttgagaacagagcttcgcttcccgttttcgactacctgtcaggtagacacagccagaaaggactgtcgtgtgggtaaaacgaggcgcctccgcgatgcttctctgggggcgcgggaaaaaagcaagaaacgtaccgtgttgaaacgcttctacgcagctaatcctgccgtacaccggaaaatccgcgggggggggtctctactgaatgagagaggaggccaagacaaaaacgccaacggcaacaccagagacaaccgagggtctgaaccctgcactgtctacttctgcgtctttgccgacagcaattttgaaggtgcaagtcttttgtggtgtcgttgttttctcattttctagttgtacacacttgaggcaaatttgctgggtggcttctggcatcgacgtcaccttaaggacatagtccttcttttcgtcggggttctgagcaggcggtgtttgttcttgcggtttaacctccagagtcgcgtctttgagcactgtattcagttcaactttttctgtgcagtcagcaccagtgaacacatttccccgggcgagggtggggtccgcggtgggggtctctgtgccgcaatgcaaggtgagggtgccgggctctgtaactgcaatctttttctcgccctctccgttgcaagtgagatcctctgtagcgcacatcataagcatggacgcttccgccttgtaatgaagatacgacaaacgaacggcagagacacacatacagggacgcccacctgacaatgcacacgcactaccctgtgttgggggagactcgagttgccaaaatcttcggttgttgcacggaacggccacccaaacataccacctcacttttcctgaaacagaactgaatgcctgacctcgcgacacgctgcctgagacccaggtcatatcagctagatagacgcccgacgggctacagcatcggaagacagcagcccgaaaacaacggagctatcgatattcacacaacaacggaggctgcaagtagatctcgaactgctcttctctagtacatgcacatttacacaccgtgaaggattcacgtcttgtttgctgcattcagcctactttcagcgcgaggaacatatttttaaagacgctctcgatcacacgacgtcaccactcattcagaacacgttggtacgatgcagtggatctgtttctttcttgactagcgtttgtgtccaacctctctcgaaagctatgatagaaacacttgccttccacggcgcggccgactgtgcgtcccgcgatcgagatgacgacggggcagtcttgcttgtttgccgctctgcctgagcacgagaagcagacattctgcgccgtcgcggggagtgcaggcacgaagaacgcaaccgtcgtttcggatatgccttcgcctttgatgaccgtcaggtaagaacccgggactttgtcactcaacgcctcaggggcttgtgacgacaagcaggtcgttccgtcggcggaagccgcgtagaaccgaccctgctgcactgcacgggtcgggtcaagcggagaaccgtcagggcaagtgaaaaaaacttgctggccagcccgagtcactgaaagcgccacgcgtgtgtggttttcgacactgaggtctgcgccaggctctgccagcacgcatgtattgctcgtcgctggagttcccgagacacgtgcggcgatgcaaacagcggcgagggcggcgaggactccacgcttcatgaacgctctcgcccaagagtgaaccatcgtgtccacagtggttagtaacttggcaagggaagaaagaggctttcgctacggagacaaactcacaatgttctgcagctgcagacacaagtggaacgagctgaggccaaaattgcacacactgcgagtcccgggcgtagtactatcggaccagagcggtacagcttcgcccatcccgaaaagtatgccgtacttcgtttctacgtcgcaaaaggcttcaataattcaaaagaatagacaagaatcgctcgaagtctaacacgccatggggacactggacctcgttcctcgttctgtcttgtcggccgccgcctcgattgtctttagactgtcgcgttccgagctgcgcacctgacgaccggctcttaagagagactcgttgaaacggattgcaacgacgtcggcttatattcggcgacgaaactttttcgaaaaatctgcagacgagtaagtatctgtgcacaccgctggccagctaatgtgaggcaaccacaatcgtaaagcgtcaagaaacagcagttgctgcgattgctttcttttccgctctttgagcgtggctgggagaaccgcgagaagtcgagcatctttacctaacgaaagggttgctaaaagaggacgaaaacagagcggttgctcaggacctgaaacggctattaacttgttccttcgtctattctcgttcactatttctgttcccgaaaatcctctccggcccccagctgtgtttgcgtagacggcgaccgtgccagcaagcaacggctccgccaaggtgtatttccctctctctgtcctaggaaacgccttatcctcttttctgactgcttttcgtccccgaaagacaatcgctgctggccaagcgtcgcctgcgacacacggcgactgggatacttgttcatctgtcgtcagccctggttctgaacgcgtcgtctgctctacaagttggcgtttgccttccccccgttttctcacccgtttctctctcccagaaaacaaga

SEQ ID NO: 3259 - DNA, 2025 bp, Toxoplasma gondii
acgtgaaaagagaccactaaagtgaagagcatgataatcgtgccgcttgtatgccaatgcgggtgccgaatatatgctagacacaactatacttaatgggaggcctctgctttcctcgagtctgctctaccatgaggacaaacgagtttcagaggtctaagtatgcgtacaacctccaatcttttcagcgatcaagtaaacatgagacaattctcaccacttctggggttgcgacttgatacgcaatggcctcctttttgatatcccaaaaggccaccagagctttttgttgctgagcagcagcgatgtatcgtggaacagaaccaataccagcaaccgcggcaccaatgaaagtaggtcttcctgtttggatcccgctttgtactcccgctccctcgccggccccagtaagcctctgttgtatgacaccgcggatgctatcgacgacttgcagggactgtggctggatcaacagcaaacggtcgtacgtgggaagctggcagtggtcgccgcgttcttctgtataccggatatccatgttgccggaacatctcacgtcttcgcgtatcgcggccaccagacgggttatctagcccctctcggagctggtcatcgactcaggtacttcaagtgtattgttgagttggagagagcagcagcccaatccacaaacgctatttgcacattcagagtagcttttcagggtcgaccatgccctcaaacagcacggaggcgtcgcgtacgccgttcggcatcgacccactggtaacagggggcgtcaccacgtgaaacaaagaaaaaaggcaggacaatagacgaagtggagcctcaactgaggtcatccgcttccttttaccttcatttcgaacgccaggaaacagagcttcaacctactagagtctacgcgtcggcatggatcagtgtccgtgtgggcgcgccccggaatggacgaatctcaatcagtaatgcaagggggacgccatttttaaaaagcccagcaatggcgccgttaccaggagatctagcaacttccttcggctctggacgcagagctttaatttgtgagcatattgttggacttcacatctgtcaccctgcatatggtattgtgtgcccgcttccaaccaaacactgcatgctccagcgagcactgtaccactgtgtcctgctgtttggatacagttgcttcttactacgattttctctatcgttctccattatctatcatgttttgttcccaacatttcgttgtcctcaatcgtgactgccatgacacagtcatagtagggttctgttttaccttcatccagaccgtgttgctgtcgcgcacgcggcgcgtgcggcttctgctctgtgagtgccggctacgctggaactgtttgaagctcggttgcttcgtgtagggcgtgtagaatgtgtccaccaggaagctacatttgcgattgaaacaaaggagagaagtctgcatgtcatctactgtgtagccttctggtatggcacgtccgtcttagcgggtggatacgtgtttccacctttccacctggatcccaaatagatggtgcggtaatttcgcccccgggagatacgatggaagcagccgtaatggctgcgctgcaacagcgcccttccctacatgcggtgatcggcacgccgcggcctccttttactggtggtggccgcgcgctcttcttccacgccctgtcaacagtgggttagcagctccccagctcggccaccaagctcggctcacgaaacgcgccctgcatcggaccctcggtacgcgtgacggttttaaggcaggggatgcgcacgcttgcgctggatgctgctcctggccagcgcgtgctgatcgcgggagtggtggtgatgcggcagcgacagtgtgtgtgcctcggtgtgagaaaggtgggtagcccgttgtgtgagccgttacttgcattattttctttcctcccaggtcatcggctacatcttatagaattctttttcgcttctttcgcggcttgtttccattcttttccaaga

SEQ ID NO: 3260 - DNA, 2479 bp, Toxoplasma gondii
tctgacccacgtacaaagtgcggctttcattcagaggaagaccttttccctcagtctgctgaaccccgtgcacggcgtggcgtcgcgggtttcaacctgaggcgtcgccgcctgcaacctgtcacctaccggcgtagtccatgtacacctggccgctgaatctctcgagttctctctccttgattgcctcgatttcgaggttgtaggcgtcgccgtagcgctgcagaaaccgcgagcgtcgctcatcgtagctctcgccccagagaggacacgagggtcggtgtttttgcgcctctgcagctgcagccatcccggcggccctttcccgcgtggaagcctctgcgagcgggtctccttcggcgtgacttgcctcagacgaagcgaacagctgcgtcgccgcataagctgtcgagtagcgatctgaagacgcttcgcggccagctgtgccagaagctctccgagtgcactgagagggggaagacgagtccacgggttgtgtctgagtggcttggaggcctgtgccgccgtatttttctggacccacgttgctttccccggttctctcttctgtctcgctgcatccttcagtgtgtctccgcgccgccgccgcttcagctaaggcctgactgtctgtcgggacgaccaacgggatctcccctgactggtttgcgtcaccggacagctcgcgcgcaagagcagcgtctggtgagttgatctggggtacgggagagtgttcagtcgaaggcgtagtcgccggctccgagctcggtgcagaagcgcatgcgcatccttcggaactttcggcgacccttccaacttgcccgctgactgtcggcggtgcctcagccgtggctgcggttgcaagacacgaggcaaacagaagggagcagaaacgaagtgtgagtctatacgagacgcagtgatgcccgcgtgcctgcatggtcgaacgccggccagaagagtcgctctcttccatagtccagaatcgctgtgaatagagatgtgcagagggtgcaccgcgacgcttaggttaccgcagagacgctctgcgtgtacagggggcatgggcaagccacacggaaaaaaggctgttcaagcaacgacgtgcgctaaagcaaaaacagtttcgcggagaaaatgaacgggcagtctccgctgagagtgaagggtgtcaacagtcgggacacactgtaaggagggtccggtcgttgcctaaacaactcctccgtttcttggccgatggccagcgctcatgccacgatccagcagtagcacgctggattttccggcaatttgaatgcgaaaatctgaggaaagcaaatatatgggaaaaaagaaagcgagaacttcaaagaccgctctacgcgtccggaacggagctggacaggcaaacgctggcgtccacgttttcaagctccacagttgcacagcagtcccgtagtaagcgcaatatggacttgtggaggaggaaaaacacatgcgtgcctccaaaatgccgcgcttgagagctctcgtgatttaacaaagtggaagtgttgaagtgacaagtcagtcaacgaagcacagagtctgtcgacccgttctagggacaagaccacaaggcagtcgcatgcgcgaggacgcagatgcggcaggacattcgatcccgaaattcaagggctgagttgcggttgctgcgaaaacctgtacactacagcattcatcatggagctcttttcgttctgcgaaaagccaagaaactcttccgttgagaaacagagagaatcagaggtccaaaaaagggaggcatctgggatcgtgtcttggcgagtgccatgcaggctatacaaccatgcaggatccggggaaagtagcaagcgctcatggtaagccaagcacgtgatcctggtactaatttcggtgcccacgttgacgtaggcttgcatttcccaacctccaatgtgcttcacacctgtcagttttcctagctatcgctctggagctcactcaacgaatctggcaccaaattgacagcgcagacattccgttcctcatgttcaaacgacggacacttgagtccgcgacagcatacatgactagtttggagagtcatcgcttctggtcacatgcttctaatgaatagttttccgtgtgcaggctgagattctgtctgctgactctgcctgcacagtagcggaagctggtgaatctcagtggggaaccccgatttgcttgtggagggtcggcgcggagctgtggtcaaacgataactgacagcacggctcatcttggtgactagtcttcgtgttgttggggagagttcttcatttttggctgatattctgtatttggttcggaggcagctctgttgcgctaggggtagaacgcagggcagtccgggcaggtcaagttcttaccgccttgctctgtcgcgtagccgctatctgtactgtacacagcctgcggacctaacgggtaaacgctgttctcctcttagcaa

SEQ ID NO: 3261 - DNA, 2016 bp, Toxoplasma gondii
tccttgagttcggagagccaaacttcttgactccagatgtctgcatttgcactgcccctacagagtaggcactgggatccgagaaagtccaagcaagaatttctcatgtcagatatcgtttctttgtcgacgctcgccacccgtgggtgtatgcgaagaggcgatccagaattaaaaaaagcttccggttttgcatgcatgaaacagggatctatgattcaaagtgtgaggagcgagcccgatacattgaactatggcctggtattatcccctgacacacgcaaaacttactggacgcccttgacagctctaaagtcaatacatatatatacatgtatatatatatatatatacggataaacatataatgtatatatatatctatatatataggagtgccgactctctgcagagaagttccacgggttcaagactgtcttagacaggagagagaagtgcgaaatcccgtgcatgtagaaaaccagctgaaagcattgctggattaactgaagtgaggagaggcagttcaatcgaggagacgtttcgcggcatcgagaaggtgatttcagaagctgcaataaaggagaacccggtcagcgggactttttgaggatgcagcaacgcgcagatccgtactaccgtggaccaagagaaggggaatacaatttcctccaagtagattccgtaagcgcgaatgtacacctgtatgcatgaatggagcagagaaatgttgtatgaaacaaatgtcgaaaatcatcatccgttcttttgccatgaaatcaaccgaaggcacgtcggattcagcgaaccagaactggagagagtcctttggaagatccagacatttcaccactctgaataaaaacaccgggaaatcgggaggtctctcatgcccttcgtggcgcactttccacgacttacaagacagaggaaactgccatccgaaagaagaaaaagtttcggggacttccggcgttcgagcgcccgtgtcacacccgagtgtgctgtcccttcgccttcctttatggagtctatactgcaagcagagagtccccaacgaagccgacgaaagacatgtggtgaacagaacagagaaatttacacttctcgacagaaacagaggcaagaaaaaactttccaactgtccagccaacggacccgagcacccaccatggcggtcaaaccgctcgagtctctctgtcctttctcgcggttctcaaagtgtcaaggcgattgtccttctctcgttctctttcattcaccagcatatttggagaggaaacaaggaggacagtaaaataaagttgagaacctattctcacgctttcagctaacataaaatgtcggtgagtctccttggtttcgatgaacgagaaaagatgcacgcgtccattattgacaagacatgcacgctatcacggtccttggtgaagaaagacggccgctgtagatttaaagtttttccttccttcgttatttctctccttcagcgacgttcatggagccgaggagctggtctctactgtcgagacacctcggaacgctgtcgctgcaggggtctgcgtcgtcctgtctcgttttttctccggtacaatgtaggaaattgcagctcttttgttcgccaaatggaaggatgcttcggctgaagaagaaagactgtttttcgtgtgtctgttactcattgtcgccattgagtgacgctcttcttccccattcttttctgttttcatcgtggagtcacacaccgcagcgggtgccggatttgctgtgtctcctccgacttcttctgcgcctttgtctctctctttccccgtcctttcctcttctgaagccttttcagcttttgcggttttccacatatgcgcaaaggccatctttttcgctgtcagccgcgataccacgcgtcagaggtctctctactccgcgcctcattcttgttgacgtttcgtcctttccttctgccagtttcttcttcatcaacgtttccgtctaaacctccgtgaagttcaaaagcga

SEQ ID NO: 3262 - DNA, 2478 bp, Toxoplasma gondii
ggacaagaaattggcgtacctcctcgcataaacatctgcaagaaagggtccgcagtcgggttcggaagagggggcgccgaggcagcagcgctggtgttggtgcttgatgtccgagcagctgtacagaacacacaagggagatgctcgaaagcgaatttgccgctttattccattctgcaagaccaaccgcaaatgctaaaggcagctactcttaacattggatccaatcaagacagatgaggccggagaagcactcggcgtgtcgttcgtaccagacgaatcggaactgggttgcgaggcagaagaggatccgccagctggcgcattgttggatgaagccgcaactgcggctgcgctcttcaccaagtgaatgatgtgtccgtcttggacatcatgtgtagaaattaagtcggcgtccttaaggatccgtcctaacagtccacaaacgcacggaaaaaacagttcgagtcctggtcgtggtcagcacgccttaggcggaatacttcgtcgagcaatctccgaagccatttcacaatcagacgtgtccaaaataccgtcttcgatatcatttacggaaccctgtgcacacccctccctgtgcgggtctgaacctgccacctcggacccttgttctgggctattccaaaacagccgggtgttatgtgttcccttcgcacatgtgggagagttgagtgcatctcgtacggtttgtaatgcttaggaaatagtatatcgcaaatgtgaccatttctggcttatcctgcccgaaaaacactacgtagcgtaacggaacaacaccctctgctgctgactgaagcatagcttgttggcggatccggaacgacagtaggtatgtcatgactgagtcgtgggaagcattgcgaactcggttttctcaagtcaagcacagttctctaacctttgtagatgagacgttgagcctggaccggaatttcagtttgagtagcgcatttctccttgacctgcttgacagtccactcaggttccagttcgagaacaaactggctccccccggagaccttgaacgtcacttttgcgggcggcataatggaaaaaggacgaacgaaacgtctttcgtagtgatgggcagactacgggttaacagtgaccggattcagtcggggttcctcagagtcggccgcagaaaaccgtggaggcaagcactgaaggagtcccctattgtcaccggaaaaatgtggtgcggataacacagcaagttcttaaagaggtttgtttctggacaaatgccacagttgatttcaggcaaactgccccccgcaaaaccgcaggcaaaagcagtacgcaacagcgtccttcagaaccaccccaacttgggttccgggagtggagaaactcgctcaatttctaggactctgtggcagcgttttaagacaagaacatattctgcccacgcacgagtagatggctgagaaaagcatgtgtcaattcgaaacgaaacgcaattggcatcagtggactacgagaaaaaaaatcgcacggcgcctccaccgttttccgcaacttgttcggtctgggcgtagttccgcagctcacagttcgttgcggtctttcccaaactcccagacaggactctagagggaggacttgataaggttcccgcgcaaggacaacacagaggtcgacggttactcgtgattcacgcagaaactttgctgaaacagaatcttagctattatgtgcgtcggctgcccaacccaaagtcaacaaggtgcagggggaagaaacggggggggggagagcagctgatgccacgttgtttcacgtcttctggaccctcgaatataggtcccagtccgtctgtctcataagcgacgttagtttcggaggctgaaatgtcacgaaatgttgcccggaaaccttcctccattcagtgtatcttcggctttttgcggctgcgtcgtttttcgacttccgacaccgccagcacacttcactgtgagtgtccctgacacacgcttgtgcacgctggcggagactgggtggagattccatagactgtcacgaaatcgaggaggcttaatggaagacccgcctgtggtccgcgaaccttttgtagggagtctggtcagccaaaagagtgattgtctcactttggcaagcaccacccgagtcttcaaaaagtgccgtcgagccattagcactgattgccgggcacacgggagacagcggaaatacccgggcacaaaaagtgtctcgattcctggtggctaggcgtacgaacctctggtagacgacccgatggtaactgggtcagaaaaagtcaaaagaccgattcagcgtgtcactgtgtggcgtcctgaagggaagtagagcgctggccgtctggggtgtctctgtgtcctattcggggtatcgcctcgctgctgctgggacattaaagatttttggatttttttcgggagtcctcactctttgccgctacttttcctggcacca

SEQ ID NO: 3263 - DNA, 2277 bp, Toxoplasma gondii
ggggatttagtttagccacctgcaagtgaaaaatggtcatgtttgcggcatgcaggcgtgcggtgtgtgctttttcccccgggtgacaagacgagggcagaagcttttgttgagagccccaatgaacatcgacaggcagttttttttttctcagccgtgcgttgtgcaggggccattcgaacctgttcagatgccggttgtacctcgacacgcatgcgcttcgtttaaggcacatgcatttgtccacctttacacttggacgtttttctgtctaggtaaaaacggtgggaagcgtcaacggcacttgtttttctctttttttcaactggtctcacgttgttgggtcctttatacgtggaatggctctcggagtctcgtatttgcgatcctcacggctcacgcaacagagcgtcggctgcacgaagatcgtcggagctctcgcgctctcggatgagtctgcccacacacccgccagcgaaaaggaggagaaaccgcactgcgtctagtaactacaaaggtgctaaacacagctctcatcgcgcaacaaaaggacaactgtcacgaatcggcctgtgcaaaacagtaaacccaaccacttctcttctcggaggcatacttcatgaataggagatcccgacgactgccaacgcttaaaaactcgatgtgtgcccatcttcagccgcaaagtgtcctgcacagcgtatccgtttggatttaccgttaaagagtacccagtctgcatccacatgtgtgtatcgcaattatgtcgatatctgtaaatatagtcaaatggatttgtatgtgtatttgtgtatgtattgagtggccactgcgtgacgacagtgggtttcgctattttacttgttagcatgatggagactcaacacaaacaagttgtgaagcagattcccgagtgacaaattctgttgttttgaggcgtaccttcattgagacaaaacagcaacgcagatctttgatagcgaacaaccttgtggcgcaagttcgtgcctacataaataatcctttctctcctctctctctttatatatatatatatatatatgcttccctacgtagatgcactttttagatcacgtccacgtctaactacgtacgtctatgtcatcccctaggcaccatatgagggtccatgtgttgtcctggtggtgaagcgggcaacagctttcatgtaggtgttgttcggcatatgaaacaatgtaaatttgctcccaaccttttacaagaccatatgcagacttaactagttgagtagacatgtaaagattgatttatatgaagatggccgtctccccatcactgggagggttgtgagccagtctgaagcgagcattgagatgaccagtttctcaaggcccttcacggttcaaggcctcgaggatcacgggaagtggggagagaaagttgaattttctcctcgaaagattcgtctccaactttaatacgaatcccttcccttctataccagagtgcgtaaccgaaatgtggctagaaaacgaggagagccaacgctgagacaggcgctcgtggaattaatcaccggctgaggtgcctttgtttttccgggctccatggcgctcgcatgcagttttagcgtcgcgcgtttttcgcgcgttcttgctttttcattgaggacatccggcgacttctctgcgcccttgtctctctgttctcgccggtgttcacattgtcaagcaagaagtctaatgccactctgaacctatcttcgtttttgttttctcttcttcttgaagttcccctcttggttgtcgctctcttccccgcccctcatcttcgcgtcgctccttgacaacgagtggtgtgttctgcggcgcagaaaccggaactttattgtttttgagtcaagcgttaatcgggacgccaatttgacttttcttatttcttaccgggttgaaatctgccttccccgtcatctgcttgccgaaaatcagcaaaggagtcagctgtctgcccacaagggccgcgacttttccgtttttccagataattgacctcggccgtttttctgcagttgaaggaggagaacccaattcctttaaaccgcaacgccgactctcgccttcccggcagcaaaagtctgtttcgccgctgtttctcggcgaagtcggtttgtcgaggacagagacgccattttctctttcttttgcgtatccctccagtgtgcttctcacgcgcgaccgaagacccatctttcttcgcgactctctccacagcattcttcgaggagaacgaatctta

SEQ ID NO: 3264 - DNA, 2956 bp, Toxoplasma gondii
cgtcacatgcatatagagggtgactcttgtgcacgcttcgaggaagcacgccggtggcttacatcaagaacgaattcaactgtatccagacagtcccagagacggtcttcccgagttcgcaactcttccagtttgctcgagggcgtcactttctctcctttctgcagaaacttctgacacatgccgacaatgtagttcgtcacctgaaggaaaaacgccagcgagcacatacatgcgtttctacacacaactgtctacacttctgcatccacacagattcacttgcctgcacacccatgcatacagacgcttgcatatatatatatatatacatgtacatatatatacagctacttggaaatttagaatggaatgcacgcatcggtaggcacaggtgtttcatagcttctaatctgcagggtttcccagttaatccataacagagggagacatatctcggctccaaagcatgcaagcatttcgtccataaacatatatgtacataaatacatgtatcacgtatacgtagggggtacacttgcatttgtacgttgattaacagtttttcccagacagcagattgcccttcctcgaccacgacgagctcaccgcattgatgtcagtgtcaacaactggactttcttgtttggtcgtttcgttagctgccgaggaaggcagttcctttccactatctccctgtgggggagttgcggcggttgttgagagaaggcgacagagtgggaagcggagaccaatcgtagcctccacgcattcagacgcacgcaaacctgaaagcactcggtcagcagcgagcacctttctctctgaagccaacccgcgggcagaaaaaaagaattttcccgttttctcgacctgagatgtcgactgtgagtggcgtggcgaccacaccccctgggcggttccctttgctgggatggaggataagcgcgctgtagacagcatgcatctgcctttctcgatcaacggcaaaaatgcagactgagacggaaccctgcgaatgagctgctccatcttcacagtgcaggctgaagagagggtgaacaacataaaagaagggtggacggaacgaaaaacggaagcacggaacccggaacgacgcagcgaaccgggtcccgggatggcagggacgaagcggaaaacggcttcctagccgcagagcagagaacgcaagacagagaagcaggaaggattcactgtggagaaggaggaaaaggacgcaggcaacaactcaagaacagatgtggccgacagcaataggcatcttgggaacgaaaaagagttcttcctgcgattaatcgtcgtcgcagtctccctcagcgaatcgctgagtcggtatgcgaagagagaaaaaatttctttgaagaaaagaaaaaaaaccagatgcgacccagggtcgagcgctgcaaaaaagttgactccggcgactcagcggctaaagaaagttcgcgtcgatcccgggggcccctgttgcctcttccggttgttcgcagttgacaaggttgaatgggacgttgctggcaagaaagggaatctttgcagaactcaaacgggtacacgagcgtggtatttcgagatccacgtgcggtgggaggcggtctagtcgcagcagacaattgcagcactgtgcccttttgagaagagtcttgtctttgtgctgacccagccgagtatcagttgtacggctgcccatttattgtgtataacacgttttgacgggtgacattcagcgagcagcgaagtccataaagactggtaagcaacctttttccatattccgtgactctagttctttctcttgttctggaagtcgttcttcgtcctacgagcatcgtgcgcgacactctctttgctgcctcgaaattgcgtacacagcggtcccccgaggagggtatggtgagggggagacatacggcgaggcacgtgcaatgcgcgttttgggatgtgcaagtgcattgtaaactctctcgagagcgagaaaagcttgcttggccaggcaaacactgtatgctagagccacagtcactgcagatatcgcttctgacggataaacgcgggctataaaaatctcttccctcgcgctttcccccggtagagactgaactaaccatcgagagattgggcaggcggccggtttctacaaggagggtgtgcgcgtacggctccgttttctcatccattttgcgtcgacttgcatacccgcaatatgagaacagcttttcaaaagccctgggaaagcgaaacaaggcagatgcatccatcagtgcacgaaaaagaactcctttgcagctcacacttcaacctggattttcctgcagggagcattcggtcgtggtgttacgtccaatcggcctgtggcatgtggctgcttgcggaagtgtgtcgccctctccgtctgtcgagatttgctcgcatttttcctacaaatctctttcggtgactcgtgaaggttctcgtcgaagtcacgagtagccctttttggcagaaagggcgccgctttttccggtgaagcttctctcttttcgcaagcttcctgtctaactccctcaagaaagtatctgcgtaccaacgctacaactcaattcacgcgtttccggccaacacacgccaggcacgctttgttgtgtcgtgagtgcgtgcgtgttcgacacgaacaattcttacgggtgcaagtttcggttttggtgtcggtggttcctttctcttgggttctgtttcgttctgctggcattctgctcgtaccgccaagagaacggctggccacggtatcgttccccggttttacgccgttcatcttccgtgcgagtaccggagaagcgttttcccgccaggcctttttcctactaccgctccggaagaaccgcttgatacgatggataggtagctgtttgaaactgaagagactacgctttccgcctttgggaaaaaacaggggaaa

SEQ ID NO: 3265 - DNA, 4586 bp, Toxoplasma gondii
agaacatggacaaagaccaaggaacacagacagtcgaaaaacaccggaaaccggcaaaagccagagaagactggacatctctgtcgctgttcttgataaaggttttcttgtcggtcctcacctcatcaaccacctgcaactgtgtaggctggagaccctctgtgagctgagaagtcaaaaaaagacaagcacaacaagcatcggaggttcggtcatgagaaaattccaacgtgcgtgttcatgttatattgacagacttatgcagatcaagagacgctcacttttagtggacagacacgctcagcgaaccacatgcgcggcaaggcctcgatcacacgcgtggatcccgtgaactccttacgacagctaaatcggttttacgtcatacaccaataatgtttatttatagaggaaactactcaaaaaagcaaccgcttctagaatatataatgcagtgccaagttgtatgatggtttgactcaatgatcatgcaatattgtatcgttatatcccattggacaatttcgtaaactttaaaataaaaaactaagcaaatcgccaggtccatacacccttctgttgctgttaggattgacagctcagtgcatcgaaatgagttccacatcggtgacgtgcgttagaggtggtgtacctgaatttctgttcccagtcgaattaactgcgagagaaaataccgctccgtacgatcacttcgaagataggtaaagtcacaaccgatgcagacatactgtgtggtaggcaaacggatgcgttttcaagtgcgtagcctaggacaaccgatctggagtgtgaatggagaaggaaacggcagggaaaccccgagtaacttggagcaaacaacttgaccttcttcgcttccaaagggaaccgcgggttgcacgaaatacgcacgaaatacgcgtcacacacatcgactctttttttctcggaaagaaaacgtgtctgcgttttattcttctgcgtggcgcgctgaccttcttttcaattgcgagggtgaccggacccttcaaagtggtttgactcgcagaagaagcgagacgagagagagaacggaacaacatttctggcggctgttggcttgctgcagacactctgcgaaagagagacacacctccccactctagcggcggatttgcccctctaaagatttccaagcgctctgttccactgttcctccccttcgaccggacagcaggtgaaaacgaacaagcggaagactgagaagagatgaaagagtcacacggaaaggcgagtgcaaatgagagaggctgcaagggcggataaagggcagaaacaggtttttgcctcaagcggaaagtgcgtgcggcatctgaactgaaaagacacaggctccgcacagagagacacgccgtggaaaggagaacagcaacagacaggaagaacaccgggacgaaacaaacaagtgacagagctgaaaagcaggagaaacgggtatttctaccgcgcggggaaacggcggtgccactctgtgtcggccagcaaacctggcttatcccagaaagttcacttctcgacaaggatcgaggaagagagggacataaaggcgtctgaggaggggagcaacagacccccatgagcctcgagggaaaggaatgcaacctgcggaaaagatgctcactaaacggcgaagagaacacacacgcagccttggccgccttcccgatacactcttcgaacggggagtcttttgcccgtttcgtccgaaagaaaaagggaaactcacgactccaagaagacagaagtaagtatcgacatttctctattgaatcccatcgatgtccctgggttgagccagagagacgagacaaaagcggagacagggcgcttcgatgaaaaaagctagcttgcagaagaaaaaagggggattaccctgtgagaaaacgggggaaagtacaaaagaccatttataggataggtgtcgcccacgctatttcgaaagtgggccgttcggtttattatgtgtactttcacctcgcggctgtcggtgtcttgcacgccttgagtttcactacgcgccgcagcgccgctgctgtttttgcgttccttcggtttcttcaccaaacccaaccatctttagtttttaaagcatctttttccttcctctctttgcgcacttgttcagaccaccccgtctgtgtcgcgcaaaaccctcgtactcttttgccgccgtcggtggaagccgctgcccagcacgcaattccacgtgcgttcgcctttgccaccgccctgatgttagtgtctcgtgatcctaaacgactcacaatgacagagtctctgcattctgtaaaggtgggcgtcatgcatggactcctgtgttcgctcgtagtagaatcgagaaacagctcctcagacgcgggcacagtcagtgcagtggtgttgagagttgcggcttcaggtagggaagtggattgacacgtcttgccagatgcactagttacgccagcaccgcccttcctctcagaagctgcaacttttttcagcgaacttattggtctgcaactcttccgtagaattcaatggggagacaacgttctgttgtgaatggctgctccacaactgccagcgaaaacttccttaggatctcagtatgcagcaggatcaatcagaaaacgttcgcaaaactccacctgcttgtcttatggttgtgcgtctctcttgtgagaggaaccgcgctcagacaatgcctctgaaagaactctgccctctcgaatctttctggtatccgccagcagtctaccatcataactagggattgcgtggtgcccttgctgagaagttcatgccactcgctcttgtagttctgtcactcggataggttatcgaaactgcggtaagaaaacggtaactcggtttcaaggtgtgacggcttcgccgtaaagtctaaccgtgacagaggatttgcaggtgcctcgcacgggactttgagccacgcttcttctattttaggctgccagttccggcgccttcaaccctctgagctccacgacaacaaagcaagcaaatcacaaactgtcatccgttttgattactgtcatgcaggttcgcgcggagtcgtgtgctcgcatgtgtctgtgtaagctctatagaagaaatgtggttgcgagatcctaggtggtggaccctctgttcaaatgtgtaaccactgccgtttgcagtttttttcccgcgattttttgttttagaaccctagatcccttcactcaacgccctctggctccctgcatgcaatgaccgtcgatgaaattcagtctgcatggagaaaaacactgaataaccgatagccgtcaaggcacaggggaacgtagatcgcttgcccggggcagcatcacctcgctctaagaaggctccttcgtttccctcgtccatgtgcagtcacactgcttccttcttggtagtgagattctcaggaagtttgcctgacttcaggcgggcttgccgacaccagccaaccctcaggctcccgtgaaaggactcacaccgctcgagtgcgcaattctgtcaccacagaaaacacagcggtaatgcagcctgcttctgttgaggaatctcaacgtagctctaactgcgaacgccatccacgacgagttgtgccagatatgaatgctgttcgatccgtgtatgaaaggacacgagctctcaacccgttctatcgtcaaaccgaataaacagacattatagtacctaggatactgaatacgactccagttatgagttacaggcaaccgagttctttatgattgctgtacaccaccacctcactggaccgcttatgacgatttcatgcattcatgtgacttttgagagctcccccctcgatgctaggcaggagtggaaagcatttgaaaagaaagtagccaaccagacagctcgtcccgccgcttccgggtctgtcaggaaagcaagcaattctgaaggattggctttcccgggactcgttagtgtggctgctctacagcactctctgcgtgcgtcactctctgaagagttgcgtttggcgcgttgtcttctttgccaggctcgctgctttgtgtgatttcatcgaacgccgttcttcccgcggtaacaggaccggcagtgaaagtacctaacctctccccgagatgggaggctttactgagtttcaactctttcccgactttccccgctcttgcacgttttctctcgactagcagcaaagtgtctcgcgccggatgtggctgtgttggcggcgattagacgactcgcgtgttttccggtttagatctccgggaaactttgccagacgctgcacactctgccgggaaaagcgggcagaaacgaaacgcgggtgactgtgggagaaaaaccgtttccggatatagaccgcccctccgcaacatgcttgaacccctctgcgactgtgctatgacacagagaccggcgatgttcgcacgcttatatgtgaagggtcgaatggagaaggggtgccgcagccgtttgccgtttcgacgcaaggcgtcttatttttttcttccttttcgactttcttttctctttcccgcgtgaagtatcgctgtcaaggaaaa

SEQ ID NO: 3266 - DNA, 2901 bp, Toxoplasma gondii
agagaatctccaagatgtcggccttcgtcttgtctgaagttgcttgtccccacgactgcagcatcgggcttccaggaggtgctccacacgccaccgaggctccgtaagaaacggaagaagaagaaagagaaagagaagaagcagaagaggaagagagggaagagtaaaaggaagcaggaaaagctggtggaggagacgaagagggaagatgaggaagaggcttggcgtccatcacagggtgagaaaggcccctcgagagacttgcagaagaagagacgagagaagaggaagagcgggaggagagagaagaagcgattcgagaggcttcgagaacaagtggatagtcggtcttcattgaggtctctgagactcgagcagtctccttcgcgtcgtgttcttctccgtctcccctgtctctgtttcttgtctctttcgaaaacgataaagttccgcctccttgttgggttcccttgtgatcctctctgactttttgactcgcgaaacatccagactccgtgagagaaacctcgacgcgggcagtgcctccccgcgcaggagtttctgcagaagttggcgaacagtgagaggacggaagggcagaagacgacgacgaagaagggaggtggggaagaagcttggcgctagccacaggttgagaaaggctcctcgagagtcgtgaagaagaagatgatgctggcaaaagaagcgttccttggcaaggtcgagtagagtcggagcctgaaagggcgactccggcggaaccgccttctgctggctgttgggactttgaaggagctgccaaagaagcagccgaggaagaaaacgtcctcaacatgttgcagggaggcgggagaaggaaaggagaacgaaaagggagttaaaaggggaacgacggctgtgaggacacaatgggtcgcagacgggcagaaggattctgtcggaacaaacccagtgtagagagacttctcagagtgaacagcttcacctggttcgttccgtctgtctgtcgctttcgtcttgcatctactccattctgacgattccacggaagttctcagaggagtgcttgtctggacttttcgcgttccacgtcgggcgccttctcgcactcgatttgctccgtcctttcagtcgcttgctcgccacgggtcgctcagaggtgaaacgcgaagcttcagacaggaagacaaaagcagttgaatgcgaagggcgcttgcgccgagcaagcagcgaggccggggcggacgcgcgcaagccccgtgcctaaagtggcggagaacatggcaagacagtcgattttcacgaaaagaacacgatccgaaaaatgtgtgagacaaggaaaaaaagaagtacgaaggagtctattcctaaagcaaagcgcgttggaagcagccgggaaacagaccgtcacgtcgttgacctgccttgtccgagttaggtctcgcacactgcgagaaaaggtttctttccgccaagacaattcgctggacaggaccaaaagagcgctttttgagagtcaatcggaagcgccgcttcgtcacaaaacacattttctctccttgttgacaaaaagttccaccgtctgcgcgagcggcggagagtcaagtcacgcgagcagccgcgcagcggcgaacgagggatttcgtcgcggatcgaagaagctccaaggaaagtccatcggctttcagaacaggtgaattcgagagttttttcgcggaaatttcaaagccccgagaggcaactacacctctgtgggactaaggcatattgcccgcgcagaagacaagagtccggtcgctctcgcgcgttgctggctcggcgccagacgcgcgtgaagaggggggcacctgaagctacgaaattcatacctgaggttcggcgaagggaggaggaagcgcgaaaaaaaggagttccttgacagcagggaaggagagactcccagaacgttttaacgggagacgggcgagaagacactgctggcctcccttttcgcgttttccattaaaacaagaagccagactaaccacaatgcgagcaggtgaaaggtggatctctcagggtcacccgagacgggacctatttcatacaggtatttcaaaggcgcgtgtatcgccgggctctaagggaaacctgctcggttactccagttgagtcagactccactttcgagatacacacacggtcaagtccttcaggactgctctaagcattgtcgaggaaacttcagaattcgcatttttcgtctacagccccggcggtggatatgttcacgcagttgggaacgacttctagctcggtggaactattccgcccagacaacgcagtgcccgccaactggttcgccgtcctttcgggaatcgactgcgggcagcctctggaaattagaagtttccatgaaaatcgcgtgcaagacagcacgccgaagtcgcctgcctcgaaagaacaaatcgtagcttcttgaaatgcatggacagagcacagctcgaaacttcggaaaagcgaaaaagtgacggacgcaacacgagggcagaagcagttgtcctggtcacgaggagcagggttctggtagctcgttttgaacgcagagacgaagtgaatctgaaagaaaaggttggagagatttcttgccacgataaaactaagtccaggagttgacatcatatatgagtcgaagtcagccgtaagtcagctgtcccactgtaagggctcgcgtctacgagaatagagtcgtagattgcctcttcgctgtcctcctctctgttgttttcctgtcattctgttccagttgagtgccgtctattctgtgtctatgcgggttcacagccacaacggtctacctctcagaacgtccacccacaactgaaactcagttcgtcgcctatcatctcccggcctcgtgaa

SEQ ID NO: 3267 - DNA, 2750 bp, Toxoplasma gondii
ataacaaactacgtgtgtgagcctgaaggtgatcttagcagtcacgatcgtgaatggcgcccgtgtgctcggctctcggctggcggcggttgatacagagagatcgacacatctgggggactggatgagaaaggtgggggaaagagaaacgttcataccactgaggggagtctttcgtctatttctaagctgcataagatctactcccgctgggcactccgggtgtgatggaaaaaacaattgcttgccttgctgttggaaatgctctgcatgagagacacttccgaggcaaagtagagcccgcttctcttaagcgccacgtgcaagatgtctctctttcttatatgtagaggaataaaatctatgcaaacgaaggcttaatctttagtccttggggtcctgcggcactgtagcgtctcacggaaacactagtgctgcgtgatgaggcagtgatgccttgtctcaaactgtgtttcccttccttcgtttttctcgatgaaaaagcataacgtgaaatcctatattttgctggtgttgtagacagagagcagcagcatattattctcctgtgagacaagcagtaccatctcgtgaccgtgactcaggggcactcgtcagcgaacaaaaacaaacaaaccacagctactacgacgtgacagcgtaggtcttgccatcgatgttttggcacagaccccaaatgtgaactctcctattcacgaacacgtcaggacggatttctcctttttcatctggggcgttctgatgtcgaaatgttcattcgcagcaagaggttgattgtctttgtgactggcccgagggaagcggatctttgtcttaaggaccgataggtgctcgtgacttttgatatggagcagcgtcatcacctgggattcagtacctgcttaccgatgtcatgttctgtcagcaacgaatacagtttcatggtctagggaaatatcgcgacgacctgtttgacggcaacgtgactttatcacgtactgtctgctctcacgccatcatagaaatcaaaaacacattcgctgctttctggcgcacgacgtccagagaaactgttttctgtcgtcagtgtagtattttgcaatcagaatctagacgtcaaaagacgcatggaaacaccttgagcgaacctatctcaacttcctcagtaagtttgttacacggtttaaggggggttcgtttaggagtcatgcgaaaggttacatggcaacacgttggtgaacaaacttttatcggcgtagaatccgtgaggcgcgaaaccgttcggcgtgcttgccttttacagaaaagcgacgtgacagtgagtgaggtttttctttcatgcttcagttgtccattttctttgtcacctcgaaaattatagcggtgatctgttgcattgagatcggtcaaaactatgttggtgcctatccgatgatacactaggccttgaagaacacatgttgcgtgtttacttgggctttatttatggtcgtacagtctggaaccttgatgtcgccaattaaacccactcggagtttccttgccagtggctccgctccttttcgcgaactaaaaacatctactctccgaacgcgcaccaatccaaaagaatctgaacatgtttcatgagagtgaatggaactttattcgctcatgttcgcatcgtaacaagtcctatggaacgatgagggaatgaacagcaaatcaggcaaggccttcgaactgatcaatctagggcaggagtgggacaaagctctggttccccaccagcgcacgaattttcgcaaccccgagacacagcacagaggcataaacagtgccttgtcgttggctaaccatagagaaattcacggactgttttgtcgtccttgttttaagtctcagaatcggccgatgccccaagcatgatatgctcgctgggaccgtgcttccagaaaccagtaaagagtgcgcatcgcacgggctgtcatacattggagacgaaccatatttttcccctaactgtgtccttcaaaagagcctttgaggtacaagcgtcctctctaagttgtataatcagaaaacggtgggatgctgcggagtaatgtttcaccaattttcgcggttctctccccaccggccgttctgcctgtgcgcacattggcgcacatgcgaggcgagaattttcttaaaacaacagtgtcagttgtgctcggaaaaagcatatcggcttctcatacccacagaaggtttatggtttcggatacactggcagcgccgtgtgtccagtaacgagcaacagttaaccggatggtctaccagtcgcacgctttgggatggacaaacctttcagtgtctttgtgtgcactgaaaatactttaccgtgtatattacaacagtccttgtggcgatgctctgaaaacttctagctgattcatagtgcgtgaaccctcacaacaggattccaagcaaattgcagtatgtgtgtttttagtcgacgggaggcgcaggatagccggttacgatgagtggctttttgtcgacttctggtgcacgatgattgactgaccaagcgtttgcttgtccttctcgacgaaagagcagcataaataaaacagctgtgtatacgtgaaagtcagtttatcttgtccctccatgcaattgattcctacgcatgtaacggtaggacgcccttgccatatgccgagacactccgaaaaaattcttggttctgtctcttcagagagcggataaatcaattacaaccacga

SEQ ID NO: 3268 - DNA, 1478 bp, Toxoplasma gondii
tatgctggttcctcaaactgcagtgaaatgaggctgtttcgcgttttccgcttgtttgtttgctaaatgcagactcaggaagacttggacgacatcaacgtcttgccggagttcttgaactagattctctttcgcctctttcaagcgcgaagatgtttttcgaagaaaagtctcttatcgaagaatccagtgcgcgaaagtcgctattcgactgactttgctggacacgctgctccttcgcttggtttttgtggtcgatatgcaatagctaagacaaagggaaagcgaaacggccgtcaacctcaaaacgagccgtctgcgcgtcgagtttcacagtctttgtgtcctcagccaggagggagtacgtggcatctttcgcggggcaatcgattttctccttgtgtcaacaagctgcactggcatattcggtgtcgcgggagttttctctgttttacccgccatacttcgagggaacctttgttttcgttggagcctcatatcgaagatttttctcttatgtataaacgtggcctgattcaacgtattaattgcagggtatagtcgttctctttagcgagcttattgtgcgaatcgaacggcggaaaacaacgccgttggtagtcccgcggtttgatagggggtacacccagcacgtctctcaagccaaagcttctcagatatggccaagaaaagcacagtcccgttaaacacacaacccactctccggagcaaaagtgccacataaagtgctgaaagcccgattcagacgagatgcgactgtggatgtctgagtaatgtctagcgacgaaggaacttccacttttgctcgactaccggtgcagagtcctgcccacagtgggtttggctgaatgcgacgagatgaaaatgaactgggaatacgaaacaccggagcaacgaaagggtgacagtcctctgtttgtgcccggagaagcctctgacacgacagtccgtacattgacaggaactgattcacgcagaaaggaattacaggagccagatgacacatggtgtgaggcttaatgagattataaaattgtggtctcggagcacaattttaccagctgaagaaggagtggaccctttacaagcagggactgacgaagttgtcgccatccatgtctgacggctcactgccagtacccagtgacctacttctccaatattcttttaggctcgacatcgacggcgtcgctcaaactgaatctcaaaaagagttcgtttttgtgccatgcgacgttttcttccggagtcttgctccgccgtattcgtttggagcacaagaaacacagggacagagctcgacgagtcgtgccttgcagtttggagagtggcgggctcccgactccggcgtgaaggaagagacagatgacagacccactacttcgcgcctgtctctcatttttacatccttttttcacggcgaactcctgtgcatgggctgcattcatccccagaaa

SEQ ID NO: 3269 - DNA, 2035 bp, Toxoplasma gondii
tctaattattctcctcttttcctcagacgcggcttccgcaatgtctttgagcgctttctgggatgttcggtggaagcggaattgcatgtgggggcgattcttcgagtgtaaccttacttcgaaatctcgctggtttctcattagtacagctgaaacagagaggatgcacattaagcccgtggctggcctgctacatgccttgcctatgttaagtccttgccactctggcggtgaccactgtgcagtatttaataccgtttgcatctccctggcaagtgccgtcatcttgccgagttcctgacgaaaaacatatgcattttgtggtgatttcatccccgattttaatataccttctcaagcagtctttgttcagcctctgcctcaattttccatactcgtctgcctcctgtgatgaaggatgtagacgagcagttgctcgacagaatggcatcttctctcctacccggccgacggacgacactgacaacgggagagcctgttccactaatctagtcagaaaaggtcgaatgagaatcgctccccacttataaaaaagaagtaagaacaccgaccaggccttgtgtctgatgagaatgcacattttcgaagtcaaaacgtgcactggcaagagacgccagcatagaggaggccgcgaaagcgacctgaaagaaccgtatcattgcagtcctgcagtgctccactgtacttccgttttctaccccgggaactgtgcagcaacactctcaaaccatacctatccagtgttttgtcgggggaccgttgcatccggtgtacatacaggtgacctacctgtgacgcaccagacgctgccgtgtttgactgcttggtgaaacgtacagagacacgtaggctgactcagaggacgactcatccccacgctcactgggaccaggtgttcctttgcttcccagtgatgagggattcgtgtagaaatggaaagtctgagctgagagggatgcgtcacagcaacgatcgtgtctacaaagcactcacgtctgaaaacagctgccgaaaatgactgttgtcattggcaaaatcaggtgctgcggtgtaagatgagtcaactttttggtacaaatgagactggacttcagcttttttacgaaacacggcgttgttgtcatggttatctggatgttatcgatccaaaaaggaagtgcgcagaaactgtggatgctgagcagtgttgcggcgagcacctcgcccacgaccttagggtgcttataaaccataaagccaactgagtgaaattactaagggtccactttgttgtacttttgacttccggcataacgtatttggctacgggcgaacacagaaggggccgtcccggtcgcgatactcgctgattttcaagctcgaacacgaggaaacacgggaaagccagacatgcatcgttgggaaagggcatgcaactgcagcggcgggcatgcgtactcgccaacaaagggcgaggctcagtttgactgtgtgtgcacattgatatctacaatgcttgacgagcactttccaacgcacacactatcctttataatgctgcataactttcccgaataactggccgaggtactagaatccgctggtggagcaaaaggcgtcatcatattcgttgactctccatgtcaggtgtattgctgctgtggtgcgtatgcacatgctgtctgtcatgtttgagctcgtcgtcattagggagtgcaccacaagcactaattaagcctaaacaacatcggtcgtggttggcactcgtcagtggtctgctacccgcctgaatcaaagcagcggtttataggcagagggggatcgccgccatcttacgttccatgagttcgaaaaccttttcccgttgtcgttctttccacataacgtcattgtgaatttcctttagtcggggacattgcatttctctgttgttacgcgtaggctccccgaccgagtaacttatcgcacgaaccgaatgtgtcgaagtagagtggtacgttttcttttcctggtgtcgctcacttttattttcaca

SEQ ID NO: 3270 - DNA, 2365 bp, Toxoplasma gondii
  misc_feature (552)..(571): n is a, c, g, or t
cttttgaagcgactctcttagcaagaagaaagacttcttgcccttcctgtgacacagaacgaccctcgttgtcggtggctgtccagccgctactcctctgtagattttttatcaagatctgagaggtggtgtcactccttcctgatgttggcgtagtttcggtcgctgacgcgtccgtgtgaagttccagatctcctagaaaacgcaagtggggcggcctgtctcgagagcagactccctcggcactcgaacagaatgtgcaacacttcccgatgaatccgaaacttgggaacagcaccctaatggcagagacatttgatagtctaagcatttcttcattaggtttttgcacatttcgtcagtctgtgcgttgagtcccgcgaccaaagaatcataaacggcatcatgacgaagtacgtataactagctggcttggtgcggtactgaggtgtgagaacgtccttttcacaagaaaataggtttgacatcattgagcggctcatcgtgaaacttcgaaaaaaaatcagtgtttgtgtgttctaccaagaattnnnnnnnnnnnnnnnnnnnncacttcccgatgaatccgaaactgggaacagcaccttaatggcagagacatttgatagtctaagcattctttcattaggtttttgcacatttcgtcagtctgtgcgttgagtcccgcgaccaaagaatcataaacggcatcatgacgaagtacgtataactagctggcttggtgcggtactgaggtgtgagaacgtccttttcacaagaaaataggtttgacatcattgagcggctcatcgtgaaacttcgaaaaaaaatcagtgtttgtgtgttctaccaagaattcgacgacgcagcatgcctgcactcggtgccgtcagcagccagaggagccagtgaccctcttggactcgcaggaaaacgatcttgtttccgttctaaaatgatatggaaaaccactgcgcttcactcagaaggaaagctgtcgaaaagaaagcggtgctaccacccgtaggaaacgaagcaaccgtgctgatagattctttcgggggttgtgcagaaataaggttgtacccttcactggtttcgccgtgagcagaaaagtacgaactttcttgtctccccgctcctgttcccttgagacagcgatgaacggtaaagagcccttgacaggtgtgtgtgtgtgtgtgtgtgtattatgggtgaagcaacagacaagaagtagaaatttcctcatacctaattgttcacgagaacccgccttccaccggctactgaacaagcttcgacacgctgacacttattcgatgcagagcacgccaagtgaagaaatcttgaggtgaactttggagaaatgtggcttgcaaataatagttgcaggaggcacaggtgaaacttcatcgtcgcaaaacaatcttgacctggacacctacttgacatttttgaggagtgtcaattgtagaagtaaatgcgtgtgactcgtgcacagagacgaacacatacgacagattcatgcttaaggatccgccagtggtggctaacttacatcggtcaaaatgtacatcgctagaacggctgcactgtgaggaccaataacccagtgttctttcaggtcgagcaggaaagcacacttaagccaagaaagctttttgcctgctcgcctacacggtctgcgtaaagggcggggaagtttccgtactaactttagtgatgggagaaggtgatattcgtatcgttgagtgataggtgtgttgattttggggacgctcgcgtggggcttcttgcgcagaagacatgcagcccccagtagccagccctggagaccattgacttgggaacgcctatctatgcggcattttgagggggaggagccttgattagcgaaattccggctagaaccgaaggccctgtaagataagggaaagaacgtcgtcacaaaaaacgtatttccagtccgtttatcgtagccgctcgctttcttcctgcctttcttttgtcacatctgccagaggcacggataatctctctgcgacggtctgcgtgtcttccgccagccttgtgacattttccgacgcctctcctctttttctcaacttctccacaaaaatttgtatttctcattgaaccatccccttgcttttcttaccctgttccaacgaacttcagttcagtcgctctttgctgccattattcactgtcttgcgatataagctgatccttttttgggtcggttcttcgtagattccgcgcgtccctcccgtcgcttgcgtttcccccgcgagggaaaaactgccgtttaagcgcgaattcctcttcttttctgtgtattttttctcccaaccggcgacgacta

SEQ ID NO: 3271 - DNA, 2404 bp, Toxoplasma gondii
tgtacggaatacttacgtctgtccatatctctaccttgacgaaaaagtggatttcgaatgatctctttatacgaaaacgaatcttttggaagccaaaccggctgcccactgcgatcggtggcacttggagagttccgagaggtcacatatggctgtcggatgctactggcttccctctttcttcagaaacgtaagtaacaaagaaagagggtgtctcgctataccccattcgcgctgctacgaaccagttggaaacgtagatctgcaatcgggttgtactcactttccttcgctttgttgacgatggtgtcggcctcctcctctgcctcgaggagctgctgaatgagtgcattggagcccttcgctgccgccatggtgtgaagaagtgacgaaaaaggaaaagaaacaactcacgggccgaaagccaccgtaaaaggcgagagtcgaattgcctttttctactcgagacggaaaggcagtgtcagatggtcgcagacaactaagcctcgtgcccttgctttgctacacgtagagcggggatatgacgactcgggaaaccccggggcgaagtccctccctcaggagcccaggaaaaaggcgggagggatgacagccgggaggcaagtacgtacgagatggcagggaagagtttttcttcggcagtccggatcaaaggtgaactccccgctagcaagtagtgatcaaagcaacaagttcgcggtagacatcaagttgccgcccgcgacagggttcctctacctgtccatacaacgcgagaaatcgcaagaatgtagaagctgcaaacaatgtggaaaattggaagtgtaaaaagcggactggggggtacaagacgtctctcaggggaaaccagatctgagtcgtgagtccaactgtcaccgggggctgggttgaatggagtcggcgaggaggtgagaagccgaaaaacagcgaggtgttccgttatatcgagttcgaagatactgcagcgaaagctggacaaatgagcgtcagcgttgagaacgaaacagtccggcttgatacagatcgcagagtttttatagagcaaagcccctcaagagaaacgagccgtaagggggagaaaaaacgaagaaatggacgagcatctaaccgcagcacaccacaaaatggtcgtgtgtgtagtcaccgacgacaacgtgagaaactgcgggcttctgcgaatcgaaggaaggagattttccagacgaaaaaaagtcccggctcagccatccgtgtcgcgtgctgccttcgtggctccgaagaaacgaccctacgcgatcacggggaagggaactcacttggtagcaactgcaaagcatagctgcgtgcaagcttttcctctggaaacggagactgttttcggagtgttcctttagccctcgacaatcgcaggcttcgtcggcctccacagggaaaaaaggtactatccggaagaaccttctactgtggtcaggggggctccgaatataaaccgacgtgcaggcggcgacgtcgtggctgccacacaaacgcaagcagccctttttgatccgtgaaaaatcagatgcacatctggtctcttttcccccagtcgaaccatgagcggggcagttctcaccctttgaagaacgtgtttcgtcctgaagagcaagcggtcgtttcctcggcccgcgccaaccagactttgcacacgcttgtttatagcatggctttgtagccgcctctgcggaatacttcctctggcaggaaacagagcagcgagatccgttcaggttgaaacgcatgtccgcctcacaccactccccggatccaagaacaaggaggaagcactgagttcatgtttcgcagtatttcatctaagaccaatgtgctcgagttgcagaccggatcacctaatttcactactcgctttgtgttctaaagggagtcccaacgtctcaagagcggtcagaatttgtggttgtattcaagcccgtcaaaatagccagtgtcagaaccgtggtatcagcgtcatattacactttcacttgcagcgaaggatgcgttgggactaagggaattttccgtctacgctagagtagcgggcaaggcaaagtcgtagcgaaggctgcagcgaagaggcagaagatccagcttcgtcaaagtctacggcaccgagaaaaccaagtgatagaggggatgtttttccgagagttcttagtcaccttatcataccttgtttgccttctgcgaagtcccaggttgaagcgacatgccaagtggacgccttggcaagaagaggcacctgttggaatgcgttggacaacggtgtacatgaggtcttctacgattcactcagcaagtcccctcggacaaagaatgtgttagacaacacagcttaaacaattactttgacagtttgatggaa

SEQ ID NO: 3272 - DNA, 3592 bp, Toxoplasma gondii
tgcggtcctttcagcagaacgaatgggcgattttctggaataagtttttgaaaaggaacagtgttaactgaggagagattggacgcacaaggattcgaaccttgttcaacagaacttgaaggtatcgaactatatacccgataggttgttcaaggtttgatgtcgctgtctggagatcagacgcaattcaagcttcgttttttattcgcggttgcttctgctcgcgacttttcgtggcttcttttgacaggcgatggaggcgccgcctacggggcaaggcccgggggtcggggcggcgggcgctctgggcggagcggtggcgccgacgcgacgtcgatgcatcctctcttcagaggtcttcacggaaaaaagtgaactttgacagatttgagacagccaagaaagaggcgaaaggccagaggcgctgttcaggttttcttctgcgaccaggcgaagcagaaaagactttggggggcggtggaactgaccggagttctggtgcgtctgttcagaagggtttcgcggaagaaagtgctgataaatggcgcgataacttaagcatgacgggagaaaggaaggaatcatggggcgagcacggtggcgcggacattgccgctcggcggctgggccgttctaccagggaaagatcccgataccttattctgtttttctgtcgtgccgtgaaatgtgtacttctcgactgcttttcgtcttcagacaagaacaacagaaaacgctcgcgagtttcttctttgttcaggtttttcgtgcgaaaaggagaggaatctcttgtagacacggagttactgtcgtcgcgtgtatgaaaccgctctttcgcgctgcacgggtttgcgcgctgaagaacaggcaaaacgcctcttcagatttgcacacttttctggttttttaacaggaaaaactcataaaaaagaagctggtgatagaaacgagaaaatcactcgatggaacaccagtgatatctctaatttgctgctgtagcgtaaacacctcggatgcgaagccggcaactcgaccattctagacacgggccacggtagatttcgtaggactttcacttccataactccagttatagagtccttgaatcttgtgaattaataaatacacaagaagacggaagagcgaaaagaacgaaatgctttgggtagaaacgatgtaggttttattgaacagctggaggtggaggaatccccaggaatgtttcatagaacatggtacattcttgtttgactttgggatcttcacagttccttgctagatttcatgcgcgcgcgtcgaggcgcagcggttctcaccacaaaaagtgttggattttactatctacgacgtcaagactactccatacctgttatgttctaggcgtagtgacaggaccaattttattgcgcacctaaacggcgagagatactaagacgctgggccaggggagtgacggaacccaggcgaaagtactttttccagtgtgtacagaatccgatttatgtattccgtactgagtaacctcaggaaggagaccaccgaattgagtattattattttagtacggcttgcatagaggtgcggcttttgcatcaccagtcggcaattttatcggcgacatggtgtccctgtcggtgactgctgttactttttccgtagatggatgagtgtttttcctgcatttgtgaccgagtttcgttcccattaattccgtagcgagacttaaaagctcaatccaagtgttatttgtgcacggaatttgcgctttgcttcgccgatgtaatgtccggcagtcaacgggagtgtggagtcgaggtgtggatgtttgcgccgttctcatcgaagtgtacgaagtcttttgaccgtcacttctccacgttccctcggtgaagacttgcttcgattttagctcgatttctacagccgaaattcttctttccctagtcaccgtcagggcgaactcaccgcggatggctcgttccgcgaccaggatgctattcgaagaactaaacttctgaccagctaaaagagctggatttcaagaccctacccgtacgttgcttgcgtggaagctctccccaggaaaaggtactttgtagaaacctagctacttggggacttgggttcagaccgacgggaccgacaagagtctgatccgcatattccgcgaagcagggacgcgtcactgcacactgtgtgtgtctggcactcgggactcgttgagaatttccgcttcttctggatttgtgaagtggaaatgtggcgggtgcccaacgccagctcgctcgctgctgcaggcgtcacgaaccgctttcttgtctcacttttcggttgcacttcgtacctgcgtttttctgccctgtttgtcgagcaacgcactcgcgaggaaattcccagcgaactgttggcactgtctggaaagccgaagcacgcaaaagcgaagagccactttcgctcctcaccgcgtttccttagccttcaccttgatcctgtcgccctctcgcagtagaaccctccactttgtttgcctgtctctcgagcgcttccaccatccgagagtccttcctcctggccactagggagaacgccggggctgttggccgctcgtagcaccaaattggagagggaaacggcgtggtttgtcgctgtccatttccatttcgcgagcgcggagccgagcgaaaagtttcacctcgcttcttgctcgtgtgctgtctctggaggaagttctactgtgtcaccgacagaggaagcaaaagtcgatcgcctgcaggccacccgttgtgccacgcgtgcgttatcctttgcgtttctgttttctcttatggcgcgcgaaaacacggcgcgtctgcagagtttgtgtgcaagcatgtcactttcgtttacgttttatgttgagactcgcagccgtcccgccaccacttttgcgctcgtggacgccgattgtttctccacctaccccacaggggcagcagactgctgaacgcctcaagatcggcaaaagcagaaatccgtttcttgccgcagtcgctttggcgtcgagtctcagagagtggcctgcgtttttcgaattttctctgctctgaaaattccgctgaccgtcgcgagcgaggcagtcgagctgtgcaggacgcggccatgcttccggtgttctctgcttacacctttcactcgtttctccgttgtctcttcttttctgcatttcttttctgatttttcccaccttcacgaacccccttaaagtaaggactgtggcgaaaggtggcggtagacgcctccggaaacccgtgtttgcgctgggtgttggacaagtgcgcgcctgcgtagaaggcagaaggtctctctcttctttgaacttgtgtccccagaacgcttttttgagagcttggttccccagcttcctggctcttttcttacgactccccctcttcaccgcgtttcgtcgcttcgctcttcccgtctgcggccttcgccgtctgccccgccccgcggacacaaggacggtttttcgctgtcggtccatttccttagtggtctgtttgtcgtccctttcgacgaaaaggggtccgccgtctttcgtgtcggaccagaa

SEQ ID NO: 3273 - DNA, 3921 bp, Toxoplasma gondii
gaggtcagacaattccagggtgaaaagatgacaaggaaacgtcgatatacgacagaccgcagacacacggacttccggcctcgatcctcaggctgactatttgacagtctccgcaccgtgtgacgcatcctctctcgtggcgtgcatgcaagaatccacaagcatctcctctcacccagatgtcgtcttgaaatgcacctcaaacatatatatatatatatatatatatatatgcatgcagttgtgcacacaaaacgatgcatacgtggatgtattaaccacacacacagttatgcgtggatgcgcatactcttacatataaataaataaatatatatatatatatatatgtttgcttgcgtgtatttgtgtgggtatgcatgggcgtccagatatgcctgtctaggtggcatgtgtttttggtgagcactgaggctgcggaagcgtcctttcctttttccattttaaagtctcacctcgagtgtctcccatgagtggaagagaatcacggtgtgcagcgagttttgaaaagacatgggcatgaccccacagcaagaggacttatgtccctccgcagcgacgtgggcggttccttccgcagccactgctttcttctttttacagcaggactgttttccttcactggaaggtccctctccgcccgaccctccggcagcgcctttcttgtcgcagcaagactcctcttttccgtccgcctctctcgcagcagaagcgtcgtcggcagcgcgcttcttctgtcccttgcagcagtcctcgacatcttcatacctgtttctcggccgctgcttgtcatgcgtcttatctggcgtagcatcggaactggaaggttttgagctgtcacggtttcgctgagggtcgggcacctcgttgtcagaagagacgggagagttcgaggcggaggacagagcgccggggagagaagacacgcagtgaagcgcgcaaacaaggaagaacgtggacactcgcagaagagaggcctttgattgaggaccggtcggaagacctcgccgtctggaactggggattttgcggagggacagaaggtaggcttccgtctttctctgtcctccttcgcgtccagatctcggagaagtgctcagagagcaggaagcacctgactgagcgtgcgttgccatcttgactctcttggtctgccctctgtaggtctttctcgaacgcgttctctctccccacggagcgcacacacttgttaatcggaggttcgcttcagcctatgattcttgtgaagttttctttcctctctcgcggagagtcgccacaggagagacacgcggcgtgtgtctttgactcgcgggggggccctcggcagttgaaggcttaaaccctaaaagtccctaaaccctcgactcagaggcagcaagaacgcaggaagagttttgccacctgagtcagacaaggcagacgggaatttccttcgtgaattgccaaggtgtcgtgaaaggagacgcttcctgcatcgcctgtgcctcccgcggggaaacagaggcgcctgccttacacgtctcctgcaatccacagcgcagaacgcgagatcaaggtggacgcgtgcttgcacggaaaaggagagccccccgcgaacgggacagaattgccaggttgacatccacttttccgagaattcttccgaaactctcgcttccttccatcgaaaacaaccaccaactcaattctgtcaagggttgctgatccaccacacagaaaactcactcgcgagacgggtgagaaggcggtggggctgcgggctggggtggcagcgaagcacgtgtgttttctgtggctttcacagaagaaacccttctctctttgcaggggttatgtcggcgcaactcactgctttctttcacgtctttcgagagaatttcctgcccgagatgtgcggagaaaaaaggggaagtagcgactcattttactgacgcgttacagctgaaaaagctgcgggtaaaaaacctagcctgacctactctgcaaacaattttagttttagcggcagaaaatgccactgagagcccacaagaagcctgtttcccatatgcactcacacacagtgctctgttcgagatcttgtttgaaaaatactcacacggaagcgaacaaggcaccgggtttgccgttcggtgtttgcagacgcgcggcattttaccggtctcgactttgcaggaatcgtacttccctctcctcgtccgtgcttgttttttcgacgttcgttccgagctggagtgccttgcagcagcgacacgtagttttctcgagggtttgcggtggaagcgaaacacacgggccttcacagggttccacttcgctgttcagtccagtcgttctaggtttgtgctctgtactactcaagactggatctgtcggtgactagaaggcagaggctgtcgcagaagtacctcttctctggagatttgcgggtggagttgcaaaggggagaaaacgacactgcagagcgaatagatgaagaggagagttgacgagaaatggatttcttcagaccatcttgagtttcagcgttactcaaatggcggtttcacgccttctcacacggctcgtagaacccacaagaccggtgagcgtactcctttttcttgttcatcgccatagtacaacgagtaatcactttagagggaggagggactgaaggtcttagtacccgcagtaataccaatacgtgtcataggtgaaaagtatgctcgtgcagccagatcagatgtagaaatctctgctccctgaaccgtatactgtgtaaatcgcgtcgtcctgtttccgtcttcgaacacagaaagagctttcttttcagattcgcacacgttctggatgtggtgctcctaacgtcagtccgcacagtttgccttacaactggcttgccctctctagggttctaacaggttctttgttttcggaatagtttctcaactgcagtttccacccattcttttcactgcgagcatctcgacgcgggtgagaactctcgaaacgcctcgcatttcttgccccgcttctctactgaaacgtcagtacagcggcacagtcgtctactattgtactatcgagaagctggtctgcggtatactcagctgcttcgcctagatactcgcctgcatacgcttgatggtctgaaacagcattcaacacatctaagtggaattatgagcgtaggcctgggcacacaccgcaactgctgcgctctttccgcggagttctggtggcatcgacgctcgtctttgccgtttttgctcgcatttgtctcgtgtgttgcatccccaggtctgtggtcggcgatttctccacttccctctacacgccaagagaaatgaattccccacttgccgtacacacgacgctggaggtgtatatacaccacacatacaaccaggtcgtctgacgctctgtcgctgcttcggtggttcttcaaacgcgaaacgggcagctcggtctttggcgttttcattgaggaaaagtggaaagtgtggcttcactgacacgcaagactcaaatcgcggacggcgagacacttgcgaagcaggacgagacgggcagaaacgccgttccgcctgtgcatacgggtgtttgagtacggggtcatttcccctcagaagagacacacttttcggactcttgggctctctagctaccgagacgagagagtgacgccgttctacttcgcgcctcggttgagaggggcaagactggcctttttcgacgagcaccttcgcgcaggttcgtgttcagctgcagcagggacggatcgagcgcgggagtgagggcgacttctctcgtttccccccactgtttgtcgcgcggccgctgccgtcttcacttttttttcttccctctttcttctgccctgcaacccccaagtttctgtttcgttctcgcaga

SEQ ID NO: 3274 - DNA, 1913 bp, Toxoplasma gondii
ctttcctttgaaacgcaaaggcaactgcagagctgctttctctccacattgcctccaccggttcctctcttcttccagtccatgtggaaccacagagagcgcacgtgggttgggaaatgtttaggtgtaaacatgcgtgcactcgaggcgtcggctgtaggccagaggagacggcggactcacacatggaaggctgagaggggtagtttacgatgccataggtactagcgaatcgccggtctgggagggattcttttcggcgccgcaggatatgccggtaactgccattacggtacgaccggcataggtaggtacgcaaaggttttcacctgcgacacaaacgcaacctacacaaatgcttgtttcaatcgtagacggtttttcaactgagaggccctctcccgtgcgagctctctacagcgctttggcgagtggccgtgagacatgcgggctgatatctcttatgggctctcgcgggctgtgactacagggcatgtgctatccctgatcttccctttcttcattttgtacggaagatacggtaagacgctcctggagcgcatttgaacgctgcagcgacgcgtgtggttggtttaagaaaggtcattgaagctaagaaccgaagttttcgtgctggatttcggtgtagagcactgcaccacactgtaatgcttgagacagctgaaagtggtggatttcaacgtccggccagtattcatgtttgtttggaagctgttggcgtcaaaagggttggtttagttctgtggatgtgggttctttgggtgcagtggggtctgctcgacctccagctacttccacgtgaatatttagcaggacaatcatcctgggaggagttatctccgggacacgattattaaatggcgttttcagggctgccgttctctgtttaactctatctctcttgcacaaacacgtgacaaaaatctaacttggctgatcctcaagaaacgtctctgtcatgtggaggacctagctacatcactagtaagagtttagagatttgagtgctccacgggaacttggaaaaaacgaaccgttcttccttgactaaactgcaggaaaatgtagtttgttctccgccgtagggacacgcctatctacaagttcccacggggtttattttcacgaaccagggaatgcaagtctgtgcagtgaaagttgcctccgtgcgacagcaacggccgtgtgtaattctctggaaattcgctcttttgagagtataaaaccgccgtccttcagactccagtcccctcaaagtgtgtgcagggaaaggggtgaatgcacccaaggcgccggccgtaaccgaggcgcctctccaaaatgcccacttgaacagcgcgtttccagccgctaaaccacaagttaagtgagctttttcactgttggagtcatggattgccgccctgaggtcttgtgcttgttcactgcggccgcttccagcgtccaacattgcacactcccgattttacgcgccacccgtcgggtcctacgtggaatcggttgtccgacaggcgagcgtttttctggaccgcgtagccttggaaatgcgccatcgaaggatcgacgcaagtctcacacgtttcaagttcttctcgattgtttcaggaggcgaccaaagtcatcgaaaggagtcgactcgagatatacttgtcactcccatttgagcggctcccgagtgcccgcaagcgtcgtgcgctcctgtccctcctgttcaaccgcttcacgacgaatcagttcgctaacgaaaagtttattgactggcttttatctgtgatacaagtgtccttcgagtcgtcgattgacctgcaactcttctgacgtagcgccgcaactcacaaccgaaagccgcttctcctgactctgtcgccaactcgcagtcgcggctggcgcaa

SEQ ID NO: 3275 - DNA, 2591 bp, Toxoplasma gondii
gcctttctttttcgcgattctggcgggtgtacgcacacttgaatgtggagctttccgttttctcttcgcagttcttctcttcgatgctctagatgtgtcttctgtctttctccaggcgaagctgctgccgacgctcctggatccgagacgcacagagttatggagttggaggcgtcgaagttgctgaatgtgttcgcggagagaaatcaaaaaaaataaggactcaaagttgcagtgaaatcatcgaaaccgactggcgttgggagagaggggaaatgtgtcgcactcaaggactgaaagggtgcctttctctgtttcgatcgatggccgattcacgcatatatatacgggcacggttttcttgatgtggtggatttcttcctactggtgtacgcagcagtcgccttcttctggcaggggtctttcttcccagtcttttcgtctcctcttgttcaggtctctcccgctttgaaagttttcctttttctcaggccgttccattaatacatgtggtgtgtcagatttataataactacaaagtcgctgtggttactctcctgaagattgctttccttacatcgcatgcagacggacggctctagagtccgttcacttgcaggcaactcgccgaactcgatacttgccaccaggcgatcgattccctctagtagaaatgcccctccccttgatcctccaatctgatcagcggtctatgatggattttcctctgtcacaatgcaaccgtagtttacgcgttgctttattgggtgaaaaagagatgacagcctacgcagatctaaacgccttccgatcgcggtcgcagaaaaagtatgtccccgcatcttaggcggattcacctttcgctgattcatttgtcaacacaggagaaacgccctcaagaagagcacccagcggcttcgtgtaggcgagcgaatagactcacgtttcgcgagtagatatggagaaactaaaaaaccactttgccagccaaaggaactgtgatagggtggagtgctgcgcattgcgatgcacacaccccatgtccttcgcccctccatgcgtacacggcggccaacggttttcgttcctacgggaattccatcctacaactgtgcttcgctaaaagaatcgagccttttctcgtggtgtatctttgagttgattcgatgacccgcgaaatgctgcatcgccgcagaacgagatcgtagcagcgactaagcagttgtgtcccgtagcttcctccgtaaagagacctcgtgctacctttttcttgtgcagacagaacgggaatggcggtaattctagattgcgacctctgtaactggcatgttcagtgcttctcttgggactcgaacagtcccagaaggcatcagccagcaagagatttctcgcggcaagtctctgaaacagtcggcgggttggagtccctggacagcgagtccgcgtcttcagtgtgtggcgccgagtagctgtccgagactgacgcaacgtttaccttgcaagatgcaggttaagagggcaacggtaagggcgttccgcgggtgcatgtggcacccgaaatacggggattcaggcagcggttgaaaaccagctgaaagtagcagaatcgacgcccacgcctggcggagattcctggacgcgaaaactggacgtcagcgccgctggtctcggcctgtcccgacaaggagcagcggtagaacggttcccggaagaagaacctccaattagagagacgcaaagatgaagtccgctcacaaactcccccctctttcttcgtcgaggaaaaatgacgtttcagaagtagtctgccgaagcaggttctcggtgtaggcagaacccgcgtgtgcagtctgccccggtgagttccgaagtcctgcaagtctgtggctgtagtaaatcgccggtgccttccggttttttctgtcggatatgtgcgttgagattcgcagaatcttgcgcgtagcctccgaaagtgaaaggccccccgctttctcgaggaaattggggctttccctacaggaaatcatagacacggcgtcgcgcagctggctgttggagtatcagccaccggtcccgccctaggacgagctatggcgggtcgcgagcgttcgcttctccctggactcggcatgtgcctgccaacaggcgttttttccacgcggtcgagaggtttgttggccctgagaaggggggtttactcgtagctgcactcggatcgtggagagttcgtgcgaaggaccagattttatgccttgcggcagcgtacacccgcgtcccgtttagtctcttctttctcatctccgcgggcgagttccagagtgaccttcgccaacgtggaggaccacggccaccgttccgccgcgaattccgcttttccgtgcaggtcaaaacgcggtgtcgaaccccaagttgcgggtgtccgtgtctccggctggagtttgtgctttccgctggtgcctcgtgtgaggtccgcccgctggaatgctacaaaggccccaaccgtgtgtctctatacccccgcagcagcgtgaggtcgcgtgtgtatacaagttcgtcaacctggagctggtccgatagcagatatacatgta

SEQ ID NO: 3276 - DNA, 2185 bp, Toxoplasma gondii
cgctagcgttctggttagatatcgctcttttctgaatcacacgcgactcctcgccgtcggtaggaactaacagtggcggatttttcctgttccgttctggacgaccaaagacgtaagtgttgccgagcgacccggtttcaccttcttctgttcagctcggtttatctcagttgagctcatgctggctttggctgaagcacgagacttcgtgaacttcctgcagatcacaatgcacaaaatgaaacatatgataaggcccatgcatatatacacacgtacattgatgtacataatatacatgtgcatgagatacggatagatatgcttgcgtatacacaaataaacacaagtcttcgggtgccgacaggcctccgaaagacggtgcctagagtcgggaaggtcatctgttctgtttctaaagcgattcttcgaggtggatgtaaagtctgtacctcggattgtgtgcccccccctgttgaacctctcgcccatttgagaaaatacgtgataactgcaagtaaagaacattctgctttgccttcttctgcgtaccgactagtctctccatctcacatgcatgatcgcttctcgttctgcgtgtctgttagactccttttcgttgtgtcttgcaacatcttctctgccagactccctctctcattctgataacacctctttgcttctctctctgttgttctttctccttttcttctctctctcgagcttcgtcgaacctctctcttgttcttctcctttctctcgttttcgctctttccttcgttcgcttgatccctgcgttctcgggagtgaatccgaataacaagcgttgcatcggtctcctcgctgcggcaagtaaaccgcccggaagcggaagccagttcctcgcgtacttcttccgcgagttccttttggactttgtcttcgagtccccctgccccgtcctcctcacagggtcttcttctccccggtgcctctctcttctctctccgttgaggcgattttttcgacctcgtgtgtggcgactttgcacagctttctatgtccgacagcacagatcgactgggttttctgttttgccgaaatctgaccaactctttctgaggtcacaccttgtcgttgaaaggccttctttcctcgctcggcgccggccaaagacgacttaaagcttctcccgcaacgagagaaagagaagacactctgcccagtccttccgtgtcgactagcttgagcggccgttctttgcagaatttgagagacgtcacgcgcctcgcagtctgcgtccacggcttgtgttttcttttcttttccccctttttttctcttttttctccttttgtcagccgagtgtcgccgctgtttttaaaaaggaactccgcgcgcatgaccgtggaaggccctgcagcttcgctcgcgctcgagtgtcgtgcgacatggccgtctactttctcggtatacgtttctgaaaatcatgctcatctttctcctcttgagtttttaaattccacggttccacttcctctccgcctttttgctgggcatcttctcgtcgaatttcggcgttgacgcccgtgtgcgtgacaccagccatctgttgaggcgagattgcacgtttttcgctgtctctcgtcgtttctctttttcttctgagcctcgaaaaacgcctctcttcttctgccggaagccatccttcgtggttggcaaatcgcggtttttcgagaccgcgttgcgagttttttgcctccaccttttgtgtctttcctctcgtccctggcgtctcagaggagacccggttggttcgcttctcacaggctttgggtgactgttgcagcttttccgtaggatcccttctcgcttcgtctcttctctgtctccactctttcgcgagattcttctctctcgctgtccctcctcgacggcgcaggtcttctcctgtgtgtctctcgtttttcctttgctttccttctcgctgtcgtgctccacgtctgcgtgtcttctcccctcccatccacaccaaaaggctttctttcggcttcctctccgtttttgccagcctgtctgcctgcctttctctctcctttctttctctctcctttctttctctctcctttctttctcctttctttctctctcatttctttcttttctctcctttttcgcatctcgcttctttctcgcggcggcgcca

SEQ ID NO: 3277 - DNA, 2111 bp, Toxoplasma gondii
gtatttctgaggcgcttgcgacaccctgatatttaggtgtctgttttgttcccagtccgtgctactctttgcaacgtatcagggggagcctctctgttttttctgtccatcgcgataacattcgtttttgtgggatagagaagttcttgtggctttctgctgcgactgcgtagactggtcttgtgacctcgtgcagctgccttagtatttctccttgtcgctactctctcactataatccttggtaaatggctagagttcacgtcaccgtttttggagcacacccctcggaaggcggtgaggcctcagcgcctttgatgcatatcatttccgccgaagacagtacagaacggttcatcgggttactgcttagaacgtgctggtcgtcgtttctccgaaaccacgaagcgacgcccgctttctgttagcttccccgttgtgtagtcaaccctcggatgccggaaggtgactacgtcccacaatgaggccaggcgttcgatgcgcgtacagaacgcgagcctacgctgcaatcacgtgtaggcggtgacgacagggaattcgctggcttactgctctcggaagcatcggtctgacacaaaaggactcacgcgtcggaaggacctttctgttcaaccaaacgaagcacagccttgggaagtcacgaacagacaggaaagcatccgtgtgtggacgagattggtcatgctgctgtgttggggcctcttgaaagtaacgtttgtaaatttcacgcttctcgcaaacaaagggacgagatgagaggcccaaaacgttgcgtcttcttgcaccgaggaggtttcttgacaatctctggtcgctcggaggactaaggcaatgcagaacctgtggaaggtagtccgtaaagcgcagtgaagagtggaacggagaagttggtgctgaagacaaataccacgatgagtcaacacgtggtgaagccacacaagacacatcggcttttatatccggtctcggaagacggcttcacgatcgattcataaaaaggaagtaaggaaaagcacatttctgccatccaggacacctcgcatgtgggcccttggacgtaggtagatctccctctctcacagaaatgaggaagccatcgctgtcttttggtttttcttggaaagacagtgttgaatgaggaaaccagagagtgtcaactatctgcgactggtcgcgctgacacctttatttctgtcccaactttcagttgcatcctcagttctctaatgcgcttcggtttgttgcgtctgtagagtctccccttctacaacgaagacgcacaacaggttttctattcctccataggcgaaacaatttattaaacttattatcagtctctctcggaaagtgcttgtagccagcaagaaaaccaacagcagccccatcaagaggtacctgccagccccaggaggtgcggggcgccattacgttgaagctttccttggtctaaaagtcgcgaagtgtgcagaagttcacaagaaagcggtatcttctttttcgtctttgtctatcgcaatactcgacccacacgtccaggtaccgtacagtatgagtcaaaccgacagctactgacatttcgaccgaaaacgtggatccttcagcttcaaacgtttcttgcagtacctgagagacggagatattgcttccaaccactatttttcaagaactcagaagcggaggtaccagcaccatctccagaattgccgggttctcgcgtagttggccaaagtgtgccatataacggacacgggtgtgcttccaaacggttaaaatcagattgctgagctgttcaaggttttcgacattttccagacaggcggataccccatggaaacgtgttacctgccagaggctgtcccttgttttgagctattagcagcactgcttgcattagtctgtggaaatatcctgaatgcctctagaacacaacggaaccggtcttcggctgcgtttgcacagctgttcgcagacgatcgcttgcaccagtttcccagactctctgttgccttcatatcatgtttttcactttatttggctacacatcgacatttagaaaggtctttcgttgatcatccccttttggaacagaca

SEQ ID NO: 3278 - DNA, 2609 bp, Toxoplasma gondii
ccgcacctgcagccattgtgtttccctctactttactctgtaaacagggagaccaccgggaaaacaaggactacgtcgacaccgaaagatcccggtgggctcgggccaagacgggatacatgcacacgactcggataccgagaaaagaagcggggaagaaaacagaagaaaggacagaaccgtcagatgagaacgcagtgcactgtcttccacacaaaaggcgcaagccgtctgtccaccgaaaagctgactctgtacaatgcctggaagacgccaagctactgggaagacaccgtcaccagtgaacaaccagggaacatccagcctcgacagaatctgacagacgaaaggcgactgcgagtcaacacgagttgagatacccagagaccaaaccggactgtacacacgactgccaccgtttctgcgcagtactcgattgctgtatcaaccacactactgccacagattcgtctccaaaagcagctgtacgaacgattccaaccgtttcttccatctggcagacataacggcgtctcttgcccgaactccaggtaactcgtggtccgcctttgcacggttagggcaggcacaaaatgcattcgaaaaacaagcgtgtcaccaccggcggatgctagagctggagaccaaagaaagcaggagagcatctgacgtccgtccctttacgacgtgtgccgtcctatcacataggaaacgaagttgtcgtccgcggccgtcctactgggtaacacgcgtccgtcttgggagcaagcagccactgtgtacattcggacacgcaccacataccatttggacatctgtcccactgtcccaatctcgcgatccaggcagctccttttgtgccctaggcaagacggccgacagatgaacatacggggaactgcgaggatgagccggcaacgaacgggacggaaacggatggctggcaccttttcacgctaagaaggaaatcatgacaaccaattgacacgcagaatagaaaatcagttggtaacgcaccgggctaaaggtgccccatgggtctactggaacgccagttttctgttgtgaatgcgcggaggcgtcttgcgcactttcaacggtatagacacttgatggcaagattccgttttcacacgctcgtctgtattcgaccgcacaacagggggtgccacttttcccttcgcacctgaatgcaaacgaaaaactgcaaccggaacaatatcggagatactgtgcgggaacacgccattacttttagacgatgtaagcgattcaaaaaacccttgcttttcggcctgactacggggtcgccatcagagaagccggctgcaacacgacagagaagcgtcctgcctaatatgcctgattaaatcgataaggcgccacccagctcgccccaattaaacactgcagcccagaatgggcaaactgatcctcaggaaaacccacatcagtttcgctccgcctttttttccctccggtacggccaacgacgcgtagtgctccgcgcagaagctttcagaacgccagctaccccaccagggacgcacactgactattccgaaaacgtcatgcgcgctcgccatggcagccgtagagcctggaaaacgttgtacagtgatttcatctgtccgccacagagcgtcggccgtccctaggttcggcgttttgaccgactatagggcgatgtgaagcggtatataaagcgaccttgttctgagccgttctcaatctttcttccgtactgtgctggcgagcctcggaacaaggtacccgtcgctgtaagtctcgaacacgtcctgctgcatttgcgccaagttactggtttgatagagaaatctttaactagagaggacggtgggaggtgggtagtcaaccgcaccatgcaaacttaggtttgtggctttcccgtgcgtgtctcgtatgctcgctccgcccctttatctgctgttccgttgcagcagcagcgctgcaaatgtatgctctttatccaggggaaacacgccgttctgcctccccttccgagttttacgatggtttgagcgcgaggaatgcagggataccggaggaagcgacgagacgtaatttgttcctctggttcgtcgggctcgttttccttgtgcatgttcttgcaacaagacagtccagaagcggtgccacttttcgtcgctgactgttcgttcagcggctcccaccttaagttgcgagagcggtttcagtcgcctttcctcggagctttttaggaccctagctacggtgtgcgcgtggtcgatatctagtacattggtggtcgttttgtgtagcaatctgtgcaccccaagttggcttgcatgcggcacacctgtttttctccgctttttcctgcatcgcgtcacgctccatccacatatctgtctgtgtctttcgttctaccctcgggtttttgctgcctgccgcctcctgttcttcacactatctcgagccatttcctccggatatctccacctttcttcaccatccaccgccagttgccctaccatcgtgtggcgctcgccccctgttccgtccgcctttctgcctcatttctctcgggcccccatgacaacgtgttctcccacggccttctccta

SEQ ID NO: 3279 - DNA, 2041 bp, Toxoplasma gondii
atcatttttgtgacgagctgttcgacgtcttgggcctggagcgcagctctggcgttgccggggtcgcatttgtctcctccgttcctcttgtctccagcgctgccgccactgaagaggagcagcgcgggcgacctgaagtctctggagtcgtttctcgccttgagaccggcggcttttcgtacgtccttcatcagcgagaacttcgacacttggaaggtgagtgtcgggccgctcggcagctgcgcaactttcaggtagacgccggcctcggtttgagagacagcctgcagatgtgtgacgccgaggagcgaggaaacggcgacaaagtccttgagtttgttgctgcgcttctcgcgaagacgcgagctgcagtatggcgacatcagcatgcgcaggtcttggacgaggagcctcgcggcaggcgtcaagcgcccccgcttcaccacgaaggagcacggtgccgagggagaagaagacggctggcgagcgtcgctctcttcctcccctgcggcgccgcgcgctgcgcgccgcgaggacttcccaggccgacggcgtcgccccatgccgcgaagaaagagacaaaaggacgcgagaagacaagaaacacgaagagaagaacccaaaagcaagagcagtgaagaagacaagatatcgaagacaaaaatacgaaggctggagggaagagagaagagaatgaaggaggaaacgacaagacggggaaatatatatatatatatagagagagagagtcttttcttcttgcttgagtcttgaaggccgcgctgacagttgagatgaagagcaacgatgggcaaaaaagggagttgctgtggcgcgtcttgggccagtgcttggaagacaagagcgggaagtgcgacgaaggaggtaagaaaataaacgaacgagaaagaagaagagagacttctggacagattgcggagcaatcggagagttgcggtgcccgaccaagcgcgggagaggggcgaggaaagggggttttgaaggcctcgaccagctgaaccgacactcgcgcagaattgcagagaaaaagaaaacggtcagttccgtttgaattctctctcgagaaaagtcaatgtgaaacactcgaccctcgagcggggattctgtggggcagaggttcgcaaaccgaaccggagaggaggcattttggggaacctacgccctgggtcctacagtaggagccctccacccccaggctgtcgaagaggggcacaacgaattcagagtgaccaagaaaggaagagaagttcgaaaggttcccgcacaccgtcttggcttctccagtgagatgtgacttacactcgacgctgtcgtctgttcgcggctaggttcgcgaaaaaacgcgcggttgcatgcggaagccgccgaggtcaaagccccaagcgggcagacacacgaaacaagtcgcttcaagcgctgaaacgtggttttgtttcagtctttaaagtgtcattcgacgcgtttgattcgaaagagacggggggcgccaagcttctcctactgcctctccggtttccccagtgccgcgcgccgcgatgtgtgccggaggggcagcaggcggacggcgccagccgaacggagagacacaacgaaagcgtgactttttcctttgaaccgtcattcgcatctctgccagtcttggccgagggttcctcttcttcttactccttcgttctgcgtctttgcggctgagttctcgattctctaaatgcttcgttccagaagcaaccctcgcaatgaacgcgaatatttgggctcctcttcttgtaccttcttggccttcccactcttcatctttgatctaaggtcgagaaggactttgctcgcgtctctcgttcttctctgttttctaacatctgtgtagagccaggcatccacctgtgcatacagccacaaagctgtacgtgtctacgttgtatcgtcttgtcgaatgcacgatgaagagcggtcttccatctctttatcttctgcatcctccttttccttcgcgatttttttcttcgttgttcggtcctaagca

SEQ ID NO: 3280 - DNA, 2252 bp, Toxoplasma gondii
tgttctggtcgcagcaaagccttacaccaaactcgaacagactggaagggggagtaaaaaacgcacaagagataaagagtgagaagagagtcacaacaacgcaaatccgaaccaagaggccaaacaacgcatcgatggaagagatatcgaacctgatgatatgtcgacggaggcaacaacgccgctcaacttcgcctgatgtttgaaaagcgcttcaggcacgtcctctacacgtcgaattcgattcacctgggaaaggaaatgcaggagaagattgtacgaatgggtctgggaactgttgaggacgctgtacaccggcggagatatgcagaacgtgacaagcgaaatgtatatacgcgcggacacacacacgcagaagcagaggcaaatgtccggaggggtcgatgatccgtcttgtgattagcacacaaagagaggacaaccctgctgtttgctcccacccgtgtttcgcgttcttctctctttctccctttccctttcggtccttctctctcccatctcttgtctacgtctgcaacgtgatctctggctttacgacgggtctagcttctccctgccgtcactttgcatggcttacagcccactcgcattggcctattgcgttatcccgcctggctccatacgtcaaaaacggggcatcgtttctcctccgtatgtgacgttttggctccttcataagcaagacaaacctcgttacattttcctactcttcctcctgcaattactccctgttcgcctcagccttactcgataatcctgtatgctgcgtttcagtacccaaagcgacagacctgctgccacgtaaagggcagaagaaatccccctcttgtggttttctatccaatctcgaatgcgtagaaagacacggccgtggtcgtcagaagggaaacatgtgtcgtcaacatcttcctcttccatgttttgcagaatttgactgtcgaagaaggatggaagacaacgagtagtggtatatagttggcacgaagcaaaacaccgtctcagaactagttcacgtcaggcgccagcgcgggacatccccgtgcatgttgatgctgtggagggagttttccaggcgagtcattttcttctccgcggaagacagacggttccagagtgatttgacgtcaaccttccgctccacacatttctgcaaagaattggcgtttttacggccggcgttcaccagtcgtggcacaaacgcacacggcaaatttgcgagacctcgttaggtctcgacaagcacagtatcgcagcgtgggtcgtgtccatgattctgtcgttctgctagctgccctgattgccagggagggagagaagcgtcccgttccttaatgatttcttgctacatagctgcacacaaaatgtcctatttcaccctttagtttcacatatacacaccaaaaatgccatatcttcggccacatcgctctgatcgctttccgcatttcctgtagagacggcgtcgatgaatcgtgcgatgccggaggcaggagggtacggcgaggcgtgccccgtcgccaaggcaactcgcatcgaggggtttgcctgctgcattcgcagaatcggaagtagagaccaattggaaacatgcgcgtgccaagctgaagcagtaggcttctgattctaagcaccttttcacgcaatgttttcacacctatgtgtaccttcagtccactttccccctcgcaagtcaagcgagagtgaggctttggcagccctgagttctctgtgctcgtgaggaacagttgtgtgggcttgcaacggctcacctcccgccgcgacaggtacacatcaatacgacgactggtctttataggaaaatcaagcgaagtcagagttgaacttccatacatcacgcgcgtcaatcgtgtctggagtaaggctgtcgagacggtgaaatttttgttcagccggggaaagcaacgactcaaacgcagttcccgtaccgggccacgcggactcccagcctgtcgatgggcatgcgaatgtaacaaactcgtcattttttgcagcttcatgtcagacttacacaattccatgttattcgtggaaacgagatcatcgacgaggggcgccaagttgcttcacctgcgtgtacactatttcggatcttgagtgatttgacttgccaacctgaactcgccgagcacgcagataatactggtaaacttcgtcctcctgtacggcccaatctgtttttcctgaggagtttcgttttagagggtctacaa

SEQ ID NO: 3281 - DNA, 3810 bp, Toxoplasma gondii
agttcgagctacctattcatcaactctccagcaagtgtttgaactgtgtcctgcagcctttctatcagcttgtcgtcacagaggtcacgacctcgtaaaggatgggtgggtcgttgagcactcgtcgcgatctttggccggcctctgaacgcgtgctaaacacttaagcgatataaaacgaaggttggcttgttcggaccaaaacaagagtcggaaatgagggaagcggacatcgatagctttcagtcttcagcccctcattcgcggctaacagaaccaccatttttggtggctaccacgcaaagaacgaaaagacacgtttcctacgggtgtttagtacgatcccttctttgaagtataatgaggagcgtagtgcgtgctcttctttgtttgcgcctcaattaccggtcggtaactgagggtcttcttcggctgcgcctgaacagcctttttcggaaccggactcacagttttcttagagactgtacgtacagtcttcttcggctgatagctaacgcttttcttgggctcggagcgaatgagcttctttggcgcaggctggtcaacctttttggggcgtcgaacaactttagtggtgtaggaaggctgtacggttgtctttttgctggacggagagtagctgtagccaccgtacgtgcttttgccgagttcgcggccgtcggcagcctcatctgccgactcctcgggctcttgtgcctgtaattcctcgggctcttcggcctccagttcctcgacgagctcgtcttctgtatctggttcctcaccgaggcggcggtagtagcctccgccccagtatcctttcttgccagcgtagatcggagtggccaccttcttgggagcaacgacaacttttttgggcggtggtagctttacaggaatatagccaccacgattcttcttgcccccgagttcgcgatcatcggccgattcgtcggccgtctgtgattcctcgggctcttcggcctccagttcaacgacgagctcgtcttctgtatctggttcctcaccgaggcggcggtagtagcctccgccccagtatcctttcttgccagcgtagatcggagtggccaccttcttgggagcaacgacaacttttttgggcggtggtagctttacaggaatatagccaccacgattcttcttgcccccgagttcgcgatcatcggccgattcgtcggccgtctgtgattcctcgggctcttcggcctccagttcctcgacgagctcgtcttctgtatctggttcctcaccgaggcggcggtagtagcctccgccccagtatcctttcttgccagcgtagatcggagtggccaccttcttgggagcaacgacaacttttttgggcggtggtagctttacgggaatatagccaccacgattcttcttgcccccgagttcgcgatcatcggccgattcgtcggccgtctgtgattcctcgggctcttcggcctccagttcctcgacgagctcgtcttctgtatctggttcctcaccgaggcggcggtagtagcctccgccccagtatcctttcttgccagcgtagatcggagtggccaccttcttgggagcaacgacaacttttttgggcggtggtagctttacaggaatatagccaccacgattcttcttgcccccgagttcgcgatcatcggccgattcgtcggccgtctgtgattcctctgtgtcgagttcttcgtcggagcggatggcatcagtctcgtctgtatcgatgtcttggagcttgcgtggtaggtagtcaccttttttggatgatgcgtagacaattggctgggctgctttcttcggagtgggcaaataggtcactttggttactggtgtcttcttcactggcatagcaggaatatagccacccgattttttacctccgagctctcgatcgtcagcgccatcctctacatcgtccgggccaagagaagaaacgatctgttccgctaactcactgggaggctcttgtccgtcttgagctgccgctgccacaacaagcccggacagaaaaaggggagtcaagagcttcatgatataaatgtagtactgagaattacgacacgcacacacacagaagcctccctttgagaggacagtacaatccagattccacaaattacacaactgaaagatgtgattgcttgccgtccgtatttttggatcatccttgtcccgagtgtactagcggtggtaaccgcaagcccgaacgagcatccacgactcactgcccgtaagcgaaagcagccaatccgtttgtccactgtagttcaagacaaacatcagtgaggcaagaatttggctagtgctgactcgctaccaaagccgccttcgtcaagagacgacaacttccaaaatcagttcgagttcctcagggtgtcccagtaaatttttagttgcgccccaataagagtagtagcggtgtcgggtcttttccacaaaacgtatatagccagtgaggcccgtataagaagtatagctaatggtgtctcggcggttccatgcagacgccgaagaaaatcgaatgacgcgtcatttcgatgttcaatcgaactctgccacggttgaggatttccaacggcggaaatgatcaggaaccatgatcaagaaaccagatcgcacctaaataccatcacagactgttcatttggagtcaaacccaattatgattggtggtaagcaggcgttgtagcccgaggtagaagccgacttttcgtcattgatattgcagcgatctgttagtggtaagagaccgtgtgtttccgaaacagagctttcacaaaacaagtagttctatcgagaggagcgattcccctcttcgctttgttcgccagagtatacgagttttcacgccttctgcgactccctctggggagaaaccaatgatgtcagagttctcgattgtcgtctgcggcaacacttttggttcattacgctgcccatggttgtacacgtcatttaccagctagtggagaattgacgttttgtacacttcgtatgtcttgctggatcatgttcttgcataaaacttttttcatggtcaagtatactgaaaacgcgtgcaaccatgtctttataggtacgtgaggaaaaaaacttgttccaatcactccgttgtccacgggcaaagatcacgacctatgggtaaaggtaattttgttcgaagcaaatctacctaatgtggtaaaaagccctcaacctccgacagaccggaaaacaccgacgagacactccgatcgcccacagaacacacggtttagaccagcattttcagaagctaagtgttgagctttcacgactagggaagacaacctgttacagacatgtgctttgaagatgaagacagttcgaatggacgtaacctctgatgaaaataggcatgtgccgaccctaaaaaaccctcttcctgccttgcagtcaataacgtccctacaacaagtgtgggccgccacacgaaaatatcgccatatggactgatcaggtgtgaattttcccgaaacgcgcaagcctgaagcctcgatagctgtcttggcggctcttgtacacagcaggcatcctggatcagtgcgaaagggtaataagccaccatgacctaggcatggttccttcccgaagcttcttgggcaagctgcacgtcggacgagcgtagtcggcgtagtgtcactacacctcagaagggtcaccaccgacgctacgtcacacactgtcagtttgacttgtcattcattttttttcggtctctcagaagcaaaggcttgacaacatcgcaatacgcaaacggcacga

SEQ ID NO: 3282 - DNA, 1761 bp, Toxoplasma gondii
gtcgcagattttagctcgcaaggtaacaatcgagaaccacgaggaagttgcggatgcaatcggtttcttttccggtggttgtctgctgccccaatattgtcgctctctcacgtttcacgttatttcaagtcgtcttcatgttaggagactctgaaccttcatcacgctagaaggtgcagcatcgagatgtttcactaaacgtgctgcaggcaggagactgcatttgatgtttacgacttcggttcattctgttctgatttttcaacgctgtcggaaaaactttctcactcaacccctactgcacttttttagctgttacagttgatcctctactgcagaaatcagtgttaagttttatgatcttcacgagccaccagctacgcgccctcttaacctttttcccaacggccccctaacgcaaattgtcttgctgtgtaacttcaagaattttcaaaagccggctccatgcctttcataatggctttctacgctgtatttcctccaggctccgccactcgcccgtcctgatgctctattcgctggaagagttcagcctcaatttcactccttctttcgcgcgaaaaagacaaagctgtatggactaaggacgttaggtgttgcttgttgagggtgaagccgctctctttcaaactttgcgtggttttctgatacaggcaacttgacccgcacctctacactgagtggtactcggaatcagttggtggcgttagttctcgaaagacggcttccatcccccaacacacactggtacaaagaattgcatatgtgctcattacgaaactggcattactaaacacagccatcggtaaactccacgctcgtgtggaacagcgaaaaggcgcttttgagagccgtggaactcccagggccgccgtagatgacgcgaagccgtggatcgccgtctcgatctgtttgtgtctttgtgtctttcttcacaacgcaaatggaaacatccaaaaaagcaacctgtcttcatcgctgcttgcggccgcctttgttttggaacctctgctttcttgcatgtgtgaagcctgtctcgaggtgcggaactacattccaaccaaggctgctggcttttgggacaagagtcgctctttcttgtgtgccggataccgcagaattggacgagacgcgtagaagtgacggataaaaaaggactctgtgtttctcaaaaatcccaggtttttcggcgtaaactgcggtgcatgcgcgagtgtcgcgaggcgcctctctctcggcacgaagacaagccgttcgcctctccctctctgagctcgtttttcgcttcttttctcccggaggctcgcatcaaagacgtttccagtgtttgtctttcgtaccctcgtgcgttcccgtggttttccttggacgcggaactccattttgtcgtctttcccgttcgcggaatccagcctcttcgggaccgcgctacttttcgtcgtctgcgcgtgcaaggaagtcgacaacgcatccgccgttctagcctttcttcagcgtcgtctctcgcgtttttcatctggcgagagccgttctgcccggttctcagcaaagccttcgcgacacacagactccaggtcggcggcgactgtcgctttctctttgggttttctctccagtttccgcgcgcgctgaaactcggaaactccgggactctcttccactgaaaacaccaaaccgcaaacctctcaggcggaacatctgtcctctctctcttcggttctgcttcttccgtcacgatca

SEQ ID NO: 3283 - DNA, 4487 bp, Toxoplasma gondii
cgagctatgtctttagcactgagaggcttgtagcggaaaggcattgttgggtttggcatcagacctagcgacgatttcatcagcagcagcaggccatttctctcttctacttggctgcagagatcggcgtggctttccggatgaacgcggcactgagaacactcggaaagagtgtaacatgtgttcggatcgttcgctggccgcggcgtgaagaagcccgccttacagcccgcataggcacacgctcgtggaagggagttctttccagaagtcgcctgccctgcctccaggaaggcgaaatcccgggaaggagagaattcgcaaggcgacgaagaagaagaggcacccgaggaaggagattcctcagcggcagggacagattcagtcgacaaactgagaggtggagtcagtccggacgacagaggagagtcagccgaagatgagggcagagcagacaaagacggagacgacatagaagaaaacgagatggaagaaccttttgaaggaaaaagagagaggcggctcaaagagtcgtgcagcgacaggtggcctggctgccttgataaatggaaggcccgtgatagaagaaatgagactggggcagacctgccgttcgagaattcagtagacgagggatcaggctgaatgtcgtggtgcatattcagctcgtgagcagcactggactgctgagactcgtgcgataggagtgccacaccactgtcatcaggagcgacgtccttgaaggcatctcccgtcttcagtgaaaagccgctgcctctgccactttttcccaatcctccgagggtgtttcgtggttcgtacaagtcaatttgcgcctcctttgtcagagctgcattcactggttggcgagcgtctactggagcagcgagtgaccagctgctaagacaggtaggatttgctttgttgtggtgagcggagtccgagacataaacgatttctctgaaggagagggcggaaaagagccagagatgcacgatacaaagcgccatacagaggaagggtcgtctggagtttctaaaggaacatttgagactgaaacagggggaccacgaagcccggcggttcgcatcgagaaaacaaacggcaggagaaaaagcaaggcaagaaggattaacggagagcctggaagaagctgaagactgagatggagagatggaactgggaacagtcggcaacgagtgacaaagaagccgtgactgtggggtggttaagtccactggcttccagcgagcacaaggttgtgactgtagtttcccgtttgaacgagtcggcttttttctggaggggcacggcccctgtaaccccagaagtggggaaggaaggcaaagagacaccatagtcccgccgaaactaaagagaaaaagtcaggaagaaccgtctctccacgaaaaacggcgcatagggactagtatccatgttgttcatttccgaatgcatcgcatgaagacacgctagcttactcaaactgcgtttgacaagacaaacctcgatcactggaaaagacacagcttgggtggccggtaaaaaacagcaaggtaaaactgcctgcatgcaggcaaaaaaagaaattgcaaaaggacttggagcttactgtccaatcaaacgctctgtaaagccacgttcgcaggcttcggcgatgacctcttcatcgctcaccgaaccccgttgccgctgaaaaaatcctggcaacaccaaccccaacgcggctaggcagcagaggatatgattttcatcctgtcggaaagcttgcttgctaataggcctatccgtagggtgaagttactttgagagtgaaagaaatacaaaggataaagacagtaaaaatggtcattcagcattaaatggctttctgtgtcttccacagtctgcgagtagcagcaacgtggtgggtcttcagtgaaacacgggcgcatcttttcaccctagcgccatgtgttacagtttagcaaacgttacggtttcgtcaagaaagaaacccgtttggatgatgccatccagcaccagctctgggaccttgtttgaatagggtcatgtcgcctcggatcgagacgaaagtgttgctgctatgacgtgtcagccacagttgcttctgttgtgtgccagcaagtgtgaagatgccggaaacaaggagaggtgtaacgatgagggaggagtgcttgtctattgatgctttgaagccgtcgttgcacgtataatgtgggaagttctctgtgccgtgcacactcggggagtgaagtcgggttagcgggattacgcaagaggaaaagtatgtgtcttgctatgcttatcatcgtcgctgtctctgaacacaactggtgtagagaatcctagtttcgcttcgacggagtgcattcgagctgcgggaacgcaaacgtctctgtgggggttacaacccgactgactgatgctgcgttatttgggtgtgagagttgcatcaaaccaaaaagccggtgcgctccatagtgtgaagcaagaggcaggagcgttgcagactttcgcgacaggcaagtacgtcggaggagcacattgcaaggtgaattcattaacacgactacggagactccagagccagtgagtggaactgttttttgtggcactttgtcatatctgttcggtaatcttgctggatgtgaaactgcgtgtccgtgtgacagagcagcgatcgcaatcataaggttccgcaatcaagcgcagatgtgacttcacttctcgcgaggtcatgctcgagaagaaagtttcatgcagtgaaggtggttcattcccagtactttattctgtggggagcgacagaaggcacctgccaaccgtttcacttgccacctccgtggcacgtggccatcctagcacttctggcgtcacattcgttatcgacatcgctaatggttaccaactgccaggacagctatggtagacaacagaaacagaaattccgtaactgtttcagctgttgtgagtgaaagtaccagctccaccaaacaatagtgctcctggacagttatcaaccagcccgcagatttctatttgaccgtgaataacaccggaagaaggctgtataaaccgcacgtcgattcagacacgaaaagtcgaaaggaaattgctttacggaaagcctatgcttccctccgctacagcgttttctaatctcaaacggctttctttaaagtgaaaacgaagtcacatttggagaactgaagggctcatagtcctgtgggatgcatcgaaaaagtagcaaacgtatgagcagcactgacttgtgactaacctgtatgtaatacgcagtggcacttctacagtaattcgacttgcggtcgcgtatgtggccatgatggcccactttgctgtgactccacggcgaagttgtataggattaactccttgtctgatgggagcgcaaaggttttatcttattgttggcagtgagctcgaagatccagaatggtgaggacatcacagctttgtgagagagacgttcatacggctgcatgtggtcaacaacgatgttgggggcaccagtaacagaccgacggctgctgtatcctcgcttctctataatccgcatcatctggtacatgctataatctcgtcaaatggtttgtgcagactgatactctctgactttcgtagttgtgtcgaacgttacataagaagacttcacgctcgagcaacttccttagcattcatgagcgcgagtagtgaaccgaactgcagacaagcacaagttgcagcagatgctgcaatgcacacagtgaacgtccgagcacagctgttactaggacaagtcattttatacaccgacaacaccgaagaatcgacgcccaacttggcggcaacatctgtcgcgattgcctcagagacaggaagcggctagcaggctgtcaacgacgttcagatggcttggctagctgagaggaacacaggaaacctatgtgaaaatacgcagacatgacatgactccatggtaactgggtagcagaccaccgcagatcgtctgtttactcgggcgttactttgagcacactgtctcggccacttccaaaggcaacaaggaagagctccaccttccgcgtcactcttcatgcgagggtgcaggtagccggtgatcaacaatacgcgacggtagctgaatgatactagaaaggatgacactggaattcatgttacatttctttgtcgaactcaaaaatgatacacgaggcgaagttagagtgttgtggaagtatcaatgacagccaatctctttgtttctcaaatttagccaaagaacgacggagtctctcgatgatcgagggttacgatattcctactttgagacgctgtcccgtcttcatgctgtacaggccccagttatgcgcaaattcgcttcttcaaacatatggtccgcgatcttcttctgtttggcggtccggtgttattgcttgttggaacttacatatgaataaacgattgatcaacacttcggaaacgaa

SEQ ID NO: 3284 - DNA, 3924 bp, Toxoplasma gondii
ctgcagaaacagacaggaggaacaagaccgcaatgaaacacgattctctgaaagagacaaggaagaatcctggtcacacaaacgagcagcaggttagaagtgagacagcagggcgagtgagagggcgcggcagagacaggcgagtgttcgaagtaagcaagagaaagcgagaaatctgcagagaaagtccttcagaacgagttcagccgcgccgccgcttttctcaggaaaatcggcaacttacaaggagcgaaaggactttcttaacgcactgtcgttccacccgcaaaacgctccgatcaacaccatttccacgaacacagtcctgcgatacgaagccacttctctgcacatatatatgtgtatatataaatatattcgtataactaaatgcatatgcaaatacatatgcgaatatacccaagagtatgtagatccacagagaggcagagagagatgcgtgacatagagctcctgaaggcggcgacgagtgtgcaagaatggagctgctaggaaacaggaggtcgctttcgctttgggaggaaacgagttccgaaccaccggttctgattcttaagttgaagttccccttggtgaaagcgtggacgggatcgcccagcactcggatactaagagtgacaatcgcgcgcgcaaacccgtgaccttgcactttttcgtcatttctgagtgtgagaaccacgggaggttcctcaggaagatccagacacgcaagaaagcaggtaacaaagaagtgccatggcatttcttcagcgtcaggaaacgaagaaaccctctgcacccagtgaacgccaaaggttcccatcgcctgctactggcagatccaacggaatctacgagaaacacctccttgaacgcaaatctttctcggcgttttccactccagtcacgtaaggaaacaagccactcttcagcgaggtaaaaggtcgagagagacgagagggaaaaattgaggacggtatgctgtcgattgagactgcaggggtgacggaaccggtacgacggcacgcgagaacgcgaactgcaagtttctcccgttcggatccctcgttttcgtcacagaatttctgttcttaccaagaggaagtcagagagagaagccggcgtgtcagatttcatttgcctcttcgattcccggggacggcagagtcgcctgtggtcccgggagagacgagaaggacatttctgccgaattttcccccgcaatttctccacgagtccgtcccgataacccccgacgaagaaaaagaaaaatcgcgagctagagttcgggaaatctccgacacacaccgcagtccgcgatgccgaggccaggagaggccgagctgtccagaaacgcgggataaaaagtgctgcgagtccgagggtacgcgaccgattagggtttcaggggtgccgctcgcaactctcgatttctggatgcccgtcgttttcgggaaacgtgagagaaatagtggaaagcagacacattctttgactcaacaccgtcgcggcacttccctttacaccacagagatactggaaatcctcgcaggacttgcagggctcttcggagagacgttgagggaaatcgcaggtcgagagggtgtctctgagagggcggaaaaaaagggaaagtttgtgcaaacaaacgccaagggctcagcagctttattctcggagacaaaaggtaaagtctgggtgaaacataacagaaagtagctgagagacgcagctgctcgctcctacgttcgctaagagagcgcctgctctgtggaactccatccttcggttgaatttattagagagcttttctcggctgctgttggaggcgacttaaaaaagaacacaagaaaaggtgcagagaacaggaaaagaaaactgaaagaaccccaatcactccaccgtgcgtgtctgccgtgccatcgtggccgcctgccacattggcaacctgagagactccgccgagctgggtactacgtggaagagctgcctacagatatccctagaatctccactgaagtggggttaatctatttgactgtttgtgaaaactcggttcatatcacgaaacgctcagaaaagcaggggaaaagtcgaaaagtccaagtggaactacgcgcgcaccagttcgtcttctttactgcctcgtgagaagaggaagaaccgcataggggacgcatagcggagttttctcgccggaacagggcgtatctgcattcggatttctcgacattctgtttctggcacatatgtcaacgtccacagaggggagacttctgtagaacagctttcctctcggagttcagagacaacaaacgctcctagatcgaagaaatctggaagactgcgaggcctgcagagtgagtgttcagagcacacaagactccccctcgacgcacgtgaaagagacggttcttagatcgtcttttcgcttcttagacgaaataagatctgggaaacagtaggccgcaaggctggggcccactggaactccgtttagagaaagtgacctcaaatctagtatagcgcactgcccgcgtcgtcgaagagtctgaagaacctcccgttctactgacgtggaggcgtatagcaaattgcttcttgttgaagctttgcctgcagaacaagactcaccaacgacagaaacgaacaacgagcgagagagtgtcaattcccgtagtctagtggtcgcaggctgtgaaacccagcacggagacacaccctgaagcttcgcttgaggtgactctcatgcgatctgaaagacaagcggacgcgaggtttcgcgataggaaaagatctttctccgagatcaaaatggtgctgaatcaatcgaagaaggcgaagatttctcgctatcaagggatcaacagccgaacaaaagagttcagacactctccggtgccctggagccggggtccgcgccgcgaccctgccgccctcgttttcgcacatgcaaaggcatctcgtggtttttttctacccgcagtgtattgaaggatgcccttcgagtttctacccatgaaacgcgagagaaagaacagttgtttctctgtgttttccaggccgaggagaaaagcaaatttcgtctcttctccttccgtgatgtcaccacaatcgtcggcagtcttacctggatgtctgcacgtccaggttcgcactttattcttccctttaccgttttctctgtttgttttcccgagtttcgggttggttttgtgacgtcctttttccagcttcactcccccttcgtttccttcagcattctcccctcaatcgcacagaaaaggggggatgactcaacacgaagggggaaggttttcacctgttgctgcccattgttcctggaaatatcgggaaaagtctgtcggttcgccgtcatccgactctctttctttcctcctgttttttcctctactttatcttttctctttcccccgcctcttttgcctttctacctcacccacgtctacgggtctcgctcgtttccccacgttttgactttctttgtttctatttcaacttatctttcccggtctaaattcggggttcggaagtcattatcctggacacgaagtctcccctgttctagtgccatcaagttttgcgctgacaactggaagtctttttctgtcgcgggaagtttcgtctgttgccaaggtccaaagcttcatcgatgcctcagcacaacacatttccttacggaagcctccggataaactgtttacgaaagcgagcaactgcatgaaaatccccatatacacacatatacatatatatatatatatgcatggattcggcgcatgtcattcgtatgtgattgtgcgtcttctgcgtttctcacaaacacctcagtctcccgatggtagtagagaccgttgtctgcgatatctcggtttcgacagaaaggttcctcctcagaagcga

SEQ ID NO: 3285 - DNA, 2289 bp, Toxoplasma gondii
tgtgtcgcttggacttttcggagttccttttgattaagtaaaggagcacctggtctgcagatttcctccttgctctgcctacacttttctaaacatggggactctaaattgttccgctgccaacagagagatcagcatggcaaacgtgtgttgtaggtgtacacagaacgcgtgcgtgtcgaggcgagcgcactgaacccgcttctcttgtctcgtgtgcctttcccgttccctgggaaggattcagtcaaaacgtgtagagaagaatacgagttttccactctttcttcacagcaccaaacctctcctcgtttccgcgtcgaggccattgaaaagtaaaagtgctttctgccgtcgaagacaacttggtcgactctcgattcgaagtgacaaaaccccagccccttctatggatcactgcatatttcgttgctttctagtttcgcttattgttcgtggcgcggaagcttttcttggaagaccgagctatacatttcactttaaaacatatctatcacgcttataccctcttaaatttcaaacaacccgactgccctcgcatagcggatgcggatgttttcaaatctggcggtacctgtcgacgaaatgcaggccactcgccgtacgaggaggggagcagcgctattctgcacaaacgcaaacaagttattcgccacaatggttacaaaaacgttttagatgctcaggctacttctctaaggaaacgcagagtgcgtaccatgcttttgctagaacaaaagacgattttctgtgtcctggctgtccaggaacacttcctgcaacaacggagttcatctggctttcgtactttgttcctgcatgatcccctgactatcacccattgagaagcaattttcccgaatcttttctcaggttcgatggcatgtttaattgatcctgtgtgctttggtttaacatgatctccacgcgaaaggctaacaaacggatggtgtcggattccaggtcgaggaacgtaacttgcgtgtctatcgaactgcccactccagtgaaccaagtgccgttcctcacaaaatgccttacttcttctacaagtgaactgccagtgtaaccagggttgcaaaaggggaaagccaagcccagaacgcgaacactgcgcttttttcagtgggcagctgaatgacgtcagggttctcgagcaggttaaagtggaacatagatgcgaaagatggtcgagaaaattctcagcagcttcagttttgcccctttactagaagaaatgctggcggtgcttgttcagaataaaaccttggctttttacgtggaagagcactgcatgcacgggctccgttgaaggaggcacctatcgaaagcgcatcgcggtagagagtgcgattcagacgtccctggtctggctaagtattccgtgttttcccgtgggagagaagcctctcttgtttctgtgtctgcaaacttccccagggttttgtcaagaatggaaaagttcgagccctccccacctaggggggtggacctgtgctgttcctgaggaaaaactttttcttcccggcggcgtcgagttctctctgaatctttcgcaagacaaaattttaagtgtctttgcttcttgtggctcctccgtggtctctgaagaggcgagaaactccacatttgtatagacctgttttcgcccgtctcgtctcttggcgactttcgcgcggttgggtctgctttctgtggatctgtttcatgtagcagagacagtgaaaggttgttttttatcttttctgaactctttcaatttgtaatcgatgcgacagcaactgtctgcactgttccggttccgccttcctcctaccctgtcgacaggcacggttcgaagcccggccaaaccgggtttcacgggtagcgtttccccgtctgtttcactggaaactgcccttgcctctagtcagtcttgccgccgtatgttcttcgttctttgtgacgcgtttttcgacggagacgaggtcttccctccactatccggacagcaaatcttgtctcgtcttctaccctgatgttgcggagagcttcagatgcttgttgagcgacctttcttctgatttgtcccacggtgtccttgtccccattcgttttatctcttcccgttttaatcctgtcgtcttggtcctcttttttcttcggtccctgccgttctattcttcttttccccgcttcttctcttgtctcttcaattgttttctcgcttcgccgttcctcgcccggtgcgctgccgggagatcgggacgctcgagcttcagagcgtca

SEQ ID NO: 3286 - DNA, 1766 bp, Toxoplasma gondii
caactctcacttattgttttggagaagatatgacgccttgcaaaaaggaaagcgagtgcagttttcagagaccgagagggaggttcccctgccctcacatggctctcgacgtcttttctcttgtggatttctgctttctaaattcatcgttctttgagtcgtccgatcaacgcctttcttccccgtgtaatcacagcaagtctggtacacccgcgaatgttcgcgagaaccgtaaggagaggcggcgtttctgccgtcggttgaaaaactcctccattttctgcattcgttttcgacacagattgtggtgtagtgttcgatggatttgcctgccttttcaagtcagaccgcatgcgttaaccacaactgtttaaggaaatagattttttgttcccgtcgttccgaaaattaaacactcggtcgtggttaggttgcccgtcgtgtacacaaatcgaggaatgctggtcaaggatcatttcttaatgaaggagatgagattcgaattttaggaccagcaaatgtacattaagaaagtatggtgccgatactttttcaaaagatttctcgggtgaggttacactgcgtgcttggaatcgcgccacagttaacaacagatggactcaagctcgagagacagtttcctcttttaaaaacagctgctgaacaaggaagattgctaaaagaaagttgcggcatcctagacttccgaccgaacggatagaaagatcgtcggtacgcgatcgattaccatattgcgggtggaaatcgcctctggaagtattttgaactttgtgacggactgcagattttccgcctccttgaaagttttattttctgcttctttctcgaatccgaggtgatgtttccttcctcagggggcgcagagtctgcaagttacgtttcttttgtactacaccacagtgcggttccctgtgtctcttcactccgtttctgtttccttcagatcgactctgtctttcagcctcccgagacgagatatttgacgcacgaatgaatgcaagcgttgtcttgcgctagatgaactccattttatttcgcatacccagtattttttagtcgatgtctagtttcttgcatgcgcgaataatacgacgaaaaaaatgcatgcctagatgcctcccactgttgtgcgcggcgcatgcagttttgagaagcagcgcctcaccttttcagcaggaatttgcctctggagacgagacctgcaaatcgttagagaaagcggtgtccggggaagagaggcatttctatttttcgcaaactctcgaaactgtctcccaaattgctgactttcttctcccgtctcgtctggagcaaccgagagaaggcgcgactcttcgtctcctcgttgagtggaacttgagttttgcgggagtttctttcgacgactcgtttattccaaaacgacgccgtcgcctttttagtttatcttcgacttcaggtcggttttttctcgccgtttgtcgcagctcgtgtctgtttcttcgacgctttcttccccaagccttccgctggtaaaataaacctacctctcgtcacccctccacctccttgcttcccccactgttccctctcttttatcctttttttcttcttcttcctttctcctccttcgtcgtctttttctcctctttttgtttttttcaccttcggtctctcgcctttccagtccgtcgctgcagcatcgtgtcgtccggcgatatttcgcagagtttcacctttttgcgtccgtttttcgctctccgcga

SEQ ID NO: 3287 - DNA, 3544 bp, Toxoplasma gondii
attcatgctgctttggtttcgttgttcgacggcgcagtctttacatccgtgtcacgacgtcgcactcgctgaaaagcgaatcgaagaaaaagagcgagaggcgcgagagaactttcgattctagccttaaccgtccctgcacagcctctctcgcgacctctttctgtcttctcacaaagcagtttctaccctcactgcagatcgtcgacaaagtgccacccgcctcgtgatgttctcagaggatcgaagcctgctgaagaggcgttcgagtggcgtttctgtgtgtgtaggagagaagcacagtttcgtcttcacgtttccactcgttttcacagttccactccgtcccttcttgtgacgttttcttcaagagcgaccaggagaacacttgcgccgctgaagcggaggttcacactctcgcatctcagtgacagccgtgctgtgcaaaccagtcgacagcgacatcctcaagatggagtcgtggaaagagacttgacgaagaagacgtactcccgctcgaccgcaaatacacattttcagtcctctctctgtgcggtttcctctcggtacaagctttcgtcagagagacgcgtgcagcttacaaatgatcgtgtgtcagggacaacagcgggtacactctagatagaagaggcaagtgtatgcaaagactcgttctactgttactgcgtcagcaacgaagttattcatgtctcttcgccggtcacaaaggtgccagctgcgtatacgtggacggtgaaacacacaccgttgaggggatttgtggtgccgagtgtggaagctggaactcctgaactgggcaaagagcctcgactgcggttcgagttatagctcggtcaactcgtggcgtctgcagaactcttagtgatgcagctaggggaactgaagaattgcacagcgctgcactgtgagttggtgccgacgctcgtacacggcagattacgcgagtggctccggcagaaaagcgtctggacaggggttgcagacagtaacgaatcgtttcactcgatcccaggacacgggagagaatgcagagcagctggagtgactctgtatttactgcgctttcgacctcgcagcagcttcgccctgctgactttcgtgaaggccaacgacggcgacaacttgtcagcgtagtgtgatggacgttaagttggacagagaccatccggattctgaggagcagcgtgcagcaaaggtcacttagtttagggcgccgaatgcagaggtcacccagattggcactcgtataagacggatctacttcaatttacatcaccacagtcaagcgaaggtaggtccacctcgatttccgcaggaaaacaaagaagagaagacgtcagttctcgtcaatcgagtgctggtctttgctgcctcctgcgtgcgtctgagtttcgaaagtcttttcgttgcgctttctggaaattccttcttccacggagattgcaggggaactatgacaagtggaaaaaacacacctcttttcgtccgcgttcttcgcctttttttgccactctcccacaaaagacaagacgccagaagtgccaggtgactgcgaggcaggcgaagcagtgaggaaaaaaggacgaggagcggcagaatcgaggaggccgagagaccgcgacaaaaacggagacacgacatacgcagaagaggcaggacagggaacagaactcctggacgataaaccggggcagaggcaaggcaggacaaagcagaccgagagggaaaacatgctcgagatgtcaacaagcgtgcaacggcgactggagagcaactgaaggtagagtccctgttacacacagtgtcaactgcgatacggcatcctcgagtcgaattctcgttttattttgccaggcattaacaacgggaaaaacaggcagagaaaatacgccgcgaggacgcacgaggaagaccagcgggcagcgagacttctcctcggcgagttgaagaaagggaggagatttgggcgcagaccaatctgcacttgtttctcatcacaacctcccgaagttgtgccggcactctcgggcccctcacgctcgcgagacgcttttgctcgtttctcccctcttcaaattgcacccttttccactctgcaccattgacttttcgcttgaacgcgtgcggaacgcaagcagaaaaagaaaacaacgtgggcgtccagattgtggtctgccatttccagtctagcagtggcgaccccgtgagtctcgtgcaaggagtctccccccgccaggacggtgcagagagagagctgcttcggattcaggaagtgtgtacgcttttcattggctgcaattttctttctttgaacaagtaaaaacgtttgtggtccacttcactggagaagagagcgcgccgacctttaggaccttctcgtcgactgcttgtccgtgacatgcgctcggttgcacgacttctctgggcctcgaggcagcagctcgccatctccgggtctgcaagaacagacaagaacacagagaaatttccgccggtgcacgttctgtcttcaattccccttttttctttcattccacttttcccggtgtctctgctcctttccatccactggatgtcctgctctcgacttcgcccgccaccagtgtgcgactgcagagtggcagatgtctcaaccttctttcagagactttgaagccttgttgcatttttgggcgctggagttcaacggaacaaagtgagagccttgaaatccgtttcaagtcatcgcctctagtggactgaagcggcggtttctttcaagctcgaaagggcagttggagtctctcccgagcgccctactcgcctcctgtgtcccctcgccgcactagccgcggtgccactacgtccagggcgctgcgcctgtcccccgtgtgtgtgcttccgcggtcgcggttgggacccgtgaggctccaaaaggtactagggaaactccccgctttttagcgtctttctcgccacagctgtctcctgcgctgctcgctgctggcgcccgatccatcgctgagttttcagccgcgctcgaaagaaaccgagcagtgttttgttccgccttcctctccgcggagcctcttgtcgagttcaggcttcgggtgcgccttcactggaaggagaacaagaagactgacgaaccacgaaggaagaaaagagagagagcgagcccagaggcaggagcacgaaggaagagagaggtgaaggagaaggagcagagcttgcggaggtgaactggaagagcagagagactggaagacaaaccagacgagcgctcgcgatagaaagcttggtggtctcacgaaagcgagagtcggaaatcgagatcgcgagacagagggagagaaagaaaaatcgccgcagagagaggcatctactttcttgcgttcttcttactgctgtacttccgaaaagtctttctcgtctttccccgtcgtttcattcctcaccttcgggggtgcctgcgctcttcataggagcaagttgaacagaggctgtcctcggcccgacgcaccctgtccactgggaatcaaga

SEQ ID NO: 3288 - DNA, 3270 bp, Toxoplasma gondii
cggagacacgctagacaagggagcggactctttatcctaagccactcttgcacatgcagccgttggaacccctcagctggccaggccgccagttgagtgccggttgggcatcagacctgtctctcctcatgcagtgtgaacagcagaaaatcgtgtttttcgatacaaaagaaagtgtgtatctggagtgcatgctgcactcgcgcacgcgtccaaattctgctctcgaggttctcgtgatgaactagtggtgaggcgttgtacgtggaactggcgatgcaagcgttgtttctgaggtaggcgtagttatgagccttttctcgggagtagactctacgaattggcctccgggtttacgtctcggcttgggtttttccgtggatggcaagcatatccgtgtcttacgttagagcttcgccgcgcgtctacgcttactcgaacatttcgtctctgctaagaaaagacacgggatagatccgactgctaagtgatcctttgccttcaatcgaacggagggtagaacaacctacaatgctgctgaaagtggcagtttctcaggtgtcagagatgattactcccaggacgatggtactgatcagactagcatctgagtagttttctctcgctgttaatacgagtgataacagtaatccatatattttgcctagaacgaaaacagtctaggattgctcatccatccgtcacgtcaccaatccactccgccagcttccagccagagtgacgaagtgtactgcgttctgtttaacaaagcgagacgaaccgagggacacaaaagaacggtatattcacagactcttcgcccacaactttgtcgagtgtttcagcctgcgtgtgcccagcggcttcgaaaaaatggatgcatccgcctccacattttgaggtgaagaagtaaggagcagtagagctcgcgagctgtagaagttgtaccagacacgaaagaaaaacgaagttcccgtctgtgggtctgcgctggtcgcgtgtcgacccgagtggccagatccgtgcagtgtcctgacagctcaagtaaggaaatggcccgaacccgctttccttcaactgggcggcgcactcggcaaaagcgactgcacctcgtagatcagcctgtcacacctgaccgcagcggacatggggaaattggaaatgcttatgacaacgggcgtgcatgcatcccgcgttatgtccacctcggccgtcggctccgtttgcccctgcacagcctcatccccagcaggctcgcgccctttcatttcggctgttccattcaacaggctgcctgtggttctggggcgcactagacacctcggtatcgccgccgcgtcgaggtacggacaagcagaaatcataaagacgaggtttgcttcctcccgaagttctgtcatcatccggcgcaagactaccttgggcgcgtggcgcgaagcagacaagcaaatgggtctgcagacagagaaaacccagaaaatcaacacgagtggccagctcgcaattaaagtgaatctcttctcgttcacgccccgagacgacacaaaagctttctgcaactcattcccacctccagagatttcctaggatagtcagactctcgctttctacacatcactccctcccactcaagcaggactcaacagctccacactgaggctgcctcactgaaagtcagtgagtgcatgcaagccacagctgtccaaaacaatgaaagagaccttccgaccccccctcctcccaacccgacagacgcgtgttcaatatgcttctgtatggagtcaacgtcttacgaatccccgaacccttcgctctccaactcacctgtagttgtccggcagatgcctccagaagggaggctgaagcacttcgatgagggtctcttcttcctcctcgtcgcggtcatccgcctcgctttctcggtcagaagcagcgccctccgtctggaccctctcctgagaagcccagccgtggcggcggtttctctcggaccgcgccgtgggagtcccgcgcagcttccccgtgggagaggacagtgccatcgtcgcaactttcttgaaaactttgaagtttcgcgggacgcgaaacgaaggggagacgcgaagcagcttgccgtccatggtgtggagaagtagctcgaagttcatgttccctggctgagctgacaacggttttcccgcgcccggctggcctttccaagcttcgcctgacgcagttgtgaacgccgaggcggcggcgtcggtattcttgccggcaaagtgtggaatgccagtgcggagctgagagaccactatggagtcgaggatgttcaacagacactgatggacgacgtcagagcgcatgcacgcttccacaagaagacgacggtcttccgctactgcagctgccctggcccccgccgcctcagttgctgccgccatgcctcggttcggcactgctgctgcatcagcgagatcgctcgaactctcgaggaagggatcatgcaactggcgaagctgtgactggatcttgtcgaggaaaggaaatgcaaagttgtcagttgacgaagaagagggtcgacccgccaaaaggtaccgatggtcgtccatgttcaaaaggcccgccgttgaggaatgcctcttgtcccggaaaaggtacaagggacagtgcgtcagaacgatgcagcagttggtcgaatgcgccagcgacttactttttgctgctcgtcggtgaccagggctacttcgaccctcccgcggcgacgctgtactcgcctgttcggcagcatgtgcctcggcccctccctcccgctgccgccgaaccttcttcttcattcgagattctgacaatgactgaaaaagtgaatgcggggccgcttcagaggactgtctagcagcaaaaaatgccgtattctcctcagtattgcctcttgcggctgctgccgctgcatggtgcacggaccgcttttttttcggttgcatgttagggcagccttagagagtgacggcacggatataaatctacagtagcctactgcctttcgcgcataaaagtgtcaacaaccacaacataaagagtcaaggtatgcatttgcttgcttgaaaccttcagacactttccaggcagttttgcccaaggtgccgggttatcgggaaaagtcacaccgcagcggctggcgaaaactgcgtgtgccagccccactgtggcgcgaattgacgctgcacaggatgccagactctataaaaactgtaacatgttttttgcgccagaaaacacctacttctgtctcga

SEQ ID NO: 3289 - DNA, 2899 bp, Toxoplasma gondii
gtgaaatcggcatggtccaggcagcgaacgtcttgataatgaataagcgaaaaacagttatcatactaacgcagaaagtagctgtcgggacaggagcagaaggaacgccgtgctcctgatgggacgaatagagcagctgacgtcggatcaccgcgaacgtgagggcgggtggtaggtggacagtgaatgaaaaagggtgaggtgtcagcttgatggtgttgcaagtgcgtgtcagtgtgcatcaatgaatcatctctcacgaacagcattccgtgcaggcgaccctggcaatcgcatgtggaagcaaacaaaaacagtgccggggcggggactgtgttgggaatgctgcccaagaaaaccctcgatgaccaagggaagatgaccgcagccgtcgtacagtgttcctttttctgcgagcgccggcatatctttccagccggagtggagaagaacgtgcaactcaatccagactgaaacacagtcctagagtacaacggtatgagttggtagctcgtccatctgggaaccactgaatagcgcgttcagaagacctcgcgtagatcggttcttacgacaatctggcgcagtgcaactcccttgtgggtaggtgccgttgcatgcggcagcagaatcaaagtttactgccatgcttctgaagaaaccgcaatcacgagccctgtatagagaaggcattcgttgacattcggaggctctccggcggattgatggttagttcttttttattttaagccaacctaagaaacgacctaagctcttcccttccgcaggtatagtcacggagttagcggggacgggaaataagtaaccggcaagacccaggagacctgagtcatctgctgtgcaacaattgaaggctgcgctgagctctagtattcttaccggaccttcgctcccgagagttccctaggacaacgctttccatcagtggtaaaccaataacgctatgccaaatatggtccctaccaatcaaaggaaatgcattcaatggaaatcccgacgggttcactcccttcctctggtgactgattgcacagcgcctgcacttgccggagtcgttagggcacatgaccccctctaccagcaggtgagagtcgttataaatgaggtggttcctgtctcgaatttgtggactgtatgaatcgtgtatgaatccagttttagcagcttcttactactcctgcaaccaatggctcctactggccatatccccacccacaccagcatgagttgaagaatcgcaacgtacggtcttgctctgtcttactgctccatgctccaacggaactaacacttccaagtcaccctttccaaagaaggtacacaaacactggctttccacctcggtggcatagtgacttttttgggcctgcggtcatctcgaggtcactgcggagtgtggaggaatcagacacgagcgaagtgttttagtacactgcgccgaaacatccttgacgtggagtttttgttccgacgtacaacggcacatgctccagctttatctttcagaagcagctttccatcatctgggaccctttaacaggtggacagaatcgccgaacacggcattcccatgcaagttgcagtggttccttccattaatggcactggctagctcgcatcgaatagcaaaccggacgactgttgcgggagctggtggagttccaccgttcaccttccccgcactctatttctgtagactatgggaagactataaaggattttacgtctatattcgtgcggggaaatctgttcggaacgacatcgctcgtttgtcgggcacaaaatttgccaacaatgcggtttggctacctgcagcagctcgcgcgacaacactgccgcgcacttgcgtgccgcgttctctgcaacagtgatcgtggcttggcgattgaaatgacacctaaatccaatcgacacgccacgagtcaactggtgtcctctgtaaattcgcagtgggattgttttttggtacttaatatttgtggacgagtgcgtggtggggagcttgtcgctttcgtctttcgcgtaccacttactccaatatacacgcagcgataaatcgcgtaacggacctgtatgcataccgtttccggaagtctctgacctgggccttgcagcatcgtgcgagtctgttccgggcaactggggcaatcatcggaggtctcgcggtcgcagtaggtaaacgatactctcgtctgttaacaaacgtcatctttgcttcacctgccttcacaagtgtgtccaaggtctcttttcctccttgcactttccaggggtccacttttttttcagtaattcgcgacttcccttgctgggcggatgttcaggaagcgggtggcagcagtggggtgactccacgaggcgagacacgtttgtctgtgcaacactacaacacaagaattgtagcgagtctctgcatttggtgagttgttctcgaggtttcaccatcattggtgtgtacctttgttgcggagtgattgttgcaggttgatgaacattcttgtgtcacctaccgtgccagtggctgtaggtcatctgtcccgtattgtggagcatttcaggctcttatatgcctctctcttgtttcacacctccccgcggtgtgtcggcggttcgccgcagagccgcttcgaacaagcggattgtttctgtaagtgacttcgttaagccgtttatgggagtggctgtccggcacgcggacaaactcctgactgcagagggtgtttctcgttcgtcctctgctcacattgaccattctgagctgctcagcagtgcaaccactaacgccgcactagcaaaagcgccccaccaagagaaggtcggcctctcactcatacaggggacttccatcccctagcagtcgtgctcctctttatcaaaa

SEQ ID NO: 3290 - DNA, 2354 bp, Toxoplasma gondii
gactgaataccatcttcgacggcggtagcttgtccttcgaaacgggcggtcgttgctccgtacgtatcaacaacttctgaatccaggttttggtaacgtacttccgttctctctcgtctgcgatatgctagtggggacagaaacgtgtaggccggcttcggccaacgaattgcactaagcaagaagtggtacctaaatgacttctgacggactttccgttgtagcttgagacgcacaaccaacaaactcctcatatgtgcagtatcgcttcatgaagcacgcgtcgggacggctctaaacgcgtttgttcacagtgaaagatgcgaaagtcccggaagttcgtgcgatctttcttaaccgtgagaacgcgatggtgaatgaggctgtggaaagtcgagggcagcaagtgtggagagcggtctctcggaaagaggggttcgcgtccgacaaccacagctgtgaccgtcagggggaaacacatggaagtgtgaaggaacagaggtatccttcagtgcaacaacagccgtaagggtggactgagcctcgacccaggtcagtgcttttcgcacatctgtccattcttgtctgagacaggtagcgtttcctgacagagagagcacggctgcatgtgaacaagatttgtgctctcctggaactaccatcctgcttcacgtaggtctgctggaaagacatgtgggaaccgaatccgcagtaagacgcgtctcacgcaggcataataatgctaaattccagagagggcccggtaattcatattcgacataggcttcggacgagctgaagcgcactcaattcgtcgaatcaccgttttgtgtttcagtcaggaagggggctttctcgattctgcttttcaaagccccacagtgactgtgccgtctttcctcgagaacgctgttaagtgggtgcgtctgatgaaggcgagaaatgcacggaactcggccgttcagcccacaccattactcacccatgtgtttttcttagattctgtttatacgacagaacccatatcttaaatgcgttggccggatctcgtttgacgccttaaccagtgtctcggcgtgaccggatgcttttctcccagagctaccaacacaacggcacctcttctcagaaggaacgtttagccgttctcatgactcctgaaaaactgaatgcaggaagccgtaaacgaccagcgaattcctttcttgacactctccgtcgtgcggcgctgtacacaattctgcaccttccgccagccgacctcctttcccttgcccctcgcgacccgcagcacctcacggttagagaaagctgctttcctgagtcgcggagttccactgttgtaaggcctttctcctcaactctattcaacgcacacggaactcgtagcgcactgcgtggcctcgggccacttatcatcgactcgaatggtgaaaagtcgattgaaactagttagcctcagtctgggcgttttttcctgcatgcggggcttttcctggtacgctctattgtacggaggaggccgtgtaggggggtggagtggcagtgggaggtttttatcccctctcgctctgcagtccaaagggagaaatcgatcgagcaggttggcggctaacactccgtttcctctttctcggcggcacttgtgcgcacttttccatcgcctttttcgctgcattcagcgacttctcggtggccggactttctcctgtctcgctcgtgtcgctctgctcaacttttcttgtcgtcgccggccccgcacaacgggcagcagctgtgcaagagtcaccccgggagagtgtttctaaacttcagcctgaaaattcgacttcctgccctgtttaacttttcttcgtttcccccgcgttcccctcgcaatcccaggctggaggtacacctggttgcagcggtgtcagcaaagcggttttccactcgttcgtcgttcccgcttttcccgactttctctccacaaaaccctggctttttacgtcgcccgggcctcctcgacttccactcgaaattcccgtttcccggtgcgtctttgcgctggcttcggagcttctttgattctcggagaggtgactgaaacgcgtcttcggccgtctgttcaagaggcacactgtccttccgcactcgacagaggcgtcgcgagtcggccgccagcgaattgcaggctccagaaaagcggattcggccttggtcggtctttcttgcgggcacccagtcgccccgcctgagagactccttttaaagcctcccttgagacctgtctcaactcgaagcaccaccgcgagactccctcctcttcctctcgtttgttctttcctcgttttccccttttcacgctcccaaaa

SEQ ID NO: 3291 - DNA, 1081 bp, Toxoplasma gondii
tttttacggtttcagtgcatacttccgtaaaccctcctgcgccaaatgaacaacgatacacggtgacgaattgtcctgaaaacattttcttctcctcactgcctcgataccttgagcgcgccgagtcgcagccgaaataagaggactaaacaaatcagcctgcgtccttggactaccggaaaccacatgcaggtttgtttcccatgttggagcgtctgtctcatcaagcatgtccatttgcctggacctagcaaagttttagtcggactgtagttgagcacatgtgtgcagctcaaactgcctcggcggtgctgtatcattcatacggaatactgctacggctcttcacggactcgtggctcgtggcagagtctcctcactgatgggatcaaccgtgcaaagagatcacgagccgatttcatgacacaaataagcgttagcaaacaacaaccttaagcaggacatatgtttctataggaagtgaagataaccctgaccaacccgaagctctcactacaggacgagcagtctctgaaaactccagcgacagggtcgcgggaaatcaattataggcattcgtaaagctgtcaccgtctcagtggggctgagatcgagtcaatacaacaattccgaaatttttgagtgcgaatccattcgctggagaaaacggtccggatagcgatattcagctacaccagacccccgtatgctgcggtactcaacctcaaaatgatcgaaccatcgatcaaagtctgtcacacctaacaacccaaaactctgttccatggctcagtcagcatgccgaaagtcttagaaatcgtgttcctcgacactgatcctcgtcgagaaacaaaccgcgtgcacactcggtgtcttgaaacgattggtcgctgttgtgaccccgagtctggcacaaacctccttggaacgtggtggccagatggaaaatccgtttttcttccgccattatatcaccgagtctcgtctttctgttctggatgagccgtttgggacgagccatgggatatgtcgtgtttttcggagcgatttcaccgccagtatgatgatagccattctcgca

SEQ ID NO: 3292 - DNA, 4622 bp, Toxoplasma gondii
taactgagtctgaaggacttcttcgaggatgacgctggaacatttgaacagcggatgaagccagcaggtgagaagcccaaaagggcctctcggatctgccgtcgggtagccgagacgtgcctcgcccttctcgatctttccgccgcaacagcgacacttgctctgacctggtgaggcgccatacaggacaaaccagacagaggaacaacagagctgcgagcgaaaagacggggggaaacagagaaaacgcaccattcacggtaattgtgtacacaacccaccaccacccccccccccccacgtgcaggcggtaaacgtccagcagacgatgtagcgtttgttaaagcacaccgatgtatatatacacacatatctgcatttatacacccgcacatgtagcagtttgatgtttctggcccttaagctataagaggggctcagaaggtttgttgtgtctcagctagaactctgctttctgccgaaaatggagcagctctatcgttgactcagcaccgcacccgtgggggcattttggacaaggaggcggacatggcgaagctgctgagcttccttttttttcagtctgcgaaccgctgcatgcggcacccagtttttggattctgggtcgaaggcgcattcctccactgtcaaaggcggcagccgacgagcagcagagaaaagagcgtccagcgaggcgctctcgtccacacatctgcctccacttcccgagaacattctcgagggaagcaatacaatctcagcgaatcgggtgggcacaagatgcccacggcgaggaaagagaggtcacaacaaatcggaggcacagtaacgtcgaaaggatatacctgtttcaaggtacagccgatgcgacgatgcactgaacttattcagaatctttaacacaaccttgtaacatttacgtagaggaactcgagagctgttgactgtaaacttgcgtgttgagaaagcaacctcaagactacaaagtaaaaaacagcatcgacgtttgcacgtcaaacgcacatgagagaaacgaaaaatgttgagggaagttcacgggactacagccattcgggaagttttaaaattccaggatggatgcagcgctcgtcacctgtgagaggcgggcatgcgacgctgttgaaaagcaaaacaatacacaagagtagaccatattttcaccggactcctgtggtgaagattcattctgaatcaaagcgggtccattcatattttgactcggggtgacctaaatcacagaaataagatcaaatcgcagtactgtggacccgccgaaacacttgacgcgcggccgctaattcgtgaatcccgtgcatgcaatgggagagacacggcagaaaaaaaccagtccctgactttgcggggtaagggaaagctgaagaaatgagagacctcagagaagccgcgattttggcattcaccacagtgcgtacaaaatcttgacacatggacgtagggaagattggatacactgcggatgctgatctcgggcaaagttccggagccggctaggcggtcgtcaacatgttctgaaacacttgctgctgggaagcaaagacgcgaatataccttcagaagaaacgtatacacagtggacaaccactccgaaacgttcttgttgtgagttatcgcttcactaaatgttcttcattattttgcgtgcagcgatctaacctgcaagaggatggattggtacgctgaaacagatgaccagcttaactgggtctcaaccggctacacgaggcactgcaataatcggagcccttggaatagctttcacgacatgcatttcatgtgtgttccttgtcagcaatgtgtgttcccactacagtttactcaccgtttagcacaaaaggagtcctgttgcttccatcttttgtaacgcagcactttaatatcatcgtcggctgctccagggacttgtctggagaaagcaaatttatcagagagcgaacccacaaaaccggcgtgttgactgctcaataagttctgacgcacgagcacaagcggcaatgctttgcattgttgactgtaggcgggtagactaccacagatttggtgtccgagttggaaacggctagagaaatggaacgaatgaccaattctttgggtggcatctgaaatatctgggactggtagggcgtttagatgggagtctgaactcgaaacagagttaccactgtttttgttaattattaaggttcgttttgcagggttactgcaccgcataggatgagtcatgcctaatggttggaagggctctcacttttgtctaagggcccatcgacgcaaacagtcgtggtggtcagtctcgcaagagtactagaagcggtctgttcggggccctcccgttcaaaaccgcagtgagtagcaaggaacagccccagatccctcgtgagcgtgtccacgccggtgtcaaatgcaggagtcagattcggcaaggaagcaactcctgacttccacaagtcacacagtgatgctcaccaccgtgagaaagacagttcaactaacgcactggtcccccgggggtgactgcctcgaattctgtgcacctcttgacctccatgcacggccactgaacgccaaaagttggcagtagcgggcggaagcttcccctaatgtgaaatgtagtcaccgacgctgtcctctagcaaggtctagacacagcgttgcgagctaacacgagaaaagctggccttacgggaacaaacgtatttctgcctcgtccacaactcgcagctgaacagcttggccctgtcagcagcctgtgcaatacgactacaatgagggaatttcttcttttcactgaaagcaaaaacagggtttcaccatccgatcagatcttttgaacgggtagcgataacaacgcatacattcacatgaatgaagataccgtgtttccccccagtgacaggtagagcgacctgtgcgtacttctatcagcgcagttgaccccaattggcgccatggcaggctcgatcaactacgtgatagtttcgaagccatgagcacaaaaccagatgaggcaacgcgcagcttcatgataacgaggattaaaatgtgtagctcctagtgtttggcgagactcgtaccagacccacaagcttgtcaggcaagttttgtcaaagttgcggtgggcgaacgtacttcaaagcaccatccgaaacgcggaaacagatctcatgccctctacgttgtgtcaagtcgctttgtctgacacggtgacaaatagggaagttacattcgggctatcactaacgacaggggatgcagcgagctgataagtacgttacactgccacattccttatagcgagtaacccggttattttatcgcagcggtgactgttcatgacgctggtcaaaaaagggccggacgatccaagaggcatgtttaatgataattcgctgtagctgtcgctgcaacagcagacattaatgtcttctttttgtctagatatttatgattttggcaccgccgttgcggcgcaggcgtagctaatatcatcgctgtgcaaatgcttcatgctgtcaagttacacttccttccacaacgatagaggaggagccccattttccgtggtgccattccagaatttgtcgcgtctttttgcgagtgttcataaatcagcaatggatgcatccctatttccaactcctccctgctgaggtaagtgctaccgacaggtagaattgacgtaccggccacataccaagtaatcgcacgcggtatgcaggttttctcacggctttttcagaagggaactgctcccgatgctcagcgcgctttacctgttcaggatcatacgcgcaagcgggcatacagaagtggttgtacgccgagacaaatttcgtgtgtggtcccaaccacccccctataaactcttaacaacacaactgggtaacaacaaccacaataacaacaacgagtacccgcaacgaagacaaaaacctgttttctgcagtagttgtcgcgcagggtccgttttgtggccgtttaaagttgacggggccgagttgccaacgggttgaaaatggggctcccataattgcaccgaggcccgattacaccgtgccaacgcagactgcataccgaaagccgtggggggagctggtcttgtttgcggtggcgcctgggcaaatgctgaactccagggactctcagtgaatttccctctttcttgtgtactttccaattttttctgacatatccgagctcaatttccgaccctggcacgttccgaccttgcagagctacccacctgttgccgcgttctactcggttcctccttcctctggtgcacttgtgctaccgttgccacctcatcctctgtgaggattcgtggtgaggggatgacacacgcctgcatagtgaaaaaactatcacacacgcatttcaccacctctggaggagcctattcgcctttttttcacccgaagagaatcgcagccgctccgtagaatgttgtacggggggagagggagacgtgacagcgccgggaccgttctggatcactggaggatgcgccgtcagcaccgttgacgagaagcaccaatccggttttctacctgttcatttgtccgattcatcgaggaaaggga

SEQ ID NO: 3293 - DNA, 2632 bp, Toxoplasma gondii
tataacagatacaagtaacttggcaggcattactagacagcaatcacttagtctattctctgtcgggtacagttatatatatatatatatgtttatacatgtcgtgtgagttgctgggttccttttttgtgtccagttatctccccgtgcgagctgtggctgagaccagctgaggcatctctgcaccgcaggagagacgcgagtacttcttctgagtagagatcgattttctttttcttctgaatttggggtttactgttttcgcaaggctttgcaggggacctgcagagatcatgtggtttgggttcaccggtcgcgtaggcgcagctgtggtagaagtcgcccgcaacatgcagtcctaaggccgcaaactggtgcgcgagtctgtgttttcctctttcagttcttttctggtgtctgtttttccggctgggggtctattttcgcgagcggaaggctgcgcttttgtaacggacgcagcagctggacggctccagtgtgtggttgtcgaatggttgccgtgtgcaggaactacggaggaagcgaaatacgtgtttgacatcgacaagtttgaaatgattctccaagctttcgagtacgagtcggatccctctcaggaagggccgtccagtgggccgttttaccacagggcgcaggaagaaacagaagagaaagagcaccagcaccacacagaagccgcggcagaggagaacggctccaggaaaagaagacggctgtacatgccatccttctacaggtcaacagagaatgtgtttcgcagtgaccttttcaaaagcctggatttcgttctcagaaaccgaagaggaacgctcccgcaagtgcagagggccgccaagctggaggctcagaaccaacaagatgcgggaaaataaaaagtattagtcggttgcatgtggagaactcaggcattttcaaattgtctaaatgcagcaatgagtcgacgttggagattgaggggtgttgcactggaatcccgaaaacaagtcttgcgcgtttgcctcacggcaacgcgacagaaaagagaaccaacagccagagtgccctcgcacagacgcagggagaagcaccagacaagacatagatttgtacttgtacgcacgcgttatgaccttttcgtggagggtgtagcagccttctggctggtcctcttggcagctgaggcaaaccatattggatcggttctgccacaattttcatcgctactctctgaaccaccgagactgcgttgaccactgaggcacgtcgtgagagaaaccacatcagatacatgccagcccatcatctgcttcagcagtatgcgcctcacagggtcttactaatgctggcagcatgcgaatggtcgatatggccctgttttcggagttgccgctgaggaacgacatcaagtgtctcaggactacaaagtacatgctgcatcacaaatgatggacatgacgaccgaataatctggtgaatctcgatagtgtcgtatcatgtcactccaaccactcagttcctttaggttgtatctgttctttgtccaagccacaagtcttatgtccctgtgctcctgcattctgtgttccatatccatagtcctatactgacgtactcaagtgtgacggtgtggttacctccgtgttcattgtcccggaaccaccggttctagtttaaaatattgtcactcgtgtcttcaagggtgtccggtggaactgtaacgaacggacatacggcattgttgtaagagcccttccgacttggacccttccgtgcaggagacactacacagccgcttaggctgttgaacccgcacacagcttggatttcttccgttttgatttcaggcacggcgcaatacaccgttccgctctaccctactacacagagcagccaaactgtacaagactcatcgagtttctacaaagcaaatactgcagtgcggcatttaattcccttcccagaacttaacctcaagatgtaccaattatccctgttggtgcatctttcgtgacaccgttgtgcagcagaacacgggatgacatccgttatgacacgtctagcccagatccgttttcgagggtagtcatcctaacctacagcgtaatcgcctcctaactcagttgcttcggagttccgcgaccgggtgtgcccttttgcacaaaacagaccgattttcagtcgtggtacaatctaatcgggatcgaaatgcgtacacgagtcaccaaatcgacacccgtgtaccggcagccggagtttccttcgtgctcagctcgccagtgccgggtcgagcttgtacagtgaatcggtagtacttgcaacaggaaacgttcggaagacctgcagtcgacgccggtagaccactggagacctgatgacaagcttattctcttgctaaccatcttcacatttcgttcaccacaaaggtactgcttccgtgttgggcgtttccataagggagagattcgaaagctcccctatactcatcgaaagcggtctggcggagctggatgctgggtgcgcacagctggttccggcaggattgcggctctaagagtgcagagtatccctcatctcgaccttgctcccaaatgagtctacagttgtattttaatcgaaatagtcgacgcaaaga

SEQ ID NO: 3294 - DNA, 3964 bp, Toxoplasma gondii
ctttcttctgcagctgttatgggtctcgctccagccctgttggtatgagggttgtacaaaacgatgttccgatttttgtacaaaacaatctcatagttgttcgttaacgccgtgtctgtggagacaggtgttgaaagacggagtcccccggacgggcagcggatgccgcctcgactatcgtcactcaatgacagtatcgcgtcatcacagggaggcagcgagagaagtccgcattctcctggcaacgccagcagaattggttggtgcggaggcgagtcagcgtggaaatgtagcgacaggtcacagccaggcccccgttcttcccctcctccccctgcaattgttcctagctggcactggcgtgtttcagactctggaaggacttcgaaagaagacatcggttctgaaagacgagctccctcgcatgtttctggcactgccgctggcaggaacgaggcacattgctcatccacagggttcctagcccgctgcgagtaactgtccatggcagaggaaagatgtatgcggcgtccggtgtcaacagaattggagtgaatcacgcagcattcgttcgcatccttacaaaatcttgcaagaactggttcctgctctgcggtactgagtcaatttcagttcgtctgctcaaataaagcggcggagagctccgtcagaacgctcgtgtacgtcatgcgcacgaggtaaaagattgaggatgttgcagataaaggtgccggattgtcctgagggcaaaattgacctgcgaagaactgggtcgatactaaaaaaagctacagcccgagcacaacagacgagaatgcgtggtagacacaaggtctacattgaacggagaagaaacctgaaaaaggtatacagcagccggccaggctgtcatacccggaaatttttgcgtcttcagtttagagacaaaagcaaaaaaaagggatgtctgccccccttgcggccggcttgcgaaaagtaactgcggtaatgcggattttgcatgcctactacacagctttcgctggaaagactcgatccgataacgcgagtcatgcaactgtttgccataaattcttgtggaaaaggaggaaacatgagtcgaatgagttcgacaattaccctcattctgcttcacattagggtagttcggactgcaaactcacctcgccttcgtccgccatggattgacggcaactctctgggatcgatccgagccattctgactctctggaacttcctcttacacacattcgtgcgtttcgtgccgaagatttcccaagaaaatgagtggtagaaaggaacagccccgcgttccatgggggaatatttcgctctgacagtttatgtttttttagcggcaaacctgataacctgtcaatggcagtggtgactactgtcgcccgcccaccgtgcacgggctttcttaacgttcacaaaataaagcccagctccagcagtaaggtattgaccagaatgaaagcctaagcattggctgtctctgaatgctaatggggtaccatggcttgccagggtgttgcatgtacactgttaccccgtctgactgcctactatggcttcgctaattgtgccttagaatcgccgacccactaccaaaccaatcaattcctcgttaaggctcgcttccctaatgcatctttttccacggcagaaggttcactatgacgcagctctcgacctggaggatcttccttagagtttcaattcttatggaactccccaaatctcttggaaagaaggccgcctgcacagtcacagtgttgttgaaagctcccagcttggcttgccgcgcattcaagaacgcactgcagagtttccacaccattcttgattcttgcttcgagagtgaaacacatgttctaacagccggtgccatttccgtgaagcgacagccgcagttgatttcaatcattccaacggcagtcgcacccaacgttgtcgaacgctaggctcagccatccccgaggggaaacagaaatgctgccatcggacccgcatggaaccccttcgatctaccccatttcaaaagcattctgagctgcaaacagctgcaaatgaagtgtctgcttgggggttgaacggcgagagtgtgaaagggtctctagctttatatgatgcctgttgataaaaacgccccacggaggaacaaagcggtatgtatggggcatgaatgcagtcacatggagccagtgggcgtcagtcttagacttcgatgttgcaccaatgcacagaagacttccttgagagatctagtattatggctctcgattatcggacgtgtctactcgagctgtccgccagatccttctaaacctgctgacactgcatacctccagaggtctgccgtgttcgaagttacaagtaaggaatgcccatgctacctatgcatatcaatcctttatattcactttcctgatatgtgagaccgaagatggcttacaccccaaaagctgtccgtgtgaaggcgtcgcgacatgcattctcacgctgaaaccatggcgatatctctgctttttgcaatcgttcgtgccttcaccccgcgaaaacgacccttcacaaaacttccctgcagtctattacaaacagacaatggtacactgatgggtgcactttcagacacgaaaaactaatcaggagcttaacaatggtgtgcacgtcgtgtgagcacgaaaacaggcatcgcaccgtaccgacagatatgtgcgtctgtggtgcaggactgctttcagcacccgctcctgtacagacaccatgatattcactttcgtagtctcattcctaacttttgtcggtaaagaatacacggatcggtttcttgttggcccggcactcgctaagcagttgcaggaacacttctacgcttttgggcactagcaccactcacgaaacaatcctggggataacgactgagaatggaaggcagcccaaagaaaaaaggatctaaatgtatcatttttgatcgatctctgtttggcgatgcttgcagattaatcagcactcttaccaagttttcgaagccgtagggctgtgtcttacccacgcatgcacacacggccccttcatgaggatgattcaggaacatattcgtgtgaaataagtagggaaaatgctcgtgaacgaaccgccgaatttccacaaaaataatgcgcaatggagaaaaaaactgtccaaattttattctgcgttgctctacgctgcccatccgcagctttgcggtcacccactgcgaggagcatgcacgaacatcgcggctgaaatactgcaacagcaggagatcttgatcgcaggtgaataatatactccattcctgctacatcaataatactttctgttccgattgtgtgagttaagaaatgtgttgtcccgctggagtcgtaaactgtgcattctgaggacgtggactaccgtgtcaacaataggtctctgctccaattaattgatatctttctccttgtcttccaagaacgcctggcacacagaatctgcttgctttctgctatcttctgtgtttttccgtacatttgcttgccttctgtttgcgactctactttcgaagacacaatcttcgttgcgcagagaagtggtgcctttagagtcagtgaccttggctgtttacctcgtgtcagaactattctaaagcctggagaggacgaaaaatgtatgagacagttgacgcatctgcatagcagtgcaggctgaagcgtctcttttcatgaaggtgccccagtagctgttctgacgcccgccgccttcgacaccaaaaaaaaatcaagctgaggcgacagagaacatgaccgctggcggtttactcgcttttgcttgctcgcagctctgacgcagacgcaccacgaaacacggcatacgatgactcctacaacatgcgcatatccagtcccataattaatttttgtagaatgaacatctctttcggtgccagtgtcaatca

SEQ ID NO: 3295 - DNA, 1546 bp, Toxoplasma gondii
ccttagcgatggcttgccggatggcgtagatctgagcaacgtaccctcctccgctaacacgaacgcgaatgtcgacatcctgaaagcgttccttccccaagagaagaagaggctcgaatgccttcaccttcaaagcttcgggctgaaggtgctccagggggcatccgttcacacggagcagccccttgccttgagtgcagagcgcgacggcaaccgcattcttctgtaagaaacagcggacacccacggaaaacatctgcatgcaaatgcacggcgagactgcaaacttgcacacctgcgcaaaagacaagagcagctgcaggactgcaccacactaccaggcacgggcgaaattgtaccaggcatgcacaccaactggaaaatcagacagagcgtgcggacgcgtgtgtttgttgtcccttggagtctacggtacggtaccgtcagcaagacaggatgtctcaccttgcggccgaacgtctgcacgcgcttcttgggtctcttgccaatgtccgccattttgatcgtcggaaggactttcttcctcaccctgtggagcaagcacagaaagacaaaggcacgaagtgcaaaaaccgcaacgacgcacgtctttgtctccctttgtggccctcccatctactggagagggagtaggcgaaaacgagctccagccctgcgcatgcaggtatttcccaggccccgtgtgcctgaggaaatcggctgtttctgcagtcgcatcctgtttccaggcgtgtgggctggagaaaaaaccagtcggagagtcagggggtggacacaaaccctccttttacacaaacacattatcgaaccgacgggcagtttcacgacaaacgaatttcgacggctgtagactccactaaacattgccgcgcgttcgggcccccaaaaactctctgcgaaaaattacggaagcagtcgtgaagcgaagggtattacccgacgcagttcccacgaaatcgtcgaaaaaaccgcctggagaaactcccaaggttcctctgcagccttcgccagagaggcctggggaagcatgtacagtaagtgagtggggcgatgaaattctgactggagggagatacacgacggatggagttcatcacgtactgcctcgttgttcttccaaagcataccaaacgcagtgaatgtgcgggccacaccactgcagcacgactctccccagtatgcggtctctgtcgttttctttcctctgatgggcgacagagccaagtcgagacggcgtggtatttaagcgtgtaccaggaattcggtccctctctctgccgcgcttacccggaaaagaaggcgggtcgttttgtggagcacaaaaagccctaaacgcgtggcagtcaggaatgaagccagaggcagaaagtgagaaacccggcacagagccttctgtgccatccccaagtcgttcgcgcctcttccttccactcaacttctcgcttcttcccccctccgcccagcgtaggcagagagaccaccggctttcttcttcccctgtcgcgcagcagttcaccggcttata

SEQ ID NO: 3296 - DNA, 2277 bp, Toxoplasma gondii
gtagatacgtgtagcgggacgtctacgtggcgtacgtcttacagagaccgtcgtgtcgtggagcgaacacgagagcagagggggggagaaggaattttttccaagggaacgattggcggagatggaagactattctcaaggatgcagagatgcttctgcccccagttaggtgttggtcgtcttctcaaaatacttgtagaggcgtatgcaagcgcatttgcacgctacgcatacacgcttgcctgtagacacatccaggtgtcttggtggtattgtctttagatgccagaagaggtattctgaactgaggaccaggatggggaacgggtgtttcgggtgagacgttttctgaagagcccaaagacaggaaaaagtgcctgctgacatcctcatctcttccttctccccgtttagccaaaacgcggaccaacccgtgtgtcccctgcattgctggggaaaactctcccaaatatgtgcttgacttaaacaattccatgtgtgtttcgttgcgtaaaaatagtacttgtatacatgcatagtaaggcgccggtgaagttttcgccgccacagagtgccaaaacttacacacacgcgtcagacgcttcatttcttcgacgaaatcacaggcgctctgcgtgttgccccaccgaaagtctaccacaccttagatagccccaagctgccgggagtctctgccttcacaaagcatcgtcggtgcgattgcttttgaaaaacacatgccgtgtgaaacaaggaaccaagccgacagaacattccctacatgggttttccacttgcacatgcacctcgacttcacagctttctacctggacagcatcgacattagcactcacatgaaaacatcacgcgatggcattccagttctttgacggaaagaacgcgtgtgtccgcaaatgcgcggacgtgacaaatagcaacgtgcaattgaccggatgtacgtacagcccgagcacagtcttgacagaaacaattccaggcccaagtagaaagtgatttttaccgacagaatacgtgctctcttgtagtgaccagtagtccaatggtttcaactcgtcatttgtgccatcgtaaaggaactctgagctgtaccgcacgcgagaacacggcaaaagaaacaacggtcgtcagccaaagcgtggcttggcttcgacacactccagtcactatagggttgctgcctggccagtgagaaactcacccgctcacggttagactgcgagtgtctaggcggggacagcgcgattctgccacacgattgtggccagcgcgcttcgacggtgtagtcgtatgtcgtgtgcttctacgtgaggaaccacaaaaccactggtttggcgctcgggtacgtagtttcaacatctctctcaaggtgaggtaagcgcgggcctagtacaaaacgcccgtggtttcgaaaagccttctgcgtaatcatttgaggaaccccatttcttgaaatctagccctacgcaaaatgcgtgtggagacgatttcattgtattgatggtgtctgtgtgaaaggcactttgcaaggggaatgcctaccgtggccgctgcttgaagaaagtggcttctgctgtcctcccgattcaaaaccgaattacttctttgggtcgcgggaaacaattgcagttgtttacagaggatggatgtcggcagccggagcgatgtgcgaaagactcgatgaaagtgggcctgttccaagtgagtgggcgtttgcgtgtcggtctctgccgcgccggaacaaagcttttccatacagaacgctgcgagttctgtccagaacttgcttagaaacgaggtggcgtcaccgtagatgcctgttttaaacactttttctgaaggcgcaccaccaacgttttaccagaactcttatgtgcccgtcattccagccgagggcggcatgtgagcccgcggcacaatttatcggtcctctccattgttcatgtatggacttgggaacttttaagaagaacaataagaagaaacctctgtggctgggggcagtgacgaaccaacgaattttaaacaagggggttaatccgttagcgacccggttgtcgaacggcagatcggcgtcggcccgtagtgtcggtgaagcgcccgtcagccgttgcctttcactctttatcagctgtttttccgaatcttgtggagttttggttgcacttcgttccttaacacgtggtgagtagctagagattatatgctcgagaaggcgtatgatacagattaggtttcacatctgtcagaacgccgcaa

SEQ ID NO: 3297 - DNA, 2389 bp, Toxoplasma gondii
caatttgttgcctgtcacaactgcacactcctgtcttcacctcagcagctgcttggatggaagcagggatttcagcatccagtcagtatctatctttgtttaaaagctgcagtcagcaacagtgctgatttagtgtctgcgcttaaccatctgcagtgcgactggcgtcgaagccagacaacaccgaagccttctggaactttgatcatggcccgtaaatcctcagcggaaaaagcactgacaaaaggcggttcttcacaggtatcttactcacggatggtggtagataggacgtggactttcgaatggtctctgtgatcgactgtttgacttctatcaaacggtttaccttcttgccatctgacgtttttttcacgcgtagcaaaagtcagtgtactttcttctgtagtggagacttcactcaatctgtctcaacaatgtctgtcacaaatgctatgctgcgtcttcggtaatgcagcagacgcaagcatcgttctgtcttcgcgtgcatctgtatttttcagaacttcgtggttaaacaaggacgctggggcaacggtagtaacactgtcggctctgcagcatgtgtgggagagagaaagaccctctctgttggcaagcgtggcaacatgttagctgaccaccgagtgcctcagtgtttttctctattcccatgcatgtgtacggaagcacggaaaaagtggaactgtcggagtttcttataatacgctaatgcagaggatgataagcatatctcactcttgcagactaaacaaagaaggcggcttaggctccttccaaactccatgcgaggttcacagctcggaaaatcccctctgaacctcacactgcgcttggttctgaagaccattctgctaaaacgactaggcaacacacgagaaggccaagggttcagtttcaacagcggcagtgatgtggtttgagtcagtcagcttttgagccacgtgcttctagaagtgaaacgatgtttcgatgtttcctaacctgtcgtgccaccttgcccgacatttcacgacgctttttaggtcctgaaactgcggtgatatttgtaacgactgaaggcagagaggatgatgccctgctgacgaaaacaaacgcaaactcaccagagaaatagaggaatggggtcatgccatgggttctgacgaaaggctcggagcgaaagcagactggtcgaaaaagaatcgcacagccgaacttctgaggagacatgcggacggctcggtgtacgagaaactacagtttctgtctgtttctgcgatacgagaaaggaggaatgtttcgaagaaaagggatgtctagccgggaagcagacaacgttctccaaaagcttgtctgggaagagtagataatgtgtagactacgagctttgccttgtgtgacggcaaacgacctctcagaacgaggcatgagaggaacggtgccttttcagaaggggttctcttttggagacaggctttcagtggaaatccactcattgaggttgaattgacgtcggaagacatgagattagtggcagtgaaaggagatttctcagtcaaaacacccaacatgtacttggaataacatggatgcgcctccctagccgaggcgtcaccgtagaaggccttgaaaggacgagctcgcatgcagctgcacactttgaatgacagaataacgctttaaggaagaacgctacaaatgaactcagtttaaggtggtaagagtgttttcagtgcaacactgcaatgtgtgtgcgaatatcttaacatgaaacccctgtttttcggtgtgtggaatctcttttttcatgaaaggcacatgatcgttggcggttctctaccaggtccaatccgtctggcggctggaccttcggcgacttatcctgtcaaggagagcaattttttccgttctcttctttcgtttatctcatttcgttccagtgtgtgtcgtgatctgaggatcgtttctgtcgtggtcgtcgatcgcgagaagggaaaaaggcaaaccggaaaaacgagcacgtttctagcacaagcgtcggtttttttactttcactgtaaaaacgctgagatgtgtaaacgcgttctctttcatgagcgacaacactctttcgtcactttcctgccaggtcgccagagaccttcgtaaagaaccttccatgtaaatgccagccctccagagtttctgcttgacatccgggcccacatattcttgtcggtgtgagcgaaaagcccttccggatttctgccgattttcccatcaggctattcactgtcggtcttttctcttgaacagtttgcttcttttagaaatctgaaactagacagaaagggttgaactagaaaaacgaagaagctcttggtgacctcgatcaagaaaaagcca

SEQ ID NO: 3298 - DNA, 4740 bp, Toxoplasma gondii
gttgacttgcctgggctgtttggttttgtagtggagaggaatgtagacgtctttcacgtcgctgcatctgccgaagaactttctcaagtcatcttgagtagcgctacggtcgacgcccctcgcgaccaccgagtacctgcggtgtttgttctgctctccggaacccgatccgtacttgtctccccggaatcggcctctgaagtcgtctccgggctctccaggggacgagttcctcgcaccgcggaagttctcgtctcgcccatcccggtctctccgagtataaggcgaatcgtggtccatcggatagcgccggcggtggtagtagccgtctccgggggagtagcgcccaggagggcggtcgtcgagagaatcatctcggcggccgtcgtcgcgacgcctcctcggagaaggcgacctgtctgaagacatctctctgcctcgttctctccgacctagaaacttgccccggtcctcgcgatcgtaggaccgcattggcccgtctagcgaggacgatcggtcgtctcgacgggagccataccgcggcggcgagtactctctctcccttcgcatttttatctacgtctaatgcacaatcccttcaaacgagagaaaacagctcctggaaactggaaaaagcgagacggtcactgtcacagctgtgagaggccagaagaaaagggaacccgaatacccgcgggtgcctttgctgaaaaacctagcgagaaacttgtcgtttgccagacaccagcgccgacagaggaaagaagagccgaagcggagtgacgacgtccggagactagagaccgggagaggcttcggaaaaggtcggggcgctcggcagacgaagacgagttgtagggaaggtcgggagaaacagcgggaaacagaggacagagacaaggaggaggagccaaatggaacgaagagagcggtgcgaaacagcgactaaacagggaaagacacgcggcgacaagaatatcgaaccgagcaggaaatgacggggggacagagagaaggcgaggcagggtcacgaaacgacaacggactgcggctgacgggaaaagacagtcctggagatacacagtgaaagggtttaatcaaaagagaccatccaccggaaaactcagccagcgcggagaccgccggggtccttctttgaggagtggaggactggtaggtggcagagcggaagagacgagctgaaactaggcagaagaaaaggaacagtaaccaggtttcggttctgccctttcctcaggactttgctgcctcgtcgagtcgtggagcttggtactgagtgcgagaaaatgcacagctggcccctatgtcatttctccccccttttcttgtatgagacaaagtcgacctccactttctcgtcacctctctttccacgaacctccgacccccccctcccccccgatcaagcgtagttgtcgctatctgtttctcttggagtgcacgaacagtcgcaaacgctaactatgtagccttccgagtaattttcaaggctacgtggcattgcactccgtttcaagacttctcaaaatatttagcgagaaatagaaatgatgcactgccggcaatgtgcagtggcggagcaacttgtccgtcgaaggggattcgtcaatacgcactagatgtctacgattttgtctcgctggtttttgcgacaaccgcagtggtgcagatagccgtttgcctggcctgttcaagtattgaaggagttgcttaattctagacagcatattaacttcttttgctgcgacaatcttttaaccgacagcctcccgccaggaacacccacattgagacgaaggtacttcggctcgagacgaaacaagcagcctgcgactttaccagattcaccgagagacggcgcagttgggaaaaaacggtttttccaaaagggaagtgggggtgtcgggcggtgggcatgcatatgatcgtcgatttctgacttcttcggaggccaaagatttgctgagtgtgcttggagcagcagcggtgaaggtacacaagcagggacaggaggtacgagccgctggacagttcttttggttctgaaacgtttttgtcatttcagatccagcgacataagcatcaggcatcctgaagcgcgaatgcagttgctctactttggtcaagagcactctttgccctcagctgacagagctggcgacttgcgggacggaagcgtgctaactcaacggatacactgcatcctcacatgctggcttcccgttttctacgacagcattcactgttgctgctgtcgctaaagaatagtgattaacacccgcgagtgaaacttcactcgaccatccaccataaaaccggctgccagcgtcattgaagaccttttcggatggtcgtcagacggatacgggatgtgcacatcaggtcacttaacagtgtgtgcctgtgatggcgtgtttccccatcaagggtgcccccgcatatttcgattaaatctctccagcaaagaaacctgcaaacactaaagtctagaaatgcgggcgcgtcactttccgcatgaaccgcattgctgacgacgtcggctattgcgaggcagtgcataataaacaggcaagcatgatgaaatggaatctaagctctacatatctgaaacgactagtttgagtaactcaagtacatcaggaattgcgagtaagaggttccttcagtcgacaaccaacaagctcccgaaaatgcgcagaaaggaacatgcgtctcgacagttcagttttgtcaaactcacgtgccatcaggggcaggacacttgagagttccatagaagtcctgcaggcccacagtcaccaatcactcagtcgtagtggagatacggactgtcacgctagatttgtcttcgtgcagcagtggatttgctgagtgccctcacggcactgccaaccctgtttacacgagtaagtcatcggcggtcaggcaatggtaagcaaatgcattgtcacagtaggcgcctgcggtagtgacctcgtcgggtgaacattgattgttctcggtattgctccatgccttgagcttctgacttgtacggcccttgcagcctactcccagcatagtgtgctgcagtcattagacagcagtttgtttgttctgcgtctcgaatggtttgcacagacgagctctttgtccagccaccaataccgcgtgaccagcgaaatcgtgtgcacaacttcttgctgctttgtctgagatagcgacagatctcagtgactgggttgcactattcgcttgttgaaaactctgacaagcatgccgcatccagctggttgaacgtcaacagatgcggccacctgcacaaagcaccaacgtcgaccactttatgaagcgcaagccttcatctaatgttatggtggcctgcagctttggtagagtcctgcccgatgttggtctacacggaatgcatagatcgaattcttgttggccaaaaggctcccatagagatatatgtacaaagaaagttaccgtttctgcggatactagcatagccagaaacagtagggcatgtaagacgtccagctaaccaatcggtaggctgaaaatttataatcatcaaacgaatactcaaaaaatggctatccctcaattggtacggttccgaaacatgcaaaagttctccgttcctggataacgacttatgttttgccttcttgggaacgctgcagctactttctgtccttttgttcttgcaaggtgccctacggcaaaggctacgaagatgcacacctagatcggggacgtgtaggcttttcacgtgcatgcaccgggtgacgtctctccaagctgataaactgcaagcagaaaaagactgaaaaggtcaagaaaagggaaaacgttccaggacgtcacgacttccgagcaatcaggtcaagccgtccagtccaaaatctctttttcgtcacctgccgggtgagtttcgtagctagtcttccttggccctccacccgtccactgtgcgcaacggaacgctctcgagcaggctgtgcgctttgcatggtgtgcatgctggctacaattttctcgcctaaattgtcttggacgggtcggcagcagtgaaattgtgagtggtttacgttagtaagtaccattcggggggcgcccctatgacacagtgcctgaggtagtcacgattacgacgatatttcaaagagagtctcccttcccggctggcggacagagtcttcgatgagaaagggatctgtgctgccgttttatgtttgaagatctcctttgttgatggcaagggagtgttcagagttgaacacacgactccagtcgttggacatgtcaagtgaaacagaagcttctaggttctgtttcaccacgcccatatagcggcctcattctcctcaagagttgtcaaaagaaaacgaaacgccttcgttgttcaagcttcttagagtatcagcgacatgtttgtcgctattgtgggggctcgtgaatcgaggacggttgcggtgccacgtgaattgaactcgctgtgactttccggagtccccgaaaccagaagacgtcgctttccaggatctgcattttcctcgcgtgtcgtatatgctctgtgtccttttttcgagatcagcgtcggccccgtgaaatgacgcaaaactcgcagtgctccatagcaccgtagagcacttgccctcagatccctgttcgtgtcgacttggtctgcttacttgcatctccaaccctgagtgtcactgcccttttcgacaa

SEQ ID NO: 3299 - DNA, 1668 bp, Toxoplasma gondii
atatcagtgccacaacatcaccgaaggactgcgaaacggacgaccgtggcgggtgtagccagtcgttgtgatgataccttcctcgtgtctgagtgaggtcggacgactcagtgatgaggatagtccttgtctgcctcgtttcggatacacctcacgcagaaagacatgtaaacttattacaatcggataggttaaaggggatcctctgttgaacgtagcgggaacgtgcgagaaaccgcaacttggagtgcgtgtttttccactgtaggccggagaaccagtcgattgttcacgaatgcgcggttgtccccaaaaaagtttgataataaatttggtaaaagtctctttatactcactggaaagcaagtcagtcacgccattgttggtggtgcgtgcggtttgagggactctttaatgcgatctgttagtcttcttatcaagggatggtaggtggcatgcatttttagaatgaggagcgcgaacggtaagcgaatcgcatgttttccaatgttacacaggggtgccggtgagcagaaccaacggtgttcccgttaggcagtgttgtgctgacttctatacgtcactgttcccgagaacaatctaaaattgtggcactctcgttgaatgcgaggctttgatctcatgcttttgtcgcaccgtgcgactctgaagttccattaaccggacacagtgcggtaatagaaccaagagcatcacagcatgtgctttctctccgcaccacgttgtgcagagtttcttcgtgtacgcatatagagactctgatatatatatatatatatatacagctgacatatatatctgagaacgtgcagaagatgggataaatggagcagtatattgtgattggggtagtaaaacaaggagagcatctactgaaagtcatcactagaaactgacaataccgctggagaggtgtagtgttcaaaccgcgaaggtcacgacgcgatctgacaggccctctcgttgtttggttcgtggagaatttttctggctaacgaaaaaatgggtaccggcaaatcttgcaacgcagttcgagctgaacacatgaacattagaggcggggcgcttacacgtgctagaaaggataagactggttcgttcctgtggaggaacgtgcgttgcacagtaacacacagttaccgcttagcgtttagtgctgtatctggctctgcggcagaaatgaacaacgccgttctaagggggaacaacaaagtttccgacagccccttcatatcgtcttctttattgttgttgcatatgcgtctttgtaatgcaaatattcggcctacaatgtactgaaacatgttatgaggtcgaggaatcggcctcggttcgttggcctgcatgcacacagagtatccgtatatacggcgacggcccgcaggtgggcgcatggatacgaatatttcttcccgtttcctgtttgtcggccactgtggcggtgcctagtcggctgcggaagttcggagacagccgcacacagacgcgggatctgtggacgttagattttcccgtttcacgaaaaaggaacgtttgaacgcaggcttttgtgtggagcaggttatgcgggaggacgcactgtacttgcaaggccctcttgcagtctgtccctcaaaaacgcactgcgagggcggattccgtggttga

SEQ ID NO: 3300 - DNA, 4566 bp, Toxoplasma gondii
cgtctgcggtagagaatatggaaacgaggtccgacctcgcaggtctcgcggacgcctgatgacgcgtcatgttggacgcgcgaaccgccgagagcgaggcagacgacagaggacccgcaaagagcagtggtgaagaaacagggcgtctctcaggtctggcttcggcatgaccggtgtcgctcggaagccggccagaggctgcctcttccgtgcgaaagccttcttcttcgcggcccagacgtacagactcagctgctgcttctgactcgagaaactcatcgtctgatccgcgatacgccggcaggtgcatagcccagcactgtggggagggcggcggggaggagtgcggagacagagaggaggtggagacgcgcctcggctgcggcgcctctgtctcttcttcaccgcgagagtggggagagagtttcgcgtccttttcgggcaccagcgcccactccaactcctcctgagacaaccagttaggagacgaaactcccgacctggacgccttcccgtttgtcacgctcagacgccccacggacggcgccaagaagtctcctcgcttctcccccgtcgctgctgtctccggccggtccgcctggacaggcgaagcggcggacgacggcgacacagcttgcgcttcatgcatgttcgaggctcgtctcttttcagcagccagtgcggctcgaaggggacgaggagcttccgcgaggaacggcgcagtcgcaggacgccgcgccccaacgaccgcggtcggaggcgaggccggagaatctccgcctgtctccggcgtgtggagggtcggcagcggggagacaaactgcgaaggctcggagccgcgcggcgaggccgaggcagacgcgacagaagataactcggacggcggcgaactatccggagaaggcttgggccgagccgacgggggcaagggagcggaagccatttgaccttgagaaatactcctggaaaactcttgcacacccttctcccgtgatgacagcgaagtcgaagaagaggaggaagtcgaagaagaggaggaagtcgaagaagaggaagaaggggaagaagaggaggaagaggaagaaggggaacaagaggaggaagaggaggaagaggaagaagaggaagaatgtgtgttacggtctttcactgagtacagttgagctgaatcgcaggggagaggctcggaaacaaatcgagggttctcgtctgcacatcgcgagagaggagatcctggagtcgaggcagcatgcttcgccaacagtggctgcgaggcgagggcagaagcgagacaagtgagttcctgcgactgccgacgcgaggccttcgcacggcctggcttcgactgtgcagactgcgtccaagaagcgcgagaggaagaccgcaagcgaaaaactttcagtttctcgagagaaacagaagaaaggagagacgaagaagacttgcctaggttggcatgggcgtctgttgtgctgcctctccgcgttcgccggagcgtcgtggcgaaggggagaggcatcattaaacacccaagaagaacaggtccgagcgcgaccgcgaagcacagacggaaagaggcaggctagacgaaaccgcgaagagagaggagaagaattccaactcgccacccatcaaccctccgacagactgggctgcagggaaggagaggttggtgaagagagagagagaagaaggcggagaagcgggagatatcatctgtcagagaaaggaggaaggcgcggcgataaagaaaagaagaagttgttctcgagagcaaagggcgaggagcaagaaccgaggcagaaaggcctttcaggttgctgacggcgttgcgaggagaagaagacgagacaacaagtagaggacatgtacacactgtcgagacaccgcgagagcgtctgctgcgcatgtcgctggtgcggtttcccctgaaaaaatcgtctgtttggtccttgcagaatgcaccaacatgtacacaggagagccagtcggcttcttcaaagtgtgaagtggaaaggtgcgaacagtctgcaagcctgccgcggaacaatacgcagtcgtgtgaacggctgcgtcgagcggtcgggtgtctcccggtgtagacgctgcaaacggagaggagaaagcgatagaggagagaaatgcaagtctagcgtcctgagttggcagcgcctctgcgtcgtcaagactcgaggcagggttacatcgaagtccttcctcttctacacggcaggatttctctccgtatacacaccctcccgcctctgtgcaaaagtcgatctctcgcgtgctcagaatcccagtgcagtcactttagctcctcagttccctctgaaacgaaagagagtgtgaagagccgatagatgagaaaaagaacaaccgaaagatcttggttttcaacgagaaaacaagacacgagtcaagcgaaatccgcaaggccaccggaaccgaggaactgcatgcactgctgcctccggggaactagctgccctcttcttggagaagcgtccgtgagtcgagggtgcttgtcgatttatgttttattgaatgttacatcaaatgtgaaacagcaagctgcggttccaaattcagcgagttcgtttctgacacatttcagtgcttcaaatctgtcaagagttcctcgacagtcggatgtacagatacccagcaagtcggtaaaaagcgtagacgcaggattttcctgtgtttgtacatcattcagtaggcagatgcttgtctgacctcccaaaattggttccctggtgatgaggaaatgtctcctggagtgccgctcctctctactgggtcgcgcgctcaagttgtagagacagatgtagatgtaactgtaaataactcggaaggcatgactgtcttcccccttgtagaacggagtttcgcgtctccttagccttctttgaacggatgctctccacgttttagggaggaatttggcgttcccagttccacgctgtacgttgaggaggcaagcctggcactgtaggagcatatacaagtggatacgctaactgtgcaaacgatccgcggtcccgagctgcatcgacagagatgtcaacaacgagaaagctttggcaaagtcagctgctgtagagccacgtttactacctccaactgtgtaaaaacgtgcacatctcgcgcaaggaattagatccacacaaaataggggcgagcaaatgcgtctgtaccgctggagactatcacgcgctacgtccctccgggtattgtactcggaaggtccctagtatgctaagaaggtccgccttttctttgtgtctgtccgtaactgcgggacagacctactaggaaatcaaattcactcaaccatatgtccactctgtaaaaagcgacaaacaacagctagcgaggcgacaacgctgcgtggtgcctcccatataagcaaagggcactcgaatgggtggctctgaccctcgcaagatggaaaaacacgcgaaaggagttgtttactgagtggatcggcaccaatccgtttcttctttacgaatccttacgataataaaagtggaaattccccagccttctactggaaacacctgtgaacaggatgtacctaaaaggtacaaaagcggaagaaccatggcaaatcagaaactgccgtctcgatttccgcactctcgtatattctgcgccgcgcaacatgaaaattggaacagctctgctttagccgccaaggaaaataacaaactaaaaaaatctcctgcattcttgcttgtcgccgcaagccacgagtatcgtgacacgaggcggcgatacgaatccatttttgtgcttgcgataaagaatgtagcaaaacgggggtgatgcatataaacaccatgtggcattgtttcagtaataaagcactcgcactatggcttcggcatggtatctgaagtgcgtgcagcgaacggacctagcgccagacacctggtcgataccctggaacaagcatcgaaactcgttagtgatctccacaggaaacacaatgttgagaattgcgacctagacagggttgctctgtacatgttttcctttgctgatgcagctttacacggcgtaagaagtggacgatttgctcgaatatttcttttggatcgtcggttccgcttacgctgttccccagaacggggtcgctgtggtcacagaatcgttgactctgtgcgtcgcaaagaaatcctgctggccatggaatgtgcagagtgtcacaaatgatttttcgggatcggctggaagcaggtactgtaaaatcgatttgcgtttcttcttgagtggtctacggaccgtgttcgattagctccccctctacaaggtttgtggcgttcgtgtacggcttaacttctgttccgtgcctgtgtgtttctctgtgtcgagataccggcgctggagaatgtctcgtccatgcgttatgaagtttaatccaggagagtcgtgattttgggttatgtggtttcacgtttgagaggctagttgcggaagaagttgagtgtgactcaagggctcagggaagttttcaactcacttgtcgacttcagtccctatcagctgcggcaa

SEQ ID NO: 3301 - DNA, 1972 bp, Toxoplasma gondii
aaatgccgtaacctttatttggccttttctcagcagtgctacctgccatatatatattatgccatatatatatatatatatatttacacgtttaacgaaacggtgattctgaatcgttcaagcagtgttgggaaccccctgagaacaacactcttctctcaaacagcaagtccggtgacgttttgcttaaggtaggtgtataatttggtggccggctggtgttggtaaagtaacatcacgagggaaaccggctgttttctgttttttgtgcaccacttggtcagtttctacgggactgctcgtacgctaggttagcaatacgccgtagtcgagactttttatttcagcagtattcacgagttgttgttaatcgacgtgaccgtttgagcaaggtaagcgttaactcgatgctgaccgacggtagccagggaaacgtgcacgaagaggttgcgacctgatcgccatagtgcccagagggagagctgagcttcggtttgatttgacattgcacataggttatatgactggagcatgagcctctgacatgaaatactgggacacgcaaatcaggcgtaggtcagatttcgcggtgcgaaagctcgcacgtgttctgataccttcaaccgtgtggacgacaggagaagtcccgattccgcagacgaatggactgcacttgcaaagattagagcaagcgatcggaaaattttactctttctggtgttgtgcgaaacgtgaagtctcaatgtgacattatatttcgctgtatccaagataaccacggaagttgatgtcatagctgcagtttaaggatgcttcttgaagctgaagctcgctggtcctgcccgaaatgtatggatttgccgactcgaggtcgacgcgtgtccgtatgcgggagaatccgcagaacaagaccgcagcactcggcactgcaaaatcagtcaaccgataccactcgagaatcgctccgacctgatgaatttctcactagcgtgctctggcgatctgccgaatacgcttctggtatattccgaccaactatgtcgattggcgtttcgggcacgctggattggagttggcgtgcgtttgatagccacatttcaagtttagtggttcatattcgttttgctttgtggcagcgcgcttttttaacagcatctgtttccactgaggcacaagatgaagctcagccgctccagaatatcgcccgctcaaccaaccagtacattgtactggggtcatgtttgtgtagtggcgagtgtctgcgaagaatgagcctgttctgtggcctgctagagtgcgatttgtagctaccggactatcaaaaaaacaatagcgaggctcgcagcaaatgctgactactgagaagtgatatgttgctccgttccagttcagatacgctcagaagaactagggacgaggctttcttcgtctagtttgtggaatttgctagaaggatgtgggcatccaagaaggtaacattgttcattggaaagattcctgatggtggaacggtggtgaaagctcctgggacgtctagcccgaaacgtcgaacggaacggttgacacagttctttgttgtggtgtgaaagggtttcggaaaagctctggcggcgaaacgaagactaggaagaaagttgcagtgtttcggactttcagcgccagtacgatatccaagtatttctcaggattcgaaatgtgaaagtcacctcaccacttgttaacacgacaacgacgacagcggagcttctgttccagcgtagctgagacaacagtagctttggtcaaaagcctcttccatatatgcttccagagcataaacgcaaactgttcgcttgaaggatgtcctttacccgggaacctgtttggtgtttgttttcttcagcctttgatgtagtgcaccctgctgtgcgttgtggcaccgcataaacagcgttcgctttcgctcgttgatctttgagacgccgtgaaacca

SEQ ID NO: 3302 - DNA, 3580 bp, Toxoplasma gondii
cagatgtttctgttatctgaccgccgtagagtcgttccaactttggagataggaagagtgatctgtcgtgacgaagtttcaatgatggaaagtggtggggtttctatcgagtaggcacaactggcgagattgtcccacttgcgttcgtcttttgtctcgatgactctgtgattaatcactcgtggcaagggaggaaagaaccagacactacgcagctagcctgtacagtgtctgcggtggccatcatgaaacgaaggcagtaaacatcgttaaaaaccacaactctttttactgtggctccctcgcatcggcagctgaacactgctcttgtaacaatactacgaatcttttgtcgatcacgcaagcggatttacgactaagcggtgagcgagaagcttcgctacctcgggggaaacatgtgctgctcatacactccaggatggaaaattggagagaaactgcagcaaacgcgtcagtgtagagcgcagaaagctctcttagctcgaatgtgtgacgtccttatgacgaaccccacgagaaaacgcgagcatgttcttgagtggaaatcgtgatatccgtgaatgtgtgccgaccttgttcgccgcgaaccgctttgcacatctgttggaaacttccgcgcgaactgctccggcaatggcagcacgaattcggtgcttggcagcctcacgtgtcactctcgtatggccaagacgaaagcgacagaaagcttccaaatttcccagagtgaaaacccaccacggtgtgtggactcgtatgcagacaaggactggacaattgcggtctgtaggccgcactacaaggtgggcgttgccatccgacgtctcgattcacgtgatacgttcgcaaaatcttgattgtatcaagtgtggagcgcatcggtgactctacagaacgtagtccctgctgagaatctggagcagctcttgccctgttcgagatcacttgtgtcatgtgtatccgtttaggttttctgaccaggttccggtgtcccgtttctttcctgagttttcttttcacgtgaaggcaacggcagcaacacgcagattctcgaggactcgatccatcacagggtgactgtggtagtagcaattgatgcacttgagttgttctgctctagagcagtggcgactttcgctgcatttttagcgtctacgcacggccacaaagttccctgtttaggtgcttggattctgcttcgtatcgccgcagttttctgtagaaagtatccatccagagactgaacgtcataaatggacccgtgttttccgtacagacgagcacaaggaaggcgacataaaccaaagtgaacattttgatggtcatgcagctcgtgtacaactggtttctgctccgcgatacgtcaccactgcatatatttccgtgtcgtcagggtcaccgcctcgtgaaatgaacactttttcgcgcgaaagttatacaaccaagaaaggcagacgcgaaaacggcgtttgttatttgaagcttcgtttaaatcctcttgtttcacaggagatcacaactgaagggagagaggaaaacagtagctggcagctacgtcccttgatttggcagctgcgaacccaccaaaacagatggtgacccagagagcatttccgattgcaaatccacgccttgtgtagttcaaaaataatctcttactagcaaaataattcatccagcacaacgtacgcaaagggctgttccgggaattgaacccgggacctctcgcacccaaagcgagaatcataccactagactaaacagcctgggagtcactctcagtctcttgacagtgtcacttccctaggcgcctgctaagagaactcaatatgcgtcagggaacgttacttttccagtatttctacgtccctgtttaacagactcctttcctgcacctctgaaaacgagacaggcgcctgagtctccgtattttcgccagcaaacgcaccctctgtatcaatggagagggattgcaggtttttcggctgaagctccatagaacgctgggttccccacctctaaaaagctacggattttgatctcagccgattcgtgcggcgtcaaaactcttttcctacccgaggattcgcgggccagtcgcttgttcccacctctcgatctgtgattcccgcgaggtgtttccctccctaaagagttccctgttggcgcgaacctaagccctcgtgtgtggtaacaggaattcatccattacgcctgggatatgcaacaccgctcagaaaacacccaaaaaagctagactcttcctgtcgtacttgaaacagcgtacaaacaccctgtgtacagcaaataaagcatgctgcgtgggagagttgctgcacccatcatagcaggacgcgagtgaatcctcagaggaactcgctgaggcttttggattgcccggtcgccatgtccctgacagttccgaagcactaagaaccgagacagctttcttctcgacctcgtggaacactaggtgtttcagatcgcactctctcagggacacacggaagtgattttcagatggagctacctgtgccaacgcttctcacgcaactcaatttacagaacctccatacgtttttcttccgcataaagtaccccgcagaaaagttctgtatacttgacttgcatgtgtgcgtggcacttgatgcatttgtcgatccatcgtcacgagtgcgattctcgctctaaatccaaaatagaacgggtctcgacttccgtgttggcgcctccaccaaccctcgcgattcttgccgagtctgcagcggaaaagttcgcagcgaaccggggtaggaaaaacaggagagaaccggacggcgctggtgtaaaaacgatccgcttctgtgtgttttgaagccttatgtttacctgcgtgaatcctctcggagagtctacgtcccatttctgccagaattgaagacgcacttcgtcctcgctttctgtctcctcccagagtatcaaactttcgtttttcgagacactcagttcgccaaaacatcagtcctccgcctctgcatgtttctggagaactttttccggggattgccacggcagcagaaggtgttgtggcactgcatgcatggatacggctgtcctttggagttttccttcgccctggccgttttttccggtggcttttcgctgttttcgctcgagcttctcccttccaatgcgtcgcagagagaaactcggaagaactcgctcattctctcgtgtacgtcgccgtcgagcgcgcgcctctcgtgatttacccggcggccaccgtccataattgcaaaaatggagcggctgtgtttccgtctcctctgaaatccttttcattcccttgcacagagaagctctcttcttctgctgccatttctctgcaccttgattctcgacggcaaccaccagcagcaacgtgtaggggttgtccttttgtgtgcacacaagccttttcgccgcaggtttaccgcggctttcttctgggaggggaggtctctcttttccctctgctcgagtttttcttctaagaggttgaaggaggaagaaggtgcacaggcaagctccgaatcccgcaaaa

SEQ ID NO: 3303 - DNA, 1357 bp, Toxoplasma gondii
ttccgcggacatggcgattcgtgcaatccctttccggtgttcgactcgacaccccctctgtgggggaaacatactgtcaaggagcaccacacaccttgacgtttctacagaggcgttgttcgacttttattaagagacaccgaaaatagactgaatctttgcagtcgcttgcaactattcaggacgtgcgagttccgtcgaaacaaagtggaagagcctttctggcatttgaaggttgttctgaatataccagattcacacttttctgactaaaatgcgagatttacaattctgaggtctgcctagatgtctggcgtactcccaggttcagctcatgcaaaaggtatccccgttctttttgacaggtagcgcggcgtggaactacagaagtaggatatttcttttcagtctcagcagcgaaaccgatttcttctcgcactctaaatgctgaacagcaagactccgccctcgaccgtgccctgtgtttcgaacactgtctccgtttattcggttggagtttcacagttctggatcgcgcatcacactgaaagtagatgttgtatactcaaacctgatttggctttgaaacctggggatatggctaaacaccggaactcctcgcttgactttgtactgcggtcctcactgattaagggcgaatcgaaaaaaagcctcacatttgaaagtccctattcatttctgacacctggccaatctcaatcatgttcagtgatcgcctccccccctccttaactaggagtgaccattcactctcactgaggattcctaggatccttggcagcatgccctgcatcgagactgggtccttttggaaaccaagcagtgaaaaaatattttaacaggaaggggaagaagcatatacagtgggtgccctgttgacttgagatgcgcagttgttgcacagctcatcacccaggcacgacagccgaatttgccgctggtcgtcacagaaatgagaacttgcagagttgcaggtgtgtgcatcttgtttcttagaaacatgtttttctatcattgtccgtgtttcatgtgaaaaagcgtggtttcgtgtgtcgccgtagcgagttcacaaagatgtgcatgcgcatgcagtgactcgccgtcttctgcactaagaactaaccgggggttcacaaaatcttcattcctgcgtcacagcgcccttcgcctctgtcgtacattccttttcacacctaaagcgacgcattcctttggactgaaatcccccagcagatttttcgccagtcttatccggagcttcttgcgcacagtcgcctgttgcccgtccagagcacccggaggagcgcgttttgttctcgagttcctcaaggcaaaa

SEQ ID NO: 3304 - DNA, 4666 bp, Toxoplasma gondii
atgcccattttgtggaacgcttagtaatttgagtcgacccggtagacgcgccacctcgaagatgactccaccaatgaccatgacagttgcgatacggtctctgcagagaagggctggaaccgcttgaaccgagagtggctccaaggaaccctccgtgcgtttcaggaatgtttcgaatccagagaaagcaaaccaggactactaaatgaaacagcactccaccggcataaaccctttgaggtccaatcattctacggacgacgttttgggatctcaatggcggaatcagctacgaagggcgcagagtcgcaaccgcgcacctggtatgacaacccaaaaacgggcatggccacttgattttcacttgaacggaaaccactacagaatctgaaactggttatatttttggaacaggatggccagactgaccgtgtgagggtcggttcaaatattctgtccagatgcacaacaccaccgacactatggagtgaagaagtctcgcttcttgcgtatgtcaagaagtataaattcacagcgttctctcaggatggggcacaagggtgtgatcagccaaaaattgccttgtataaaaaagggggtttttctggagctatcgaagggcgagagaccctaacgtcatcccgcagttcgaacgcaaacgcaggcggacgaaagagcggctgcgaaacagatgatgtgaaggagcaccacgaaaacaaacacttgctgcggtcttttgctgcaacacggccttcttcaattactggattctgacgaacttgcagcagatcgttgttggtggtttcgattattttggccaacggaccgtttccgcaccgtgtgtagttgtcgtgcagaccagttgacgacctcgagcatgttcttagaagagaggaaactcactgacacttcactcgcctttaatttcatcgaagaaaacagagcctcaatcaagaagcggcgtcaccggggggtcactccctcagacaagtgcacgggcgacatatgtctcttcgcacacgctgaagtaaggctgtgtaaagaaaaaagcccgagaggcgactgactgggacgtgcgccttcctggtgtttccagaattctggaagctgcgttctgtaaaatcaaccactatttgacatttatattcttttctactagcgagcagcccggtctccgcagaccattgaatgttgctgggaagaaactcgaaaggtcgtccgcatcttccttggttgcagacgttcggctaacgaaatactgtctgcagccagtaacacgatgagatggtcatgaataatacagtgaattgtccagagaattatcaaaagagcatggttcccggaggatgtgaaagtctctccatgtctgtcacctgtggctgcgtgcatgcgggtgacatctctgacgagcgcatgctggtgtgcgtacagtcgctggtatgatcagtctttctaagttaccctgtcaccatttcccctgcatcctatccagctactggttcctcttgaagtaaaaacactacatactatctggctcttttgttccgcttgaccatggccctgcacggagagcagaagtgtgaatcaaaactcacacgcaactccatcgttacctctgtgtatagttcggccgggtgaaacgttcatacgcagtagttcgcagtagttttcggaacttattcctgttagcaaccagcccaaacacacgggacgagagcacatatcccattgctgtgacccggaatactttcgccaattggctgggcaagcgaggggtgaaggagagtgcttgaagtgagagaataattcccgcttcaaaccaggaacttgtaacgcctcagacgagcagcgtccgagacgtgtgcaatcgatgcttcgtggaccaatctgacagggaaccatgacatctagtctgcaggcaaacacggatgcgtggccgttcgctgaccttccacggtcagcaaaacaggcacgactcccttgcaccgttttcttgcacctgcgcctgatgtcccccaaccccccctcctccaatgaatggaccacgagacacaaacttggctgtattctgaagccgttttatttaggcttttgctgttccagtcgggctgtttccgcaacgcggcactggagggcctgcatggcttgccaacagaaaacgaccgatacaacctgtacacccaaatttaagacgaagtatggatccaacaacaacaaatatgagttgtggtgttttttttggttagtgaaatccacaacagaagtagaccgccgacaattctcgaggcaaacagcgactaaaacgtaagggcagtccataaaacggaaagagatagaccccccgaagcgtacagtgatcccctcaatgcttccagacttgggcatctcagcagcgagatgtggtatctctcgccatgttaccaggagaggtaggcatgggcccatgctgatttgcaagggaagaagccagtggtgaaaaagacgtgcaattccagcaaacgcgtctggcacggcgaaaactgtaactctcacgcaggtcacggagagctgggaaggagcattgaacagtctctctagaatcagcgctacagacagtgcgtgttgcaaagcgttgaggcgacgctttattttgatagaaatgcgaatctggactgcataatagccgcatgaggccaaaggcatatattgatgagaccgagtcggcggttcattttcatgaatgacagagaagggtttaccagaaaaccacacaacgcacgtgacagtgaacactattagggccccatatactgtggtatgcgtggctgatcacaaagtgtgttttctgccacacaccaaaaaaccgaaatgaagttggccctggtctggaatgctatgttcaccggcagaaagtgttgccagtagaagagccgaaatgaatcccatgttgttccaaatggctttggtcgatcagcgcgcgaaaccccctagtacaatggagctttttctatcggtaggcgtcgtatgacagcagcaattttcaatccttttatcgcgtccacggtttctacgggtcagcatttgtatactgggacatttttcctgtcgtaggtaacaactatcaaggatttggagctaggatcacttgtcaagtccagtccgtctactgcgaccgaggtgggtctcggagggaccccccccagttttggggctgcacgtacggccgttccagccggtagttgagaggccaattctgcgatccagtgttgattcagcgtgtccgtcagcgtatgcaactccgtttctgaaacatatttttctctctgacgaaggaaggaagaaactctagtcacatgccgagtaaggccggctcatgcattttctagtccctctgtagaagccttctacacgtccctcggcttcgctcagggtgcgtcacacactgtgttcctgttgacgccctcatggtgccccgttaataagtcaggaacaaccaacaggagatttgctgacgtagctgtccacagtcgcgagacctccacatgaggcacaccatgactcgcatctggcaccagcgaattagagaagcgccgaagaggaaaaacacttccgctcttcctttgtctcccgaaccctggctctactgtgggcaactcacgtttagtcaattgctgcacctgctgttgcgcgtgtcttcttgttagccaatacttacaccaaggtcaacgtaaaaccgcacgtggatggaagtttttcaacacgaggtgttgctcacttaatatagcgtcgtacatggtcacagcacccgcgttgagaacgcaaactgttaccgaccatattgtggactcttctcactctgaaaggtgacaacagaggccgaccaaacacatctgtaacgtggtaatagcgctgtgaagacgcccgtttgcggagtcttaaactgctgcgaagcatcaactgcaaatgacatggaagctctttgcagtaacctgaaattgtcaggacctccgtcggcttgtgcagcgggatacatcggtggaagatggagcgctataagcggatcaagcggttaggcgcgggagctcaaggctattgctacttggttcgggacaagaaaacaggtccgatatagaaaagcaaccttgatgccaggttgcattcctggagaaggatgcatttctcgttcagatgacgttagttgacggacagggagtcactgtgaccttttctctgagaccagagtcaatgtcagcccttagttttcccgcttagttttcccggcaccctagttgttgtcaggcagaagaggagttacgtcatccttttgtacctgtatgtggaaactagccgcgtttcggtatgctgaaagagggttggtggcgaagaacttccgcaagccattgaacgtagaagtggcgtttgcttacacgtttttcaaccacagttgagtgcatcggttccatgcggagaagcatcttcaagcgggagctcttgtttcaaacaaatgcctcctgagagcacccacccgttcaccaactgactgtcgaaatttctgtcgtctgcgaacgttaacctgtactagtcgcacctgggtgacacacaatccactgatgttcttgttagtgtaacatgtgccttatatgcgtttaagggaaactgtatgtgagcaaagacatcggtctctcca

SEQ ID NO: 3305 - DNA, 1011 bp, Toxoplasma gondii
gggcagtactgcaagctgaaaaacatccgttcagcccgtcgattcagctctgtgctgtcgatctagagagttgtttgtgtagacagacttgttgatcggtgtgacggtctgccatatgcccgcctccacactgtataagcggcaccaaactcggacgtcttcccacagagcacatggtaattgctgccatcgtggaattagctcactcactggttctagctctccgccccccaaaagtgaaatggatgtgagcgttcaagggcagcattcgagcttcaagatcccgtgccgctcgctcgtctgcgcaccgggtctccagtggctgtccaacgtgttcgagaccttccacctacttctattcgtgctcccttaggcgttacaagagtttccgtgttgctaccatgagacacttcacctcttcgcatcgcctggcatatgcagaagccacacactaatcatcactggctgcacgtggttccggcggccgccccatcaccgcaaccggcttccgtagaagactatcccgcaacaacggctaatcttcgagaatctgtttggcattaggaatgcactgtctcataaatctccttccacaatacaaaatatctgcctattttgggcgggcaaatgtggaaatcctaaaaaaatcaagaacggccgcgtggcatgtggggcagcacggatctggagcggggcacttgtagccccaaattgcaactctgtgtcccagggatccgaggcctcccttcaaaagaacttgtagaccaagtgacgcacaatcacacagtaccaattaaccttttttcagctcagaagtagtaggggaacaggaaatctcgcagttccagactctgcagaaaggccgttcgttgtagagccgctcccctctccactgtagtgtgtccgatccacagccaagtcgggtttcacgccccgttctccaggttcgttattgcgtctagaaaataatgagaagagttaagctgttcttccctgactaatatctcgtga

SEQ ID NO: 3306 - DNA, 2767 bp, Toxoplasma gondii
aaacggtgcacgatttggagagcggttgagtgtgtacgttcttgaatcacgttagctccttcgcgcagttggtggggcaattcgtatatgttcgctgcgcatgcacgacgcacccaaaaagcgttgtgtcgcatgcaacggctgtggcgcaacttacacagatcccccgaaaaggcagacgtcagcaaagagccccctacaaggacgccgcaatgcgtgaacggaggaactcgaggtcacccacgaccgacccggcagcaaaacagaagacgcattcaaacacagaaagcgatactttgtcagacatgtatgcatccatatatagaaaatatatatatatatatatatatacgaacaggtgcggcaccctgcagcacatgcatatatatatatatatatatatatagtataggaggtagtggatttgcgacccttcgacctactcgccagtttgtctgccatttcaaaggcggtgacggagacgttttggagatccgtcttcgcctcctccgaagaatgcgcttctcctgccgccgcaacgacttcaggtctgcaacctgggaggtaagcagccgagtacagaggatttccgagggtttgcggccctgcggagacgcggtcggaggcggatatcgagggacgcgacgagcgagcctcgctctgagagtagaagctctcgttttctccgggcttcgcgagcttctcgccggcgacgggggcgtccaagtacgcgctggcgaatccagccgagtcgggagcgctcacggcagcagccatggtggaggcagagaagaagaaacggagaagacgcggagaaacacggcggaaaatatggcaggcgcagaggcttgtgcggagcaaacgaccggaagcgatgcggggcgacctcccaggtgtacgtacaccggagacttcgtggcacaggggagtcgaagtatttcgcgcagcggtcagaattgtggtgttccactcgaaacgacggagagagagtttgcgtgcagagttgttactttctttcgaggcatccccaactcgtgggcttcgcgaaaatgacacttgtcctaggattgtggacggagtcaccgtttcgttgcaccaccgaaccgaagcgtgtgcaaaagaaacggagcaggggatttcctcccgctttcgccggccgtcgtcgcgcttctttctcgagctgacaagcgaggaacgaacgttgcgttcctctcgaaactccgcaaattcaaacccgaagttgcttcgggattctgtttggcgttactcagtgaattttcctcgcaaaggcgtcgacagacacgcgtccgctcgcacacgcctccctgtttctcgacgaaaactgacaagttttccaggtttgactcggattttcgccggatgaatcgcggcggcggactcgaaccacgcagcccggcgttggaattttccagtcaggttcgactgccggacgcaggcagtcaccgccgtgtgctgcgactgagtgactgagattcttcagggagcagggccgcagtcggaaacgaagagtggagaagcggactttccagtatgggcgtttgcttaaaggtcttgaaatggagagacgcagagcacccacgcgcagatcccggccccgcaggacgccaggttatcggagaatgcaggtgcagaggccccgcggtcatctgcacccttgagcgcccgtccactcgggcaagagaaagagcagcagcgcgagcgaggggagagaaaagccgagaggggggcgtcgaggggaagaatgcgagctgtctctggcaaagaaggaaggccagaccagcttcccgcgacatatggctgctagagagaagagccgaaggtaaagccacgcatttggggcgcaggtctgcgagcaaagcgaggtctggtggcatttgtttgtctttgtctcggcggaggtttgggggttttatagccttcattgtctggcttaaccttccttcttttcgacgaatgcgcgggagtcataaggaacgtgtgagaccgtgttcgttgcgaagtggaaggttagcgagtgaagaggggaaagagaggtcggtgttcctagaaaaaacgacggactgtgtgtctttcgatcctgaagctttcggtagttcgaaaacctatgagaggcgtcagaagagtcaaatctgtgtcgatggacgagctcaggaggcacgattcgcgccgttgacactcgggcggaacagcagacacaaaaaacgcgatggcttgttgctttttctgcagaaccgcagatccccttcgtctcacagcgtcggtgctcctgcagcgcaccggctctcgtcctctcttgcccctgtacaggaagagaagagttcgcacatgttcgtccaagttgcagccggagtagctccttcaggttctcttttcctctttcttcacaagttcctccacttgtctttgtcccttgccacatgctcccctcctggttgttcaagtcgaggggaacgcacatcgtctcaacgcatcaaagctacacatacgcatgtatgcgtgcttctctctagcattccacaaaaacgtatgtgtagtgttgttcagttggtgaatgtttgtgccggagagcgaggaagactgagtcgtgttggcccttctctcctcgttgggtttctcccacaggacgcttgttgaaccccagggtgttttttttttcgacggttgtctctctttactgatttccttcttttctccttttccctctcttcctcttctgctcttttgcttgaccaactgcttttcaaaa

SEQ ID NO: 3307 - DNA, 2430 bp, Toxoplasma gondii
aatatcgactgacagttggaagagaaacagtaacgtctccgcagtccagtctgattcctgccttttggtcacgcactggcagagagaggcaagcatccaccaccaccacaaatgatcgtgaatcgtgtaaacatacatatatatatatatatgaataaatatatatatatatatttgtacgtatgcatgcatgagtatcagcatgtatgtatgtatgtatgtatatctatggatgcgagtgtacgaatagatgcattgttctgtctggaaaagctgaacttacacatcgcacgcatttcttcgaatctgcgaccatcgtgtctctcgcgtttgtttgcagcttccgtcaaccgttcgcgcgagttgggcgactcataagggaggacgggaagactggagctgcttccttggaggagtgaagcatttgtcagtgcgctcaagctgcggccggagagacacatcgcggcgaagagactccgaaacgcatgcagttgctctcagacctagcagaagggtaggcaggagagatagcgagaaagagaaggaaggagggagagagaaaagaacgccaggaaagaaggacggaaaagctacgacgactaaaacgctggagaaaggaaacacccgcaaacagcgcgagagccaactggggaaacggaagcaggggagactgtcagcagaagagagagaggacaggtctagcgttctctgaaagaagatggtgcacagacgttttgcgagagtggacaaaggatgcgcttgcgcatctgcggtgggagaaaagcctcgacgcgacaccgggacggagacactgcagagtagaccgcggagagacagcaacgaagcggaagaggacgcaccgtcggcagcggcaagcaagatgaggcagacgagatgaaaaaagaggagagaaccgcatttcaacgctacaactttccagaggaagaagacgcgcaggtgagtcgaggaaaaagcagcggaaaaagcagcggggaggcgagaggcggagaaaagcagaggggtcccggagaggcggaacaacggtgctcgcagaacgaggcgacggaaattaaagacaaattcagagaggaacaacagtcggcgcgctctgcgctttctggtgagctggagagtgtgtgagtacggcgcagcgacgttgaaaagcagagtcggcagctattcagacgataaagacgattatccctggcgcagtctctgtcctaaggctggcagtggggttctagatgggggactttgaaaagcgaacaccaaaggaaagaggccgttttgctctagaaacgaatgaaaagtctggagactggaatctggacgcaaagtcaaagatcgcaaagatcgagacagcgtgagagaacacggttaaacttgactgcgtctgcgctgagagctgctctttcctgtgaggtcggcgcgatgggaatgctaggttggcgagggtgtgtttgagcctgggtggacgaatacttgcccgatagggacggtcgagaggactcccttttgcaaaaaaggtcgagacgtgatccgtttcgacgcctctgacgcccacagctgaacttttcacacttttagcgcgcgaacaactttcgcaggaacgtcggaaacggccgagctgcccacgggtcgggcccgtactgcgccggtctgcggtgactggcggggtttgaagaccaagcccaacagagaggcgcacagcgcgccgcgtggatttctgcgacgcggcaaagtcttcacggagaggagaagactttgtgccgcggtaatgcgcgccactcggcgagtgtacggaaattttcgaaaatcagcagaggttggcttttctgaggactgaggcacagacacaaccgcacccagcccgccttgtgtcccgcgcgccaggctcggtcgcattgagacctcgtgtttttcgcgttgggactttgcaggtgatttcctccggccagcaacgatttccatgcctttcgtccggttctgagaagcgtcgctttgcggaaacgtcgtttcttctccgtccggtgcacgcgaacaacgtggctggtcacgttctagatctaaaacatgcctcgtagcctcactaccaagcaggggaggcggggacggagaacaagattggaatcagtgcggagactgccaagggtttcgccgagaagctgccgtttgtatttgcgactttgatcccggtagtttcgatcctccaagagaagacagacagcgaatctggagcagttttcaatggctggggctgcccgcgccagcgttctttttcccaggaggcacgcggtttgctggccagtcgactaggcagtcgctctgccagcgccgaccacagggaactcgactttttgcagagttcgaccggcggaactcttactcgccaggaccgaactgactctgctcctctcaagcggagcatta

SEQ ID NO: 3308 - DNA, 1358 bp, Toxoplasma gondii
tttcttcgacccactctgaatcgctgcaaacgtcatgtagcagttcacggagatcgtcaggacgaggacgagcaggggcagcagcagctgccactcaagtgcgaccagcatgtcgtctgcccacgcgtagccttctccgacggagaaaacgttttcgcctttgtagcaaatcgcttcgttgcatgcgacgctgtcgcgcacacgggaaaacgtgaagaggccgacgccgagaagcgcgacggcgcagaccagccggaatgtcaaggcgaagtgcagcggcagggagctccgtggcgggcgactcttttggcgtctcccgtactccgcgagctctccagaaaccattcgccgagaaaatgaaacggtgtatcgcgtggagtcaccggcctgcggcttcagaggagaggctgtccggtcgacctcgaatgccgcaggtcccgtttgtcgtctggaagaccgagatccgttcgtcacgcgacttgctgcaggcaactgcggctcccaccgagtcgcaggtctctccaactcgtccacagggccccaactaacgctgatcggcgcatcgaaagcctccccagccatccctatctcgtcgctcccagtcgcagagagatctctagtcgaccccggcatctccaggtggacctcctcaccttcgccgtcgatgccactcagtaaccgccccccagaagtcgctccggacggcgcatgcgaccgcgcctcgtcctcccgggtcgacgcgggcgcaacctgtccagagatggaagtctgccgagaggcaactccctcaactgtgtcccgtcgctgcaaatgagacccggaagctcctcgctcgaaagatgacgtctggtttccaagagacatttccagcagtgaagaaactggcaggtctaaagaagcggctgggacatccgacgccgctctcgtgtaagaaccagctccgacataagacggattggcatctgaaaaagcttggatatctgaagacttatgggcatctgaaaaaacttggatatctgaagacggataggcatctgaagctgagccctcttcagcatccagtgtcacctcgcaggctcgggggtctgaggatggcgacgccgaaagcggtggctcctgcccccgctccggcaagaagtcggggatgatttcaatactcacggaggatgtgtcactcatcttggcgcagtctggaaaacagcagcttcgcaggaacgagggaagtgcagcgccagtgtcgaaccacgcacggaatctctaggattcaagtccgcgcaagtggggaaaccaactttggcacaccccccagaaaacgcgtgcgacgctgctggttgcgacgtcacccgcagtcccctgca

SEQ ID NO: 3309 - DNA, 2034 bp, Toxoplasma gondii
tcgactcgcaggttgtttgactgtcgaatgttcctcccgagcagccggggcgagctgtctcttcgtctgccggttaccgcgctccgaggaagcagacactcgcgacggatgccgcatccgtgtctcatcacttgacggagatgagaaggcgaggaagacctcgtctgcgcaaagtgcatgtccgccgagctgatgaaggtggcagctgtgggaaggagaagtgagaggaagtacggcactcggtgagacgtccgaactcgaggtgaacgccgccccatgcagcgacgcattttttgactcgagtggactaaaaggcgtacgacaccgcaagtgcagttgccacatacacggcccagcacccccatcccgctgttccttctttaactcgatgttgaacgccagcaaatgcacaagatgcttctgacgcttatctaaacggcagagattttgacaacttttccccgcggcctggaaagtggacaaatcgtgcgtaagtgtgagttacaaactctggccctactttgccatcgtccgagtattcctccactgatgctggtgacggagcgctcgcctcgtcacgagtgtgcaggggaaaagcaatgctccgtccgagaccagcaaacaggggcgctgtcgccccgcttgcatttttgtgttgtctcacgagcaagtggtgactggaagctttcgcatctcaactgagaaagtatgtgcgtcagggcgtcttttctgaagtgaactttccaggagaagtggaggaccggacttgcaggcaatagttccggcccgtgactattcaaacagggggatgagctacactttcgacatctgtctacggattcttttagactgcattcaacgctttagtaaactggaaggttgtgcgctcttcctcccgggccgacggttcgacctgtcgaaggcggattcgaaaagaaacatgggggaatgctaagtctttaattatggcagtcaccggcgtggtgcccgctgcaggtcgcccagtgactcacttgggagtccgcagcaaacgacagaaacttgtgtcggggctttcagtccagtttcctttccgatacgcgtgaacgcgtcaggtttttcgtttcgtgcgagtctgtgtgctcaggactgctttcccgacgccccgttaaagtcgtcggcaaagacgtaggtcacatggacggtcgttgccgagcgtcgaagtgactcgagaacgcgagaaaccatcctgccgatgaggacagaaaactgctggagaagccacgccttcttcgctggcgggtcgactctgagcagccaagccagtcgagaactcttccgtggaaaacctccaaacggagttcgctgcggaacgatgtgcttgtttctgcctcttcggaaacacacgcagagttccacttctttcgctgtgaagacgaaagtaccaagagcgacgtggcgcttcgaactaaaatatggccaggtttcccagctcaattaaaacgtcgctgaaggaaatagcaagaacctcctcaaaaaccacgcactctcggtgcatgcagacaaagagcttggcgtagcctcagaaaccggaaagctcccaacatccgtgacgtctccgcgcctctctcactggaaattagacttcgaggtgacatttgagtcgcgtttctcaaagccttcttcggcgtcatgttgctgttttcgcgaacagctgtccgccgtttcgagtcgtctcttctggaaccgagcaaagcgcatgcgtcagctgctcgtcgctcttttcccggtcccgtctgcctttcctcaacttctcgcaaatgtgcagttccgcaacgccgagaagaaatgagcaaagcgaactcgtcgggtctcctccgctctgccagtggacgttttcttctcgaggtcttcttctgtcttaggaagccggaccctgccaaggtgtcagcgcagcttcccaaaagcgtccgagcgcaaggagacaaggcggcactttttcttccgcgaaaaacgagagacacagaccctaaagaatccgaaacgcagcacaga

SEQ ID NO: 3310 - DNA, 3004 bp, Toxoplasma gondii
gtggagaggaaaaggtccaggctggtgaactccagcttgtctttctgaagcatgcagacagagtaggtcttgccctcttggatcacctggacgtaggtgcggcccccatccttgggctggggcatgcaaacctgaagtacaaggcaaaacatgttcacacggaatacgcatgcaacaacttgagaattattaatgatacgtatcgaaaaaaatcagaaaggaaaactcataaacgctgtttcggcttcgcgaaattccaccgtttgtttccttgtcttagtttggaagaccctctcgccttgcctccatcaattctgtgcctacagagtcacgagtcttctgatctcaaaggcttttgtggcgttcgaaaaatctcggctacggtctggttcggatgaaatttgaaaaaccacattcttgtagaggtgacgtgactccagctgaagcccgagaatcgcacagcgcttttgatacaccgcaagcccacagaaaaaattctggaatccgatcgcacctgacataagacccagatatcctgctgttttatcagcaacaggacttccttgagcacaagtatggacgggcaagtgaagtatcaccgtctgcccatgcagagatcaggtgtcgaaagcgttaacagtgcgggagatcgcgtgattttcgatactccgctaacacagtagaactcgcgtccggtaaacaaaaaccttcaagaactaaacccatgatccaactcgtcgcaaaatgcagatgaatgcggagtgcacggagaacagggcagctccactttctgagctgaggctcttcagtacttcaccgttgttgtacctgagacaagtgaagaacctcgccgccatcttcaggggagagagtgacggtctggccaggcttgacaacgacacctgaagagcagacaggaaagcatcagaagggtgtgatgagggcatgcttccaccggtcaagctgaagacagggcgcgaccggtgtctaggagcatcagctaaaggtaaaccggtgcctggttgcccacggaaaggtatgtccgtaaaatgtgcagtgactggacttttactcccgtgacaccgcgacgaaagcccggcacaagcgatctccggaaactacggcccttggccgcgttcgcctgtggcccattgacgcggtgccgcgttcgcctgggtcttgtgcggcgagcagggcggcaaaagccgcagagacttggaggatagtggtcagaaagacgggaaagggtaggagacaactcaaaagacagagtaagcagaaagggcgccgcgtttctctggcgaacctgccgcgtaaagcgccgccccacagcgaccccgccgactcgggtgctgccatcccgagacaacagataaggaaacgcgggcttttctccgccgtactcggccgtgactcaccgtagaacatcttggaggggagatatgggagagcagaggaaaggcggactcgatctcggaaaagcaaaagaagtacgcgaccttacaaagaaaatcggcgacgcaccagttttgagccgccgcaggaacactcggacgcccgcgcacggtggatgctcagcccaacatcggggtccaggggggccgagtcttttcacgcgctgacggcgccgagtgctcgaaaaggttgctggtccgcggatggactttccagccgcggcgccttcgtctcgtttgctgagagaccggactgtgagacaaacgcccgctgtctgagacgccggagcaatccgcgtttcgttgaagtttctcggccgccgcgccgagagaagtgccacacctgcggctgtgcaggaggacgcactttggcccggagcatcgcggatttccgagaatctcggcgcctccggttctctctgtcggggtagcatcgactcccacccaccaggagacggcgaaaagaactctttcccggtatcgtgcaaccagcgcagggccagcgaagctggctcccatcgcttgctgtttctgcagttggcggatacgcggattcagaaagacagtcaaaaacactggaacttcagagcaagaaagtgtccttgggacggaaaacgcacccttccacagcagctagaaaagaggcacaactactaggacggggacacgaaccccggtagacagcagatattaagccatctcggcccgcggttcttttttaacccctcccgacacgatagagagagacatggtttctccaataaaagcccttctcgtgcaccctttacttcaaccttcctcacttctttctgcacaaagatatctcgtattccaagcagaaggctcaaagggagcaactccccggtccacactcgcgttgctctcacccccctggcgtcgagcttcgcctgggcactaccgaaatcgcgactatccggttcgccttcgcattttccaaacgtcaacttgctacggatttctcttgtttccacctcccatttaattaatcgtctctgtttctgcatcgtcctcactccgtgtttcctcttccccgtttcgctccctggtttccgtgtcttctagcacacctctccagcgcgccctgtctcctgtgtgtctcctctccctgacgtcgaccgtacaaacacaccgttcgcttgcggaccccttcgcttctacctcttctcgcccccgttcctctcgtcttctctcccttctcagtctcgttccccttttcacccttcgtttttctttatccccctctcgcctggtgtctgcgccggccgcacggagcgccctttgtctcttgatcacccgttgatccttccgcgttccgtcttgcatgtgactcgaattctcttctctctccctttccgcctcgccgtgcattttccgctccctttatgagtcgcaactgtggttgccgtcgcgaatgcggttcctgtatcctggggtttctgccgacggcgagaaacagctacgcgaggcaggagggaggagacaaaacagaaactgttaatatcggttctccacgagcaagaacacagcca

SEQ ID NO: 3311 - DNA, 4374 bp, Toxoplasma gondii
atatgaatgtacatatgacagcgttccagcgtttgtggtttacctggcttcctgcactttgcagatgagttcttccgttgctggatttacatcgtcgaagaagttgccgctggttgcctcgacaaatttgccgttgatgaagaggcgggtttcgatgtcttctggtttgactgtcactgaagagacaacggaattccacggcacacgtacgtgtcacgacgagagagagggggagaaagcagtgaaaaacagtggttgacagagcgaagaaaatgtcgaaacgcaataagaacgtcatgtgccccatttgctgcgagctacgacgctgaatatggcttctgtcagcagcttgagacaaccaagttcgactggtgtccccctcctcaagtccggtggagtgctttgaaccaaagattgctaagaaaagctcacttccaccacggaaatggaggaattccacattgttctcagcgaaagacaaatgctgtcaacccacgaaggcgctaacctttcacgacgaagcgaggacgagaaacagagccagacagctctgggaacaggtgaaagtgtgtgtccattcggcgctttgtccgaagtggtccagttttaaacaatattaaacatgcaagaaaacagcagctgcacggtttcagaagtgcaaggaaaagaaagcgttggcttacttgtgttccggaaaaaggagtgaatttcagttctgaagagggtgctgcggcagcggaagcagtaccaagctggtccttgagcagcagggaccgcgaaaacgaagagaagggaggcggaaatgacgaaaaagatgaactcgctagcgtttgatttgcgcaccaagtcgcttcgccgatgtctgtcaaaggaagaaatgcgaaaaggaacgacggggtcaaaacggacgcttgacacacttgacacacaacagccgacagcctgctccgctcggcgtgtgcaagagaaactctcaaaagtaaaaagccaccgaagggattcagacaccgaaaccggaacagcatgcgcgtttctctgtgtccgtggcaatttcagggctttttgattgagacaaaaaacgaggtcctgcgattgtttccgcaacaggggccgacagaagtgaacagcgtgacagacagcgtgatgtgtcagtaaaatgcagatcgacttcagatttcttcgtggttgtcctcgtttcgctcattcacgctgaacagaattacccacggaaaggggggaacgaatgtatataaattccacggaaagggggaaacgaactgtttgcatttttggatgtcgaggtaaagaaacgtggttgcctatatgtctaccctggacagcaggttttccctgggaggcgggaatttttgtgggttatatgcgtgaaaattgtctataacacagctgttgagaacgatgaattattctggccgtccatttcgagttccttcgccagattctgctggacgattcacacactatgctttgttttcccagcggaaaacgcaaactccacagaaatatgaacgataatggctctttggggaactgtctttctcttcttcatttcctgggtcgcttgtgcaggctttgtctttccatatgtcgataattggaaacagaagcaacgctgcactgttcatcggtgtttgtcttgggacctttctcattcgatgattcagcaaagacgtcctcaaaagcctagatgccgctcatacacaggtcacgatggtcaagaaggagaaaaggaggcgacaatcgaaagtcgctctgcatggatacctagatcttgagagactacaccgacgtcaggtgcaactacaatgtatacttttggatgtccacaggacacaccgggtaacatcgcgtacctggaaattccaccgaacgacgtggacgaaatgctcacggaaaatagcacgatagcaggtcagtgttcaaggccggccatgctaagtttctgcagctcaagctcaaaccctgagggggaaggatcgggctccagcgcctacgagggcattgcccatcatttaaaatcaactcgtaggtgtttgtcaatttctgggccgtcgtcgtttttgtcggtgctgtgtgctcgctcgttggggtacgtatctgcgtacggtatcaatatcgactgaatcaatgcctgcggtaccgggaacaaggcacgcccgctgacccgtagtaagttaacatcgaaacgtatcaagtgtaaagctgaaccgtcatacagctcagtcatctatgttattggtagacaacccaagtggctgccaggacatatggagaggtctgctctacgttgtctacgcttttatggctgttgatctggccaaggaatcggcgtgagcgacttaactgatgaatcgcagcatgaacactacaggacggctcccgtccatcgtgaaacggattccccggcagcacgtgacattggagatttaccgagcgggtgaagagagcccgagcagtttttaaacaggagtgaactcccctttgcaccctgtagagaacgactcagccgagagcatgcagagagcgttgtcttctctaaaatgccatcaaccccgttttgtctgggttccgcgcagcgagagcggcaagctcgaaaatgcggccaccgagaggcatgggacgttccgcccttttgctaatgcctgtcgttctctttcgacaagtgtatatagagcagtaggttttaaggggagaaatcttttcggaaacacgagaatgcttatgcggcggtattcaagatgcgacgcagtcccgaacgagggcagctcgcatacctccttcgagagtctgtccgcccaactctccgaattgagcttttccttgtgtcgtcgccttcgcgtccgtgagaggacgtataaaacgatcgaaatgtgtttggaaatcctctcattgcgcgttactcgatctttcagattcaggggcaaacgtgggctaggttgaggcgggaacatatgggtgaaaaagtgagtgaattacctacgagagatcgggcagacacgtgtcttcacacatcctttttctcagtgttctatgctcgcgctctccgtttacgtgccgtggtttttaaaggcaactatagtctcagtgtgtatacctgcaggggctctcaaaccgtttaactttgagttgaagatgcaacaatataatatacagaaggcgggcggtgtcgtgtaccgatcactcattgtgtactgacagcaaagggaagaaacggattccgtttttccagacatatccgtcagcgatgcccgtctctgttcgctcgcaccggggttgacgatctgttcgccgtcttttctgtcccaccgcgggaaagtggtcgagagtcattctccagtggacaaaagcagcaagatcacctgttctcctggtgtctggtttcgaacagcgccctccccagcgacgcgggagaccgggtggaggagtatgttcaagcggctgttttaaaacggttgcttttatggttatggtggagagtctctaaaaaggctggtgcacggtgtgccgacaccgctggactggcatccatgggcgccaagggaaggctggattccgtgtggaagccgggcacagaagcgaagcgtggatgtcaatagccggcaagtgttggggtcgaaggttttgcgtgcacggaaagagagggcggacgaccgttgccaaaaaagtgacggaagcaccaccggtcaggtgggccttgctccgtcgtgttgggactgtctcggtctcccgtcgaacccggtggacgcagaaaaccgagtttttccctcagctttccagagttcttccgccttgctttcccgtacttgtttcaagctttaactgacgtttcagttgttcgtctgtgttctgcccttctgagatcccacaactcgcgactccgcaaagccgtcatcggcagagcagagttgcattgccgtgaggatcggcacacaaaggcccttcctcgcctagtttttcgaggcgccgcgcgacggacaggcggcccagctctgcagagagtttctggcagttgtttccggcacgcgttcctcgcccgcaacgaccacgtagggttcaaccggggaaatcgctgcggcggaacacccccctctcctcccgtggccgtaatcgacttgccccacgcgcgtcgtcgccgccgactgccgggagcacaagcatctgcgcaaaaagctttcgtgtcgaagaatctgcgtttttttcagaaaaccgaggcggcatcatttgtatagacggactgccgtctgaccgcacgtacaaccttggtatttgtgtcactgtttgtgtacaactcgcgtgcacggcgagtgcggctgtgctacggttgtcgactcttaccagaggctcaatcggttttta

SEQ ID NO: 3312 - DNA, 3157 bp, Toxoplasma gondii
tatctgaagcactgtcgaatgccctcgatatttctctgacgcgttctgtgtgagtgaaactcccgggctgatacccttgtcgcccctctgttcgttccttacactgtgagcgtctcccaaaaagagcggaagtagtgtcttctgaggaagctacacggtgtgtgcgctttcgtccgtcatttttctgttccgtcttttcctttacctctgctctgttttcttgctgcgtttgcgcctcctgttccgtgcttgtaatttgtctgcatgctttgagtgttctcccctgaatccacggcctgcctcgagaggcgttccgctcacctcttgctcttctttccagcgtgcgacagctgccatgctcgccgtcagcagcgcaggctgagcccattctgtcttgtgcaattccgcctcagggccttcttcgcagagttttagcatgtctcgtccaacgacttcagacgcttctgtgaagatggccttggccgctgccgactggcgggcggacgcaacgcccatgcctaaggacccgagatacgacacagaggctggatagtggacgcagagaaaacggctgagacagtgtggaaagagtgaagacaacaacgctacttcagctgcgaaaaagtgcataaaggtctacttttcagtacacgcatgtgccacagagaaagcgtcagtctgcagtgttcgcgctcgcctcgactcgtataaagttccaaactcgtaaggcaaggccctcggatctcgttttgccccccgcttttgagtcctcttgtgtgagcatctcggaggggcacgcaccaacagtctgggcgccttggcctgggaaaagggcgactgtttccgcacggaaagattcaaaggcgtcatctgcggctccacctgggtgcgatgctgtggctagacctcgaagcgaggacggggaagcaggggaccggtggataagcctgtctgactgcggagcgaaatgccccgaaatgtttctgccagaggtttgaccgttcccgggagagtcgctcgcttgcaaggccggagaaaagaaggaaacagacagacggggcgctgagacaaaggcggcaggagagtgtgaggcgttccgggtctggcgcgacgcacgcagggaacgggaggcggtagagccaaaactctgtgtttcaggagaggcgaaagagggagaccgtgaagaggagccagtgccatctccaaacaaagacggttttggcgagggaatgcgggataaaaaatgaccagacggaagaggaaccgccccagagaagggaacgagccagccagaacacagaacgagagtacaggaatactggaggaaagaacgcaacagggccgacgacgccgtcattttggcagctctgtacatgttgcggtcaccgaaacgtccccaataatctgggggagaagccaagtggagatggaagcagcgccgcgacgctacggacactgcgacaaaatggactgtacgctgtcttgtgtgatggcacgagccgcagcatacaaacgattgtattggacaaaatgcaccgaaaaggcacacacagatgaacggaaagaacgtgtgaacgattgtggaactcagaggaaattggctcgtggcaaggacgacaaacgatcaaaggctgtgttaacaggaagaccccttggcggtggcggcggtgcggacaggacaagagtatgcccgggatgctgttaatccagaaacaaaataaactggccaagggtcgttgctcatggcgacactgaagacgagcggacaaaatgccggtaactaacttcgacgtgccgtcaccagcagggatgcggacaagccccaagcatcaacggctagactggcaagtgttgccggcttcagggagacaaagaccagcgggacaaccttttgagaggacagagcgacaactggcatgatgcttcccggagtgtccgaacaaaactcaagaaaagtagttttggagtgtctgtgacccctcgatccaacggcggaatttgtcaggggctcacgccgcggtgtgtacatacacctcaagacaacaataacgggcagaacaaaggcgcattggctacctcgcgattgactgccatttatttcactaaagtcacagcatgtgttttcccgatcgccggcttcggtgaccgcacgttgtgaaaacgtgtgtagatgctgcggatacagcaaacccgaatcttccttatagcccctgaacgataccatgaactttcatttcagtgtattaaaacaacgtacacgggcacctttttgtaggggatcttcgtggcaagcgacttttctttacggagtgtcgagagggcaatcaccggggactgcagagagcgagacagagacacagtgaagtgccactctgggttgatttgtctccgtggagggagaagccaacccagccgttcgtccgttatgtcgaccggcctcctagattatggagatgagtgcaagtgtaaacttacatcgctcgttgagattcagagcaaaaacggaaaactacttcgttctcgagtgtgctgttcgctgctagacgtacagggtattcggaggtagccctgtctccgtcccagtgtctccagataggctgtggctgccttctgacgaaacacggggggtcacgccgaacgacgaccaccggggactgcatgcgcgtattgttgcctttttgtccgccgatttttcgatgggttcgcccagcaggatatcgttttcatggtcccggcgaaacaaatcaagtctttttttcagtttgtttaggccggcttcccgcgtgatacgcagacgtcgcctttcgagtccattcacccttcccctcccgttgttttccaggcagtcctccggtacacactgtgaattctcgtccctgacgcattttctgtgtttcatctctgaattcagcacagatggacttatccccagaaaccagagccagcatgtgttaaaatccagtgcgcccgtgttggaaaaggacactctgcaaactcccccaagtttacaggcacgcaaccgggcgccgtcggctgatgtttgtgggccataactgtttccgctccgtcagaacgacattttctccgtaaagggagtcttcgtggggctttctcgtggccgtgtctgtttcgtctccatcacgtttgccacttaaaa

SEQ ID NO: 3313 - DNA, 3650 bp, Toxoplasma gondii
gaaaaagacaaaattgccgcttacgcgagttggccatcgaaatgtcgctcgcttcgttcgggtccatccaaacgcggcggcggccgcatttgagaatggacgccgccaggcgcttctgcagttgaagagactgcaacgagaatccacatccacacagagccgaaaggacaattaaggcagacggaagagcggacaccgctcctgaacgaagacggcctccagaaagaggagagtacggcgaaagaaacggcagcgaaaaagagcgatcgggtcggggagacacagaaaatagaaaccgtaccattggagtctaacacagtccacgaaaaacgcttcccgaatgcagacgaggctatcacccaggtaacgcaacaggaaagaaaaggtcaagagcgcagtcaaagacgcctgcatatccgaatctgggcaaaaacgagacttccgatgcccgttccgtggtttacattccatttacgtagcgaaggggtgcagtcagcatcgcgcgaccccagctgcctccacatcggcagggatgtcagggaacagtgaaacagttcgacgaaacaactgatcgatttgattcttcctcctgttgatccccccgccagacttcacccacgacaaatgaatatagaacacccacccgcgcccgtctcgcgcgcgacacaaactggcccttcccctttcactccccatctcccgcctttgcacactcttatcaaaattgtgaatgccgtcaccggcgtttctccgacagtctcaacgaaaacggatactggccgagcggcggcgagctgcacatcggcctcagcgtctggaggggctgtatcgcgccatactctcgcgagaccccctggagcagaggcagagaggaggaactctctgcagaagcttagcaggactcccaaagaggagctaccctcccgcagaagaggcgacaaagaagtgaggaatccacgaaaaatccagcaacgcacaaaacgttattcgccgcacgcgggacgcgccatgcatgtccgtctccccatcgcgttgtttctcgatttccccatgccccacggcccttcactttctcccaagcgtcggaaaagacgttgagagatggggacgatgcgagagcagagaagacaggagacgaaaacgtagatcctggcagcactccccgtgcaaatgcgcggcgtacggaacccagtgtgggatgactgcgacagtggccacagccacgacaaagaactgttcgtttcctcgacagcgtgaaagactcaccatttttgacgaagacgaagcggaggacgcgcaacagagaagagaaaaagggtaagtggctgaggacctggaaatctctccaaacggaaccggcactgtctctccagcagggcgcggccagtagagtgtatgtagtccgccacactctacgtttcttgcgggcaaagcaggaagaagaatagcctcctttcccccctctctctggatccctcccctctatccctgtttcgagtataagccgagcctcgcaattttgccacgcgaactgccgccgcaagagtctcgtgtgcggcgcgccggtgcgccccaggaactggagctacgtccccttcgtcccagtggtttctcctaacgtctaaatccgcagtggctggtccaaaagtccgtttcagcctctctccacacctttacggcgagatgatcttggccatgttccgaggtcatgtccccctaaacagagaccgagcgcgagctgtgactttaaataccggcgcccctcgaaaatagaccgacacccacccagccgcgcgcgcatgcgtttctcaatgaggcacacacacaatgatgccacgagactgagaggcactcgagaggccataaaatggttcgggtattcatacgcacaaatgcgcagcctcgcagacaccatttttagcagcctaccgcaaacagacaagccggatagccttcatttcggcgaggctttttagacctgcaagcgagacgctcacctttcgacacctcgtctttctatcgccctcgaggtctgccgcccgggggttcagccaaggagaaaccagggctgccgtcgcagcgccagcggttgtgaggcgacggatacacggcgaactcgaagtcggttttttagggagcgagcctgatctccggcaaggcagcgtggacagccggtccagagagagctgtcgacaggcaagttgcggcagagcgtgaatggggcgcgctctccgcggtttccgctgcagtacgctgcagacgcaatttgcgaatcgacaatgtggtagagagacgaaaagctggcgactgcggtgacgtgtaccgtcggactttccagtgcggaacttctcggtttttgcacactacgtacaggttctctttctcgttggcattattgtttgtgtgggagttggcgaatgccggtgaatccatgcgctgcgttctcgcgtctcctcaacgggagaagcgcaacgtgaaactaccgggaatcgcagttcccgtcctctgcggatgccgccacttgttccagcaattcggcgacagaaggcgtcgagaggacggccacgcgccgcgcttggcttctgaaacgaagcagaagcacagacaatttcgttctgaaactctagcaaaacaggtaggcactggattgcgcacctaaaccgtgcttagcactggttcggggcttcactcgaaccgccggtttcgagctttcactcgggcagttcctcgtggttctctctgactgttgcttcaaagcgttggtctggctgccttctccgtgtccctgcacgacgccgtttctccgattttctactgaaatcggaaagaccgggaaaaaccgcgctctggagaccgcgagagacgagaacctggaagcgggtgtgaggcggcagaccgcgagggatattttttcacagtcttcgatgaccggcgacgtggaattttctggcgtgaaaatgatttgtggaagcggatacgcacatctgtttcaggtgtatgtacacgtggtctttctagccaggaactcacactcttagcacgcgaagtggggccacactcaccgcggaagagcgcataccagattttggcagtttgctttttccatttccccgattttccgtgtgcacctagcatttcgtcgctcggacgtgaatgccagcgcgccatacgaaatacaaaaagcaacggcgtcggaaagagggccaattcggaccccgaagggagggtagcccactctcttgccccgcaacccccctcgaccacgtagaaagggcaatttcattgtagtccagttgcacaatcgtttccgcattgtcagtgagtcttcttcccgcatccaggtggttgctaccgtggaaaggaggtttgtgccgccccccagagtcgcaggttccgtccgacgcactcgcgcgcagtccagcggacacgtacatttctgtttgcccgccgagttgccgaccccgacatcttctccgttcaatttttttcagaatggattttcccgttggcgcctccgtgctgttccgttcggattattccgacagtctcgcaggcctccgacgccgcctgtattcgagcactgttgtctcttttttgcgttcaggtcatcgccgcggtaatcgtttgattcggccacactgtggtcgtca

SEQ ID NO: 3314 - DNA, 2516 bp, Toxoplasma gondii
gcatgtgcaggtctccacacccgcaaaaagctgcgcccacaattaacagacaaatattacgtgtgtcttcaatgattcctcgcataataatcacgagtgcgtcgacgctagtgagttgcgtcgacttttgatcgcttccctccggttcgctagtgtgtctacgcaggtgagattgtgacaatcgcattcaaataaagatgtagtagaggccaacctgtttacatgcagcggagaggacggcctgcctgcggtgtgtgtgcactgcgagaggcatgggtggcgagtcgaaaccctttcggggaaggcggcctctgcatggggagaaagtcgttttccactcgtggattggaaacgaagcgtcttttcggctttcctgcagtccgcatctgaaattaaactggcagtgtgtagattgccgtcctgcgtatcgacgcgaatcacgatgcaacacaaaaaaaggtgagaggctcgccgtgacgagcacttgaatccccatgcaagtgtgcacacaaataaagcgtcttcgcatgtgcgtccgcctccatacccagagaagagagagttctctgctacatgcttgaaaccgccgtgtacacaagagtcgcatgtgcataacacaggcttacaggcatctgcatgtgccgacttgcgtttgcagatctcgcgacagacagcgtcggttttgtggggtctgaagcatgaaaaaaggcctttgctgaagagagccttgcgggggatttcgactctttcgcgacgaagactcgccacacattctcgtacctgcagataggacgaaggacccatgtgcctctcgcaactaatgtgtatctacagaggcaccgcagaagcagcagcatttcaaacaagtcatacgcagctggaggtgtgaatccacgagacgcagaaagagcctcggcagacgaggaaatgcactcgcacctccctgggggccttcgaccttcccgcctcgaagagaaccggaaaaaacggatctggtcaaggatcactgtggccggttcacacaggtttttcctgaacatcacgtcacgaaaacggggaacgcatgcaaatgaagcgctcctgtgcagagaggagaaacgcggtgcgcatgtcttgcgatcgagaactgcagaactcaaatcgagtacacacagacactgtaatggctaggctgctgcatgtgactccgttgatgatgcacgaactatcaggttcttcgtccttgccgttgaaacgaacccacagttcttccctgtgtcatttgaatcgcgtattcaatactgcattttcgatagttgcatcacccgacataaaatcctggcatttcgcagtctagtgaggtgatagtccacagcactcctggaggacgcggtggtctgtattccttgaacgaagttgcattcagtagcctagagacttaaatgtctcaaccaatatatatatatatacctacagggttgctgcagccgtttaagtgcaggtggaaggcatgtgaaactattgaagtagagcctgtgaaaaaggctttgagagactgggtcaacggtgaaattgagaggaggcgccaggacccgcagagcctttcagcggaagcctcacgacgcctcaaagtgctcacacccgggcgttgtgcttcgcgacccaccgcgctgagcacagcgccgtctccggattttctggaccgtcaagaagccgcgaaaaaactggatttgcttgggaaaaacagaggagcgacgtttgtccgcgaaacgccacggtgtcgcgtttcctttgagcaagggcgtcgccgccgcaccgcaaggcgacactcgcaactctggttttgcgctgtgcgtggtgtcttctcgctgtgcatgcaagtttccagctgttcacagagtagccgcgaggaaggttctgcgaaaactagcagacgcgaggaaactggcaaaaaaacgaccgcgaagagtacgctgcggaaacgtcttgcttttctgcctcgccttcgtcgcgtccgacacagaggctgtcttgtctccccaacgaccgggaaagaggtggagaggcgtttctttcctttgaatcctctccgtccattgcaggacttcctcactcggacggaaggcaatcacagcgcgtccggttcgccttccctcgtcgtcagcatcggttgcttgctgagtcatcggcacgcaggctggcatcccgcctcagagaaggaggtcctttgccgcggaagtcaaggagggaagagctctcgacgccagctgacagcagttctgttgtttcgcgcgtattcttcgtgttttgcgatgcccactgtcctccctttctcttccttctcccttcagtcgccgaccacaagccctccctgtctcccgcctccccttcctgaccctgtctctcttcctcggagtgtctcctcctctcttgatccacaggttgttccccggctctctcgcgcagcttcgaccttcctgcctcagtggctcttctacttccctcctgtctcttcgtgccgtcgcctctttccagca

SEQ ID NO: 3315 - DNA, 2656 bp, Toxoplasma gondii
agtgatccactcagagttgagaagctcttgtctccgaggcgaggctgcgtcttgttcagagggcagttgcccgccttcggttcggccgcctctcttcgtcccgcaggccatgtctccaccctgcctggttcgctcttgtgacccgctggcacgcgactggatctgaggtgtatgtacacccgagtttcccgcgcctgggtcccgcgcctgggcaaagagatccccggagcttctccagtcgcgcgaggtcttctcgtggtgtgtgcggagctgctgggcctctctctgcttcctctcggactcttcaacggcgatctcttgcggtaaggcagcctcccgcagatgcgagaaaaagatgtgacgcggcaagtccgaaataactagacctttgagaagcatctcctcctcgaggatgtggaggcagctcaagacgcatgcaggcagagacggcggagaggctcccgcggaagtcggcggcgacgcacaagaagcctctgtcgagggcggagagaggggagacagagcggatggagcggcggactcgcctgaagacggagaagcagcaggaaacgatgccgcactcgaggaggacgcagcagggtctttggcctcggaacgcggaggactgggctcgcctgtgaggagccagtggaacacaagtttttcttggagtggagacagacgacgaagcgtttcgagacccaagtgtggcgccgacgcaaagcccagcgcttgggcctgctcgtcaggtgtatgtacaccttgagccgcgagggcgtcgagggcgtcctggaacggccaggaggcaggcgcggcagatgctcgagacgcttcagcttcgtgttgagaaggagagtgcgaggaagaagacgaggaagaagacgaaaacgagtcgaggaaggaaggaacggcataggcgtgggaggacggaagaggattcgacaaaggcggggatgctgaggtagaacatggaaaagcagaggagccccgcaggaaggaagaacccgatacatctgggagggcaccggactgcgcagcttccgccgcggcagaagaagacgagaaacaccgtcctgggtctctcgaaacgactgctgcgcgaaaagccttgctcagtcccgcagtgttgcgtgcagtggcgcagccggaggaaacggccagaggcgacgacgaccgagagagcaaaaatgagaagacagagagagacgagcgaggcaacaaagacgatgcagcagccgaaggcagcgacgcaacagaagttcgtcgaaggacgcaggaacgaggagactccgggagagcgagatgggagacgcaccgtgcagagacgtggaggaacgacccgacagaagatacatgcggcctttcaccctggaaggacgtccacttgagagtggcgagggacccacagttttctttctgtgtcagttccgcactcggtgaagcctcaccctcccttcgcctctcggcgcgtctgcttctgactgtatggtctcttctcctgcgagttgcgaggacctccgtctctcgctgtcttcccctatctcccggtgttgtgcctgctgtctgagtcgagcctgagtgtctccatcccgggagcctcctgctctcgcctgaagcaaaagcagacgccagacctgctgttctcgcgttcaagacgcagacgctctgcactctctgccgccgccgcgccgccttctcttcggctgcgctggcgcccgccgttgatgacacatacaccgcagatccgccgcgattcgaagaagacgccggtgaagtctctctctgaggcgctcccggcacccttcgttctggccctgcaaaacggaacggctggcgtctcgccggccgcagagagaaaaagaactgcatcgtggcgcgctcgcagccatgcatgcaaaagacgagaaaaaggcggacgcatggggacgactgagacgcccgaaagctcagagaagaccggaaaaacaagaaggtgacagaaagggaagaccgaaagcctctcgcgtctttcttgagaagcgaaaacacagagaaactcaacagaatcgaagcccgtcgagacatacgctgtgcgtatatatacagcgaaaggcagcgacgaccagctccttgaagacgagaggaagtgcgatcgcggtgaaggaaaaacttgagaggaagtcaaagacgagattctcttgtttcattcgtttctcaaagatccccgaaaagatactaagaagaaactgtgtggggctcttcaaagcagcggacacagcgcgagacagcgagggcgaaacgttgcacagtggacatacagctggagaagtctgcttttctcgcgcgttcaaacgcgttttccaggaaaatgaacgagcattcacattttttagtcgcaggaacagacctttgacgtccttcttctgctgttgatcctctgtcctgttttctctctctctcttttcccttcgtttcctccctgggctctctatcctctctctttcctttctctgtctttttgctcgtttctctcttcgtgtctcgtctcgttgccgagaagaaagaggcgcttcagagttcgccttcttctccaagagagacctgaggtgtctgtcttttctctgcttcgcgtctcgacttttcaccctcttccacggtgtcgctcgacttaccgcaa

SEQ ID NO: 3316 - DNA, 2211 bp, Toxoplasma gondii
atgtaggtattcaatgtgaaaggaacagaagagtgaacgcgactcccgaaatagcggttgccatgaatcggtgagacgccactaccagtgcatagtgcgttaccacccgcaaatgatcctaggtgggtaaagacgtcagttaagggtccagcagtaactgaagaacgtacagaaggcctgaagttgctgggttcacgaaattgtctctccccgaaagctggcatcaggaaacaagaataactgcagttcattgcgtcctgcgggcactgcctacaccgcgagtgccgactccgaatactcgcacctaggcttccaaagcgagcacagctacagtcaggtggcttcacagacagccggcagccagtagtagcggttagattattgaagaagtcagaaggaactccaggctgagcggaatattcatgaggtcttaccaataccaacctagcaccgacaaactgtcccaagaaaagcggaaggaagagattgaacaaagaaagagttgggaagaggcgaagcctgcgaggatacttccaaccaaccatcttgcaagaagagtgttttggcagtcaactgaaactcctccaggttgccggagtggcttggacgatgtacagttaacactgctgaagcgggggcacccgccgacgccggtactctctacgcagagttagatgatagtatatactttattccatctgcattagagagtgatgacagaaactgtgtgccgcaaaagcagcgagtggagtacggacaacgatgctgccgacgcctttccctccctaaggggggtcgtcacaagggaacggactctacgcttgggaaagacggcagacaagcagaaaaacgcattttttgtcgttgcaagtgtcgaaatcgttcattattacacgcataacaagataaaacacacagatgacgcagaccagcaacaggggagacaacactcgtgagacccccccccgaccggatgagatcccgcactccctcaaagcgacggaacgaacccgcaagattcctaaaccatgtctgcattggatgctgtgacacgatatggcactctcaaaaatggtatgaatgatgtgcatacatatcattcacttcgcccaagctccctggcatgggcaaaaagcgtcggggctgccgcgttgtcttgcggcaacgagacccggtctatgacggacttcattgctcacgcatcgcgcgatcccgaatgtctttactcacgtacgcctacttgatacgctcccaataatttacagcaactgagaagcagtctcgtctcaatacagctgagaatccagtttgctgcgaaagtgaaatgaggagaccagtacaagcaagttttcacgcaactttcattccgcactggcagctgctttgcctgtgtgacaagtcgcacaacctgttgccaggacatttgccgatgacacacacaaacctgctcgctattgcttcgcatttctggtcgatgaaaaagtgctttgtaagacacaatgtttgagatacttttcgcagaaccaacggacctcgagagcgcaaagaaaaccggagaggtttgcacgcttcttggttttccacgtgtgctgagtcccctgcccgcgaaggttaccaggctcacaccgtcgtccaagggacacggccgaggtgcgatgcatgcaaaaaaatctggatggcagcagggcatcaaccaggaacagagcagaagaacccattcttgttttctgttcagggaaactcgattatttagaacttctgctgtcggtcagttctgggagtcccaggacgatctgtagggtaagggacaagtggcttgctccaggaatccccggtgatggcgtctcctaagacggggttccacaacaaccaacactgcatgccttcatattcattggtttccctccattacacaacacttttcttgtaggttgtggagtgggctactggtcagcggttgttggcggtggcggccatcctcatcgtccccaccagggagcagcacggccacttttttcggtgctgcggcgccaggtttattatcttcatccgggacaggaaatactggtccatagtcaaaggaacagtttcgaatcgacgcaatctgttgcgtactccgatgggccgctatatggtgcatggggatttggcacactctgcattgaccgccctgttgtccttcaccacttcagccgatctataacttcaaaa

SEQ ID NO: 3317 - DNA, 3240 bp, Toxoplasma gondii
gcgaggagctgcagggaggcatgagaaagctgaggaggaaaacaagcggggagaaaggactcgaaagcgtcgagaaaacggacaagagaaaggtgtacggagaacaagagatttgggagacgggagacacttggaaaacaacgcgcgcgagagattatgaaaacggagaagagaaagaacctgaccgacgacggagctgcaaaaaagagccaaaggtgccggaaaaccggggggaaggctgagaactgcacgaatgagtccgagacagacgagagtcgaaggcgggaggcgagacagccgggcaggccagggaaaaacgaaggaaagcgcaagcagagcaagacaaaacgagacaagaaactgtgaggatttgcgaacccccgccagtctcggtgcgagtgctttccgacaacaaaggccgcctccgcgcgttcttgtccgtgctcgtttttgaaggcgaagccgcgttccgtgtgaacgaagaacaaccaagaaaaagggaaaacgcaccgaaaagacaaacggtttgtactgaaggacgaggagctccttacatgcatgcgcagctcgctacagccgtttgtgcatgagatgtggacaaaaaagatacacgaatgcctattttacagttttcctcgacaagcaaggtgggcgcaaatgcgatgtggaagcggacaagcgggagagagaacggcttctctgcgaaaaaaccgttctcccctgacaactctgccgagcctggaaacgaaacgcagagcgagaagacaagaaactggagaaaaaaagagcaggtcctctgacgcctgctgtgtccagtgttttgataggaagacgccgaggagagaccgtggatgaccgaaaacgcccacacagagcaggaggaacaaaaggtgagaagcgaatcggctgcggacctctagaaaagacagaaaaacacacccagtggcgacgaagagaagttgaagagaagcgcgtgaggagtgaaaagcggcctttttttcaagacaagagtcgagctgcatgcacatatccactcgcgggtgacggcgaaacacagtggccgggatgacggcgtttcgcttgatataaaaggaaaaaaacgtctttttctttcctgcatttttgtgattcttatctcagtttttccgacgaaagcccgcggagaaatcgtgaaacaggaaaagcttcctcccgccttctgcatgtgtgcgccgggcaccacgcgggtggtgtgttgacaacccaaccggagaagaatcaagaaattcccccatttcgaaaatcgagctcttgtatttttattccacactttcgcctcttctcgcctttacgacctgaggatttcgactcttatttctgcattgccacagtcactcttgcctgtgaaatttcagactcttgtttgcgaagtctacgtcatagtttatctcgctttagaactcccaaacgttcttattctccatcattagacctttcgctttttttcgaacttcgagactgttttttcaactgctcatgcttatcacttctctgtaccaatctgtcttctgaaagtcacttgaatgcacaggcgcaattatgagattatcagtgcactgtttttaagcttaaattcgaacaggaaaaagttagtgtatcttttattcacacaaatgccggttcggaagtcatgttcccagcaactgacgcgaattggcgacacaggaaggcctcttttcagactcgctgaagaaatacgaacccacagtcccagaaaacgaaaaacttgtgggggatctatccgaatctcacgagtagagtattggaatttttaggtcgatatggaaacttgagagagtgacacacttttatatttgttttaataacatctcatgtgccttattgaaactggttcctgattgtctgattcgtaggactctgtacatgagtccagtaggagagacaggcaatcaaggtcctgacgactgctgtccgttttaccattcctctggcgcgctgaagacaactaaaagagatgagagccctcctggaactcgattatcgatataaaacagcgaatttgccgatttatttgctcgagtttgacacacgccagaagttcccctctcactcggacaacacaacactgaatggccacaaaggcgcataaaaagaccttgcattgcaatcgcatcacgtcaaaagaacatgcatttgagtcacacatcgtatgacaatactccgtgcttgataaaatcacctttgcatggagtagtggcgagcaaagaaaggacttcctatcgcaggtcaagtctcggaagaaggacgcagacgactacgaggctgaatcgaagacaaagtccggaggaaagagcagttcgagtcgctctctgaaaaaggaaaacgacgcctttcttgagctgttggtgtgcagttaatgctttcagcctttccctgacgattcactttattcaagatcttctgtgctcttcacaaccaccgtgtcaagagcgtcaagcgtcgtctgtgtgtgtgtctgtgtctagcgcatattcagaaagtccccttcaaaagagagacgcatcaggactgctttgtttttcgcgtacatgtcgcagtcctgcaggtacaaaggctgaactgtgtccatgctacttgcacagtcgtttctttcatgcgaccctcgcaacagaagcctgtctttcgtcttaccagcgcatatatccgcgcgcttacacagtggacaggcctgaactgcaacttcctacagaccctgcgccgacaaacatctactctgcgatgccgaaaacataatcaaaccgtcgatcctggcgcgtttctcgtcggtgtttgcttcttgcggcagcgagaaacgcgaaagagagatatgcatgcagccgtagatgtctgcggcacacagcgtagatatacaagtgctagcccaactttgcgcaaaaaacgaaaccaaattttcttgggattttatttctcgtttgttgatgagctccaagtattgacaccagcgaactcaatcctaaagcgcgccgtcgatcttctcagcaggcggtcttctgtttctctgggttcctctctcgggcatcccaagctggagggcggggggaggtactgctgtgtcgcaaaaacgactttcttgatgttcttcgtctctccgaaggaagagtctttcagctcttccgttgtctttcgtcacttcagtctcttctcgggtgtttccttctgttctcgcctttcctcgtccaa

SEQ ID NO: 3318 - DNA, 5006 bp, Toxoplasma gondii
tgtctaaccatgtagccctcttcccgacggccgctctaagaaatgcagagcctacgacaagcatacgcaaatgctcaagtgaattctgagcagatgggagcggaatcgaggcagagacggtcgtggcggaacgccccgcatcgggaaggtcttttttgcactcgaaaggcgtcgccttggaactgagcattcttgtgtctcgcgttcgccggagcggtgctgtaccgtcaaaatagcctacctttcaggagctggttctgattgaggctgctcaagatggcaatgtgttcctctgagagattgcggaaccgacggcgcgcagcgtcgtttgaaacctcgtcctcttcactgtccgccgttgggcgcagccgagcagcctctgccgccgcctcagccgcttccagagggccttccagaagacgcgaaagatggtcagaactggaattggtcgcagaggcgggggacgaggcgccgcggcacccgtcctcgtctcccggcggctcgtagagtgccatcgagacgaagaagagagcggaactgccttgaagaaaagacgcggtcggtagtttaactgcaccccgttcgatgagaatgggtggaacgggtcggcggaatctgtgcggcggccaggcagaaacgtgaacgtacgcctcgcgggaccaccggcgacgtaaggggggacggagagcgctaaaagagcggcgttgtcttggggaaaagtacgtggagagcggcggacatccggaggcttcctgccacacgggaagtgggcggatacaagcaaaaaagtcgcgaaacagcgcgggagagagacatggaacggacaggaacgctagaaagccggtcggcccgggcgctgtcaagtgaaaagcgatgagaaagcgcgggagaagccaaaagaaatggaaaacctgcgagcggaaccgccgagggacgcgaatcgagctctaccggactggatggcgagttgtacaaacggccgaaatcgcaacggtgacccgataaaggccgtgaaaatcgtgcacttgtcgcttacactacatgctgcggtgaagcgcggaaagagggaaacgtgaggagggaagagtgagcggcagcgacggacgacccgtggacgctcgccggagaaaagaagcgccgaaaagaaagatgcgcaaagtgaggatttcagctgaaattgtacgcgacgacgagaaacagagggtcagctttccacatgtatgacaaaaacaacgccacagctggagcaaaaatgtgtgtccggcaaagaagccccaagcgttcctcttccagagaaaggttggacgtggcagcacacgggagggtgcctcgcaacaccactgccctcagacacattttcgttcgcacgatgatgaatccagctattttgggggcccagacccggcaaaaattagcattaatccttgtagaaacgctcccgcaaaagcaagcctttcgccggacatgaaaacgacctacccctcagtgtgccgggacaggactcaacagacttgtctacattcttcaaggtcctcgtgaccagacttaaaccccgttacagagcagggacagtcaaggtatgcagatggaaagatgcgtacccaaatgcatgtttcagcaggcgtgtctacgagaaggcagacacataaaattcaaggatcatcgaataagggatggatctgtagtcactcatacgccagaaggcgttgcccacaccgggaaatctgctggttccgccggtatgcggggcaaggctatttcacgaaaagttctcagatccagcaatgtcctgcggcaaatacagaacccgaggtcttgggtaggtaaactagacaaaggcagtggtcgtccaccactgtgttgacctcgaaaggtgacagaccctgcggcgtcgttgtctggccgctgacacgcaaacgacacggtgatgacgggaagaatggcgtgctctcagaacactggcgggaaagggaacgtttagcaagacgatagagctgaggttggctccagtccctttcacatcggttatgctgtacgcgcaacatacgtagttctgttatcacccttattaacagcgagctcaggggagtttgttgctggcatgtctgaagactcgcagttcctgtcacgagggaggagacgacacctgaaagccgaaatgcaccgtggaaaacatgcttgggcatctgagttgacatgtccagcaatgctacgcgaagctggaaccttcagataactctgaaacggggaagaactaaggcgtagacagtcagagaaacgcagtgttacttaccatgatggatctagtgatacgagcaattcagggactgtagatgttcttcgatcgtcgcccaaatcgaaactggggggcattcacgtgtggtttctgtcccgcaatggtttttcacctaacatctgggattgtctgaccgccgctttcatggatctaatcgtcgcctctgcggcttgcgaacatgcttcgattcgttcgaacgaataattgcatgctgtcgaagcaggttcacttccgtactctttgtgactgggattcttccgctgtctttgtgtgatacgacggccggcggtgtcttagttgaaggcagtttccggtatgaagccatcgttgcgttttcgggtcggaggcccacaacacattgggtttcagggatcggatcctctccctcaattggaattgcacttaccatgagacctgtgtccatcgaattgcggtagaacgctggtacggaaccttatcacccattgacgagtaacaccgcgtaatcggcagtgggagcacgttgctacagcctagatgcagatatgtttttttccccaggggaaagccattttctcgacgctgaggaaaccgagacctgcgagcagcttgctcacatgtcagagtgcctgttgtccaagagtctttcatctgtaccacatcaattgtaactaaattactcgctcctagtaagcccacgcatgtccagaatacactccatttatctgtcttttccagttcgggaaagtggtctgcaaacaccacgcgagcagccaccgtgacaaactgaaacgtgctcatgttttagcaaaatcatctacagactggcgagtttgtggtgccccatcacccgtacccggacgcactcgggagagcgcattcacacagccactggaggaaaatagtccttcaaaaccatggcatcatcgtgccttagagaatcctcttgtcgagagccgtcgtgtcacatgtaccgacttcccgagtactcacaacagcggtgaaagcgccgcttccagaactggctttcatccgtgtagagcatctgagcttctgagtaaacacagtcacacgaagatccacttttcttcttcaaccgtgggggaggttcaacgcactctacggcgttttctactgaaataagcaaccacagacccaagcgaacagacacaaacatccaccgtgggactgatgaaaagcggttcctggtcgtcactgatgaggtgtatgtacacctcggaaagtgtccatgcttcttcggttttctctgtcaaagttagtgtgatcgagcctacgccgagggccatggcaaaacgcagaaaaggacagagcgtcaaaagatgctcgttctcgcgtgcagatctggcaggcaggcaagcagccctcaccaaagcgcgtcaacctcaaggctgctttgcgcgtcttttccagttcctggatttgagcttgtttcctatccaaacagatagcgtatctgtcaccgtaccagagcatgttgtgagacgaactcccaattccgtgaggcgaaggcagcaggtttttgcagccatccacgtgaatccgctgtatcgatatattagacgttatcgcccgccgttccggtgtccggtatcgcgatttcggcgttttcgcattttccccttgtgtctggaaggcccggcttttttctgtctttttggcatttaaagaccgctatgctgcggtgaggacacaatctgcttttcccctgtgtcttgcttgcccatgtctccgctcttcggctttttttcgcgcggtgcatgttctcccggcagagcggcaggcacttgggcgatgcatccaacggtgggcccgcgcacgagcacgacgcacaaactttggaatttgcaattctgcaaggaagtggagagccacccgaccgcaaaaccgcgggcgagctctgtgaaaaagacctctccattttggatctttttttatagcgctctcagccccgttgtcggccgcctttttctctgccagggacgacgttggggctgctgcgactttctcgcagcaacgctctgcgttttcgctgccgcccattcaaggatttgttagtcggctgaggcgcacaaacgaacggccccggcgacaagagcagcggaggaaaatctcgaagtaagcgagcgggcgcgactctggaaacgcctctgtgccaccccagggtgacaaagagaagtgggatttctggaagagggactcttctcccgggggacgcgggagaagatggccactggaatgaaaggaaaagacaaggaggataccattttttttgggaacaaggattgagtgactcctccattctcttccccacaaagcggggtcaatagcggaaacgccgatgacccggcaactgtgatgctctcccagaaacaactgcgtccaaccgattctccctaccgatgtcactgccgttgtatgtccctttcggcatcgatatgcccgccgagtctgtgcattccagcaattatgcacgtatgcgtctggttgtacgcgctttgcggacggacctcttctgtcggaaacgactggagaaaagatttcagtcctccgttgtcgcggatttttcctccgctgcgggtgtccactcgcttccttctctaaagtttgccttcgtttctaatcagcgcggacgaaaaagaatcaaagggtgttctatttggagtctgctgtcgcttcttttgccatctgttttttagaaagacgtcgaaaa

SEQ ID NO: 3319 - DNA, 2793 bp, Toxoplasma gondii
ttcgcagatttgcacagatttagcagagccagtatggagaggttggaccgctcgcgctcgtgctctttttctgtgcgtcggaatctcttgtgtccaatgagtctgtcgttttcaagaagcaaatggcgagaccaagaagaggttctctctcttcgataggagcctagaaccaggttggggggttgacggcctacgaggacatgagaacactcgcggcattttagaagttcttctttcatcgctcttggctcgccaagaggagaacagaatggctgacgttgagcaaaggaaatcgcaggtgttcctttctcctccagttgatacggaaccggcatgaaacgcccagctcgttagagaggtgtctccttgttgtctctgcgaatcacgtagatgctccttccaccatttgtgggcttcttagaggcagaaggcctcggtcgctagagtggacgaaacacgcaggctgtccgtgagcgacacgagaaggccagagaagagaatccatcgcatgtttctttatgcgggggagcaagtttagaggcgatttctgatgcaccgcatatagacccgtccaacgcagaaagaacccagttaggtgagcactcaccagttagcgtcggtggatggaactgtggagatctgaggttctaggctgacacaaggagctgcgacggggacccgagaagtgacacgacactaccagcggccaacgcgagaaaagggcggtggtacccacgagtaagatgctgaaaaggaaaaattggaactctgggagttttagtcgtttcagagcaacgggctatgcgggcgacaggaggaaatatcgcgcttgttacgttactacagcactcaacgcacttctctgattcctgaatcctctttttctaaatgcacccctgaatctagttcgtctgtagatgcgtagaaagttgctttcaggagtctatgtctccatgaaggcttccctttctcacaggaacttggcaaagcgaaatgaaagtcagtcctcaccacggttggagcagttgcacctacatttatgtttgcttttctccagcaaacgggttccgggccgtggcgctgttgaggccgagccagagctaagatgtgcaggcatcaccgatctttttttcagaagaacgtagcgacacatgagaacgaggcagctgcattgagtgctgagaaagctgttcatcgccgactgtatctcctctggaacggtagcgcctaccgtcccagttgaggtaactttcgaattcacgtcctccctgctgttttcattgtggtgcggacaactgagacagctctcgttggagacagccctcgtcgatgtttcattcttatttcttcgttctttctcgcaatctctgggtgcctagccgtgtgtcgcctaagagacgtttcatacacgccaagaaagctgtctacgaaggcaacaccgtgcctgtggtctccaaccttgttattttctttggtgatgatataagggagagaagcgcgagtcgctcgcgttccgtcgtgtactcaactgcggccaagtgacaggcggttgcgaactagaatggcgtccattcggcgttccctaaccccaacggagttcagtccttctatttctacaagagttttctagagaacccctcctccggttgaataatgggatagcaaagccttctagagacttggctgtggcatgcctccgtcagaaatctctctattctagagatcagcgacagtgtgaggctgtctgttcaggcagccctcacaaatctgtgtccagcggtactgtgaagaggcaagaacccattgtcgaaacggcgaaattccaagtttatacagctgtacaatcgtttgcgtctgggtatcatttctcttttttgttcgcttcgttttcctctggtgcaagggcgcttgcccgaaatccgtactctctaaatctgtctatgcagcgacgtcaacccgccaaacgcgcgaccggcaactcgcggaacgtgtgctcctgcccgggtgcttctgcaatgcttccttgctgcggttttacagcgcttctctctgccattttgagtcgagttgagagccacaactaaccctcaagctctagaatgtggttacctaaagagattttgtcgtctctccacctcgatcgtctaccaggaactgcctaggcaaatccgcggactccgcgttcttcgtttgttggtggaggtagccttcacatttttagatctgttttcccttagcctacctttttctcggatcttcttgaatcactagctgggctgggaacgaaatgttgttttcatgtcgtgttgagtccaagaccttcttacgggcctagccaggcttcccctggacccggatgcgcaggctggaaaccgaggagcacacccccgcgtttctctccgtctccgtctctctgaaattttcggctgaattcgattttcgctctcaaagcgactaactttgttgcagtccttggtgactgcaagtatgaggagcgttttccttccgcccaccctgttggctttttcgccgttctccggcctttcaacccggccttttccggatagcttctcgcagccttcctagctgtacgtgagtgccacttcttctcgcgtttcctccgggtcgtttgccaatctgtccaaaaacgccatcttgcttgccttcttccgtgctacaccattttcagcctttcctccccattgacctactattcgttttcccctcgcgttaccagatctcgtgatcccgcacgcagaatccaacctctcgcccgccccccccccgtctgca

SEQ ID NO: 3320 - DNA, 4829 bp, Toxoplasma gondii
caactttcttgcgggccagacttcaacagctgaagtgtcaacgagccggcgctgcatttagagggtcttgaaactcccagctggggattggctattcttctgtcaaccgaaatttgtaaaagtctagggtagcaccgctcgtcggcgtcagtcagttgctgatcagcgattcactcgtgtcattcctgagatgtgcgtgtacgctcctgccgtgatcctaacgatctttggaagggaagaaacaaaattacgaccgttaaggactgtcgctgctcgcagtcgtcactctgttgcttcgaaggcgccccctggaccctctgggttcttcaaaacacttacgtcacggcctgcgcagcattggttccccatcttctctgtgtgtttgatgcgttgtgagaagtgcggcgggcaatatgaaccaggcaaattggccgaagctccctctggatcaccgtccctgtccaaacgcgctgtcggggcccctgctctgtcggaagtgagaccgagctggagcctcctggaagttgtgcgtttctaaaaaactggaacgacgactgcacgcatttgcggtgcctgtaatgcagcgacccccagaagagaagatcgaaggaggaaggcagaaaagggtcgggaagattgggtcggccaagtggacgacgaagtgaaaaacaagagcctcgctacgacttgagtgggatgctccaagccgcagaccggtagctagagaccacgacggcagaaaaaatctgctcagagcctaaagacgctttgaaaacaaactgcacaccgtggaaagctacacacactgggtcacgcggcaaagggaggcggcgtggctggcaacagggcaggattcaggctggcgagttcccgggtcctacgcgggaggttcggagcacagaacacgaagtagagaccgacgcagagacgctgtcaggttcagagcaacagaacggcactacagagactggcttgctggcgatacatgtgtctctcccgctcgcgaggcagctgcgacgagtagagatgttggaaggaacgggacgggtttgacctagctggtcagctggccacgttcagcgcagacacacaccgaggagggaaagggagaaaaccacgggaaattgactgaaagagggaaggagggctgtgtttgaaaagcgagacgtttcagagagagccgaaatacaagaatccccagcctgagatccctccttcgcgggaggaagaacgcgttaacaagtgcttgacttcgagagacgaggcaaagtgcgacgaggaaaaactcaagaacgattcacatgctactccgttcaactcaattcatcgcaccaggaaaatgtttacggagacaaactgaagttccttcacaagctttctgcggtgatctcgcgaaagaagtttcaccctcggcaagacccggcgctctccaccgaggcagccacagaaaatgcgcggaccctgcgctctcaacaaccgttgcagtggcagccgagtatcgcagccaagtctgtggcgtggctcctcgcttgtgcagtttgagaacaaagtttcggtcgtgcacgaaagatgaatctcgtacacgtttgcaggaaaccagccgcatctgacacgatcgatttcgatggtgcaattgtttctcgcgggttcaacagtccccgcgggacgtcgatgatggcgctcgatggccgcgcacgtgaccgatgaggtccgggcaagaacgctacaccaggaacgggaaacttttaaaggattgcgccgacaaagacccaaagtgaaatcatgggacagacacctacacttgcagagagtctggcgaagagagggctgtgactggcgcgcacgcaagtcgatcgtggaagcacgtcgcaaaacatgctgccacacaggagtcatgccgcggtatgcagacctctgggcaattgtaagtgctctttgcccctgcagggtcacggcgcgcagcccacaacaagagaggcacaagcagcaggtgacttttgcacatctcggtcgttgctcgcatatggtagcaaaaattgcgtggcgagtcgaaacacgatgctgcacagtgtgtgggaaacgggcacgtaagtgcacttcttcccgctgatacgtacgatgtgagtccatcctgcctcctcgaagctaagcgtgtgcactgttttttcacgaacgcagggaaaaatgactgggaggggggacgcgggcgccgtcggaccctgatgtgctggaaccggaaatcttttgtggcgtccagtcgtgtcaggtcagggacacacgcccatcatcacgtattgatgcagtgggtgtctcgttaagaaaccaacggcgcaggtagcctggtaggcgttacgtagttggtagtgaccttaacagcaaagcttccgtcacatcgacatggtccgcgttcaacgccgaaaacatgcaggtcccagacgagcaacagtctcatcatagcaagccgcttacggttgttggcatggatcaggaccaagatccggcacagagtaatatcgctccgactcaccactcaagatctgacttagtaccgctaaaactggcggtgtataaacacccagagaatgcactgcaacggtgactttcagatgcgaggctctgtgcagatttctacagagttcgaatccagtaatccgaaacgatgttggtccatgaataaagagcatgccgacggcagagataacagtacgtcgcgccactcaaaagttcatttacgtgctgcggccaaagatttaacggctggtctacctacgggttggaacaaaaggcacatggcgtctcaatcgcagaagagatgtagtgccacgtgtgctagtggaggctggaaacgcctgctgtcacaattacgtttctgtgctgtccgaactactcaacatggaagctgacgattgcttttaatgttaactaactacagaccatgggagcgggtaatataagatgtaactccgttcatggaaatcaaaggaagggagatgcttctacaaacgtcccgcacatctcgggctgccagaagtggcctaccggaataacatgacaggccttcagcgacgacactttccgcaggaacgactgttcctgacggacctgctctgccaaaccaccccagagggtcccccacaatccacaacaacaccatgaactatcaatttccaacgctacagattggtccatatccagcacattctaggtgtggtccgttcctcggtgtgtgaagatggatcctccgccatggaaatagaagtcctttgtgtttgtttcccgctggcgaaatcatccacctataatggcagagctaaaatcaccaaattaagacgtgatcaaggtaccaccatatcgtatattttgttcaccgctacgcgacagcatatcagccccccatcaggcgaccgactctttcatgaaaggccacgagtgcgcacggaactcgaacaagatggttgcctttcgaaaaaaccatattctgagattcatcagctgattaattcagtatgttacgagcatgcgcgacacgttcgcttgggcggccctgtcgaaatcaaaattcctgtcgtcaacacagaccccccgccgctagagcagaccacaaggtgatcctcaaagcaaatagacgtctatccgttgcttctgcatgatccctttttctataggggctgtgtacgcaatacagacgatcaatttcgaacccccgggctgctaggggttgttgcttccgcgcctgtacggtgcctggattgtcctgcctgcaaagaccacgaaaacactcgatatgttggaaccttcaccactctgcctggctttcaaagcttctacaccttcgaaatgtggtttaggaaccttcacctatgacttttagtaaacatcagggcgggtacctaaaccccgacttgccgtagaggggcggttctctgcaatggtacaggaaaatcgggggcctgttgacgtttttcacgaaatttgtataccagtgtgaaccgtgcaagttttctgtgttgtgttgggcgaaaaaggcctctccacaccgaacttaacgcggtatgaagttcccgaatttgtgccgggacagctgctattctgtaaggactggaaattacccccgggtcgacggggtagtgaagacaggcagaaggccatgcgcaagtttcgggcaacacaccgggtgaaggagagcttagcacgattgccgccgttcgacacgacaggcaagagcggcgcgtcttgcatcgttttggtctcaaagagatttcaaggggaaagcgcttactctttacaagtcgcagttcgctttttccgtctggacctcctcgagttttcacgcaaaaaatccctttctgctctcgaagcgaggaggctccacaggggaggttttccctcttgcatgtgatcggactgtgggcgcagcgaagataggttctcctgctcctctttagtgttctggttgccctcacttttttccgtccgcgaacagactttgtcaactttgtaccaggttctctcgcagttctgcccttcgtggagacactcggggctgaaacctgcgcaaaaaagctacgcgtgtcaacacctgttcgacgtaccgccggacggcgactgcgcgcaaaggcaagcagggattctttgttggatcactccatttcttcataagtttgtatctcggtcttttcctgtcacctttttctcgccttcgcttgcgcccggagcaaagcgtcgcgcgtggacgttttctgtcgagactctcgcgcgcgctgcagccccgttgctgttcgtctgtcgtgacgccccgatctctcgcttctcccctccctcagtcccga

SEQ ID NO: 3321 - DNA, 1911 bp, Toxoplasma gondii
gagagagatacaagaaaacagtgtgccgaggaacagaactctacagaaaacagaaaagaaggcgcagaagagggagagaaggggggggagtgaaagagggtggagaaaacaggacgacagacggggaagaagaaaagaagaaaaaggaagaaaaaggtaacatgaaataagacgcaggagctgggcactcagatgtcgattggacagacgagacgtcgtcgccacgaagagaccggggaaggccagcagacaagagagaaagaatgacaagcgcccagggcaagaagtcgttttcagacttggaaaagaggaagagagttacgacacggcatttccctgattatcgcagacctgggtcgcgatccatcgagcagaaagaactgaaggctaaaaaactactttccttggcgcagattcttcaccagatctgacgagacactttccgttccccttcctgacaagtattttctcccaggaaaaacaattgccacaacatttggcaactcgctgtctgcttatcggtggtatagggtttacggcacttgttttccccgaaacgaactacgaggcgctgccaagcacggaagacgaggagttcagatgccagcgcaaactccggcaaacatgggtgttttctaagacggaggccgagtgacaaaagcaacaaccacacccacttctcagagcatctttccccgaaagctgttttgacacctgtctacgcagcccctcaccgttcgcgagtataaaggggaatgtgagaagcaagggccaaaaaagcaggaggtcaaacacgaagaagcgcggaggaacggcaatgtttcagaggcagtgtcgcctcctttcatgacaggagcgtcaactttttgttctcgcgaagtcgaggctgcaaggtcgcaaactgactcgatggttgagaaacgtgtgaaaagatctgctggaagtgtttgagcttccagaagaagcaaggtttgtggggaaggcattcgcgaccgcagtatttggtccttcgctgaaactcagacactcacgtgtcgttgttgttccttctttcgtgcccagacgccaacttttccgtctgccgtcgtctcacggcgatcagctgaaaatgacagagttcgtggacgggtctggcgagcggaagcgtttcctccgcatacgctcttccgttagtccattggaccttgcatttatacgttccctccgtagaaggcagctggattttccctgttaaaaacagaaactcaatctacgccgcctgtggaaagtcgtgtgtgtctgttagactcagtgtgctgttggccggccgcagcctgcccgcaaagattcgtgcgcgtcgaaaaagaccccccgaaattgcattgcgagtcttcgctagtgaacgggctgaggtcggaggcacaacagctgcagacagctgatttcccgaggtggaatttagtcgaatgggaggctgtcttctactccgggtccgtgtctcccaccgcacctgttactgtttcctaagttgaattcacagccgcctgtgccgggacgctgctctctggagccaccttgagacggccgaaaggttctttctgtacaggtacactatgagcttgtgttcagttgtagcagctcgcttcgtgttggtgggacaccgagcgctgcaacgcgttgctctcttggcaactactgtcacttccaacctcgcacccgacggtgaaagctagacgcagaagtcgtgttcgtttgctcggtcaaattgtgctgacatcactcagcctataccgcgtgcttcgcagggtctgtctctgaaaaagtaggataggatgtggagtgttcgttgattttcggggacagcagacgaaaggagccgtatttttgtgtcgcacacgctttcctcgttgggaccttttttctgcgtcaaaa

SEQ ID NO: 3322 - DNA, 1947 bp, Toxoplasma gondii
ttttctctgcacacctgatccgcgatccaaatctgcttaactcaaacattttagtactgtggacactgaatatatctgcagttatgagaaacagagaaccaagttctttatcactgctatgcaccaccccgctggaccgcttagcagctaaatgtgttgcatttgaatattgtgcaacattaaggttattccacatcactcgtgctaacagcgagagaaaactactactcatatgctaatcgagccactgcggctgacagaccgtcagtggagtgacgtgcactttggaacagctatttaccatgggctggaaactgcatataaccggtgtcaaaatcgtgtgtgtactcccgcttaatttattaggcatacaggaggtgcgacatgatgttgcgagaaccagaccttcacaagcctagagataccggaatcgaaaccagaatgaatatgcaacagtcaacgatgttaatcctaatgcgtgtggaaaattgccgaccaaccggcaaaaaaatatcgggatctcgcgccagcgttcttctggtcacagctctgagacacagtgtatgaaacgccgttcaggttcagggacagcttagtgttcagccaattttgtttcccccgtcctttttcaacagttctcatgtatcctctcgtgctcttgtattgtgtaaaatgtaaaccgaatagctgtgtgcctttgtgcccagatgggcaccatacagtgaatgaaaaaccggcctcgggatttattgcagattgaacgctcgagaagtatatcgtttccctgtggcgatttcacacggtagaaagttaaactgaccacattttagaactgagttggcaactgcaacactctgcagtgagcaggatctcagttgaaatggcagcaagcgaacgccttgccttcagtggcaaggaccgtgttttctgtcccggaatgttttcaagttgtcaccggatttataatgtttacgacttaaaaatgaagttcaattttgggtgaaggaaactatagatccagacatgtataatagtggctcctcaacgtgccgtcgaccgccagtgatcgacgctcaagtaggtgcaaattgcacacccactgccagggtgcaacacgtttcagtcatcatacgccgactttacactaacagcaacatgtattatcaggagaacaaacgttccacaactgcgtggggtccatattgcgggccagaacaatgtcttttttcatagaattctggtggattagaacgtgactgtgtgttgcactgcgctggaacgctgaggagagtctgtctacacagatcgtccttcccctgtcgacattagctaactctatcgtccagctgttttctgtccgtttggtttcgtaggacaaatcgagtccgcgtgatttgttgagaccggggagtaactcgtttggagatggtgttagaacgagacaaactccactcctgaacatgcatgactgcggtcgccattcctcaagcgagaaaagtgttacctcttgtgttgatctcgcaaattaatcatcgtcattctgttttccttagacaagatatgagagcagtgttctcgttatgctccttttccctaccgcgtgctccgcttttgcagttcatgcgtcgcagcaggcctttgtctcttaatgtgaccaaagcgaccactggacgcctcacaccttagctcgcttgttacagcaataggacacgtgctttcctttgaggtaatatcatattgctttcgctgatttctagcggcagaaggctgttatggggtgcaagtctgacttgtaacaacttggagatcgacgatatctccttccagatcacctccgtgtgcctgaagcagccgtgcaacatcttgcccttgcagtagtaattgtgcccctcccctgtcgagtttttcttcgcaactgcaacattcgacaaggctgcttcgtgatca

SEQ ID NO: 3323 - DNA, 1938 bp, Toxoplasma gondii
ctttcagaggcttcttcacccacggaatccgctacgctggaacccgcaactcccgaacctgcatgcacctcgcgggccctggcctcgagtgctctctcggtcaagtaaaccgcaaactccgtggcgccaggcatcatgtgggggaagggcgactcgcggtcgctgcatgcatcgacgttgaaaaaaactgcatgtggcaggcgagctccgtgcctgaactcccgcaccgcatcgcgtccgccaaagacgggaaggtccgaccaggaggcgtcgaagatgaacacgcgccggtctctcttgggaggctcctcgtgaagtgtctctgtggctgtcgagctttgtgcagattcagggcggtcgccttcgtgcctgtctctccttctgcttgcgttctcggcgagacagcgctggataaaggaatagcggccagtggaagaagcgatggtttcgctctcttctgaggagtgccctctggacgtggcgcatgcatgcgaccttcgcgtggcttccgcaatctgcgctcggaccactgaagagccgaaacgcaaaagaagagccgcgacctccgcgggactcagcaccactggacggacagtcgggaaacatagacgcgccatcgtcagagaaaaggagaaaattgcttcagaaaaatataaaaaagaggctaacagacttcgggggaagagacgcgacgggacggcagagttcgtaagaagggcgtgaagcgggtcaagagacacccgagctcgctggtccaggtgtatgtacacttggtcgtaggcgcgcggcgtaagctttcgacgccagacttgaagaaatgagaccgcagagaatccatgggagaagttgtcgtctgcgcggtccaggagaggtaaagcgaagaagactgcggaccgtaagacctggtgaggtgtatttgcatcggctcaagaaaaggcgagtgcagaaggcgtaggaaacacacgacacgaggaggagcagatgcgaaacaaaagagaagagaaaggagctccgcacatggcgatatctccacatctggacactctcttctcttgtataaagcttttaagacgtcgaggttaagtctcagcagcgcttgagtcttgtcggagacacgcagccacaagtgatcagatgtccgcagaaacatgctcatatatagcacaagtgagcttttacagagataaacacacgcgtacgtaaatatacgtgtacacatgcgtttgtgtttctcgtttctagtgcacggacagacacgtgcatgcaggctggctgtttagaaagccgtgaaactcgcgtcggcctagacaagcagttggcgaacttttgactgcaagtcgccctggaaaccggaaaccgctcctttcccagcacaggaaactcaacaatgatttagaatttagcacatctgcaggttacaaacacaccgaagtcacggagttgtgtttagcggtcctgacacactcatccggctgcatgcgatcagttgccacagcgcacgagacgactcgaagctcgcgcctttgccttcggtttccatcccggaaaagatttaattaacatgccatagggaaacgttctcacaaacacaacagagtactccttttcttggatgcggccgtcgttgcacacgaaaagccagcacagatcgcggctttcctggtctctacactcaacagtatctcaagcaccgcgtgggtctctgcgccggtccggggtgcggcgactttgtgaagcgcggcttttttttgaaaggcaactttcaacttgtttgagggagctcgtgttggcacataattgtttctctggacggcgtacatctgcggagaaaggaggcagaaagaccggaggtgcagaagggaccaaagcagagcagcaagcgcgaggagacaggggtgtcggctcccatgactctccggcgccgcttctcgttttaaa

SEQ ID NO: 3324 - DNA, 3242 bp, Toxoplasma gondii
cttctgattcagtcttttctccattttcttccctcaaaggcactttccggggccgaccccgtcctctctttggaaccgtaggattccatacacctggaacctctgctgcagtcggttcctccccctgtggtatctcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctccagtcggttcctccccctgtgacatttcatccactttcacttttcgaggccgaccccgtcctctctttggaaccgtaggattccatacacctggagcctctgctgctgtcggttcctccccctgcgacatttcatccactttcacttttcgaggccgaccccgtcctctctttggaaccgtaggattccatacacctggagcctctgctccagtcggttcctccccctgtggtatctcatccactttcacttttcgaggccgaccccgtcctctctttggaaccgtaggattccatacacctggagcctctgctccagtcggttcctccccctgtggtatctcatccactttcacttttcgaggccgaccccgtcctctctttggaaccgtaggattccatacacctggagcctctgctccagtcggttcctccccctgtggtatctcatccactttcacttttcgaggccgacctcgtcctctctttggaaccgtaggattccatacaacagagtcttttgtcggtgccttgcgcggtcttcctctcccgcgcttgatgggtgcaaaaggtgtcaataggcccatttccggttcggcgttttcgtctgccgtttcgttccacgatgcggtgtcgtcaccgccactatgcccgccttggatttcttctgctgttctctttcgtcgactgggttcgagagggccggttggcggctcgtctcgcccacggacggttgcggcgtccgtttggcctggtgacgaagatgcggtcggctcaacaccggccgcatcgaccttcgagtcgacttttctctggatcttgtggagcgtttcgcacgccggggtgccaccgctgtcgtccggtttcctgcgttgctcgtgggggacttctccgcaaaagcggggtaccgacggcgttttcggccgagcggcattcgacgaagaagcgggagaaacgcatgtttcatcgtctccctcgctgccaagtgcccgactgcgactggtgtcccgctcgcgccaagacctcgacgtcgcgtcactcgactctcctgtcgctccatgatgtggagagtcctccgagggaagagaatgcggcagtgccgggggaaacggtccgttggactccttgtcgcggcctcgcgctggcaacgccgaaattggtcgcgtgggatcggcgcctcgagtaaagcggcggaagaagttgaagctcgtttccatcgcgtgacatgaacggaagccgagtcggactcaacgaaactgtgttgtcggggacctcgcacacctcctttctaacccccttccccccttcaccactttcctcgcgcttctccggcttcccgccaggtcacttggcctctctgtctagagcagggaagggttttgggcagtcttcccgtttggcttcttcccctggctcaaaaaaatctcaagctgtgttcggggactcgcgtcgttgtcggtttcggggaaaggcgagaaaggagaacgtagaagacagccgggttcacacgctggtgtttctaagggaggcgccttcgacgggaagtgtcttttgaccggggacgcttttcgaaatggacattttttcaagtcgaggctccctaaatagagcgccaaaacccgcagttcgtacaggacgtgccgtctctcttttctgtgcctcagtcggcaaagccaatgaacacaggaaaaagcacagaggagctagatcgtgaggcatgtcacctctccacattgaagacagcagggataaacgggaaaaagcggaccgcgacaccgaaagacggccaacacgcgaaaacatcacacgtcgagggaaaagctcgatttttttgccgctgcgttttttctttctaagcagcgaacctgtagcgtcgaaaagcaggactagtggcattcacgttctggagaaccaacggggttcgtctcatcgtccccccaaacgagacattgaggtgttggctgaccccgcgttgtgcgtagccgaaaggcggtcaagagagacgggagactcgaactgcaacgggaggccgtcgcggaggaacggtctctcagtgcagcgctaaaaggaaggaaaactggaacagggatgtctacggggaagcaaatggtggcataaaagaatatagtgacggcgacggctggggggttcttcgagaactgggagccttcaatgcgtgcactcgaagacacgacgcggaccgtttattctctgtgggaaggaaaaaacagaactgtggttctttgctcgctcgctttgaatcctagatgcttcctagtatattttttacatgtggacggcatgcatctccatctgacatccgggatgaggacactcgcacatcagcagaaacaacgaaataacctgatgaacactgcggtccagaaagcctccaaaagacgcgattctgaagaaccaaggaaagtcggtgatgcgttgaagtgggattatacagtcatggtagatgcactacgaatggtgcttctgtggccaggaaacacagaaaagaaccgccgctaatcacagccatggtcgtcaactaacaatttaggtcacatccttcgtagtcatggtaacggccgtctctcgcgtctgatcgctttcagcctcttgtacgtttctttgccttcttaagaacacattagtcgtcactggaacccggctgtgagctgctctcagcggacgtgcaacttcggttccccttcttgcaaaaga

SEQ ID NO: 3325 - DNA, 1376 bp, Toxoplasma gondii
gagagacagtcggaaacgcgtagtctgaaacctcccaacggtttctgcaatcaaccttcatcccacaaaattgagactctaatttaaccctgtacaacacacggattcaccactcgtttcatcgctgattcggtacgacttaactgctttactcattttcaagaaacatgaatttgaattctcaagcggtgacggtgattgtcgccccagctctggtttctagcacgaacaacagatcctagatccggttgacaaacacattgaagaaaggttaaaccgacaggccatctcggagcccatgcgtttcacggcgaaaatgattaacggaggcagttgcccagttttctcctggccatttggaatcctagatctccacagaacggaaaggtctggggaggaggagtcgcccttcgaggactgcacattaacagtcttcgacgtcgatcgaatatgcgaatttcaggtgcccttgaaaccctcctgcacaagggaactcggcgagagtgcattttcgcttcacatatgtgttctcacttgtcttttcagctacccgacatgagtacatacaagcatgtataatatatatatatatatatatatgtatctatttatatgtatatatatatatatatatgcctacgaaacgcttggatgagtgaaagcataggaatggagaggtagacagatgcaggtagatcttcgtcgatgtctttcttgtactgcttcacgtttttctgccgcgaagaccgctctgccgccgcctgttccgcgtgcatgccgccgtgcatgcatccgctgtcgacgttgacatcttcctcagtttctttgaacagcgctggaactcgagcagagattcctcttgccactccatccttttgtcatcaacgagaaggaccgcatttccctctagaagtctccgcgtttctgctgttccgcggccccgtcttgcgaggtatagcctcagctctgtgtcgccgagcagcgttttcttcagttcaaacaactgtagagcttccaacttccgttgatttctgcagacgggttttcaccgtcacagagtgattcacttcgtttccgttgtcgatttctttcaaaagtgaagacgtttcttctgcgtctcgaggcgtctccgccctgtcgcggtcggtctgcatgcacggcctctcagctgtttcgtccgcgaaacgcccctcgaatcaggattttccgtcgttttcctcttctctttctcgtcctcggtatccctctgtttcgctcgcggccttccgactcgtcgcatcccaggcgaaacgcgtctgctctgcacttcctctgcgaaggtgaaaacagtttttggagctgagcgacaagagaccgagaaaaacttttctccacaa

SEQ ID NO: 3326 - DNA, 2560 bp, Toxoplasma gondii
  misc_feature (1519)..(2110): n is a, c, g, or t
ggacctttcagcagggcttttctggtgaggcagaaaaagtgataaaggacgtagcggcaggtagactgatgctttgggggaacagtgagaggggaggtgactacgcgagcggtgaacgaaagaggaatgcgaaaacctgttgaagcaggaagaaattgatggacgtgtgagacaggaagcaagccaaatggcaagcgtggcagaggtacgtctctcccttgttactgttatgagtctctcgcagtttccttctatgtccagaaccgcaacatcatgtttagaactaccaagctagtgtgttcgagcagagtatccgatgttgaaagcagcggcatccaaaaacaatggctggttactatgtgtgtcattcgttatttttctgtgttcgttttccgccagggggtcatgactgcggaacgtttaaagtgggaacgaagtaacgaatacacacgaagtgtgaacaagcagggtgtgacggaattgcgtagaaaactacctgtggccatccgaagaagatgtctctcctctctcactgctctacgttttgtggcgacagacaagaacgcaacagcctcattacggcagctgtaacagtaaccgtcgggtcggtggtcatgaatgccacacctgcgcggagggcagttagagaaataatgcgcgcgtcattcacgcgaaaaaacgaacaaaccgggggcatctgggaaacgcgaaggtggttcgaaaggccgaagggttcaacattcgggaatccagatgtcgaggtctcgacttttttggggccagccggccgctcaacatgccaggcaaaggcagtcgaatgaacaacgacgcatggctgtctcaccatatagttagtagagacctcatgcacggtgaggcggtgttgttgccgctctgtcgctccaggtagaatttggaggtgtgccagacgaataggccagaacgccatagaaaaggagggtaacgagctgcgcaaccagttcgaggggctctttcacggtcccttacagccctgtcgagagatcagagctctgacagcattttcctgaactcgatagtcgattcagaaaccgaaaccgaccgtggtggggaggagtgccgaaacgggtatgcgggaccaagaaggctgttcaaagacgaagtttgttcggccggcagctacgctgcgatccctggagcttctgtaccatcgtcaggcttctacgctgtttgttgccactctcgtgtccctctgttcctcttctgattgccacatcattcggggtaatgtcgttaaaccagtcttcagcgaaacgtggaagggtgatgtgggcatgcaccgggtctcatgttttttgagtcagttggaatgggcaatttcacatcctccgatcgttttctggaaagatgccccttgttctacggccgcagggatcctggaagactagcgaactacgtagcccattgcactgatcagcctgcccttctgttcatgtcttctgctgcagcggcaggtagcaaatcgtttccttatatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccttttcaggagacgtagaggagtcacagattcgttcctgctgcagtgaggctctttgaagatatgtaccccgtcgaggcataatggacgaagccgacgtccattcttcctgcgtcctggttgaccgctgtcgctgtctcgtgggaattgccctacggcgttttgttgtggaagtcgctgttcgttagcctcgtatcgagtctacggttccccgctcagtcggcggccaatagaaacacaaagaaaaaccaagagtcccttgaaaaagggaggaagaaaccgtcacagataatcttctctgcttctccgttccttgctgctttctagattctgtcggagcgggcggtttctcctcttgtctggcgcctcccctgcatctcttccaccactgtggagcgcattgttctaaccgcgatatttttatattccgatgtgggcaaggcaccta

SEQ ID NO: 3327 - DNA, 3833 bp, Toxoplasma gondii
agaaactagagcggcgagtggctgcgttaagacgacaactcgcagagtccgctgcagagttagctaggatttcagagaaagaaagtgagcagaaaggcgacggtaagtccgagtccagtaccccgtcggagaaaggagctgacgacgacggggatgcggatgactcgctcgatgccttcatgaaaggcgtcgaacagtcactcgtcagtcaggagaaacagaaagtgaaagagaaaataaagactctgaaggcggaactaaaagacgcgaaacgtctccttgcgttcgcgaaggcgtagaactgtcgaaacaagccaagtcagggatccaaggatcagtgagagagtgcagggttggtgtcaggcggctattgcggataaaagctacagacattcgtgtgtcggcacacacaagctgccgtatccatactccagcgacagttcctgagagtgccgtttcgtcgattgtcaagtgtcttgtgtacagaaatcgaagaaccgaatcggcacacgtttggcattgctgggggacttccttgtcacacgggaagggtgtctttctctggtgccgctgccttcgcgataaaaacgcagcgaccacgagcttctcaactcctcccggtcacatgaaagcgcctgcgaattcacttctacgttcacgattcggtcagagttcttcctaccacagagaaaaatgcacgtcgatacagttgacacacacgcataaagtcctcaacagacatatatatatatatatatataaacgcaaacagcatacggatagcatacgcacgtacgcttgtgcatatatgcacatctaccagagcccgactgcataggggttagcgtctagcactaaaaacagttcgttggtaagaaaattgctatctggtcagggtggtgactgtctcagaatggaaccttcggagcttgtggccgtctgtagtttccgatggttccaagcaaccctgtgagacgacagaaagatgcgaagatctgaacaacttcaaaacaaggtaaagatgcaaaggacgaaagaactctctttaaaatgtagtacagatacaaagacaggaagagctttaagaaaagtaaagaaacgaaaggtggaacaactatagtgacttgtttctcaagcacacaccacattcccgccaacgaccccaacatcgagtgcgctgccactcatacgccttcgactgaagcctttgaagtctgccggggtcaagccccaggaacctttttctcgtgacagcagcgtcgaaactcttgcaactcctcgcggcacttgcgccagtctctgaagaaagaaacatttgcatcggaaagcatgaactgcacggaactcgccctaagaagtatgcactgcttgtcacaactacacggcgatatacctgacaccctcaacaaacgtgttcggcttcgaaatgcatcagtgcacaactccaatacgatacaaatacaaacatgtatggatatatatgcgctttgtttctcttggtcgagggatcattagtggaaggtcgaccgtgaacacacggctacagaagcgatgcagccgtgtaggttgttatcgcacgccttcatcgtttcacagcagtgagtttctgctttacagtctgctgcttcaaacccaggcgggcctgtgtcacgagagccgcagtgacactgaactttgctaatgtagaagctaagagcagtacgagggcagaggccgcctccgaactttctgtaaccaaaccacttacttgtcctgcacatcgagacaatctacgagccggccatacggctcactgcagccagttcgctccactttgtcatcgacatcgtctccccagtacttgctcatctgagcgcgactcgtgggcgcacttttgtctaattcgctctttgttgtgttctgctttacagccacatgtgcggtgactgccacctcttttcccctggggtcaaacgcaggtttcgatctcgtatcgttttctgaagccatagttttctacgcaatttacagtgccatgccttccgttcagtgactatagtctgcctttcagcgcaggattttctgtctcaactcttgcagcaacgtcaccacctagcacgatcaccaacgaggaaagacagcgagcgtagcagacaccaaagaaaaaaacatgacattcaaagacgggagaggtcgtttcttgccactgctgcttttgacacgaggagcccacacatagacttgaagtttccggggtctatgagtttcagacaaacaatgacagccgacgctcctgcacacgggcgcgcgcactgtgagcgaaacaatcgaacacaaagaatcgacctatataacaagcggcgaacagactttctgtcactaagtcgtcaacatgaagatcggaaggatacatagggcaacaacggtaaacgggagaactctctacagccacatcctgagaggcttgtatgcgagtgttggtgtctcagatgcacactgttttttcgggcgccccagtctggatattctgtggagcatatgctgaacttgtctgcggaaaaacggaagttctctgcaaacacaaatattgtgtgcatagttcttcggagacgcgcgtgtgggcaccaaacagcagcaaacaaagcgtacccacaacaaagttcgctaagtgtgaactctgctgagagcaaagaatacgactgagagatctacacaggtcccgccgaatatgacctcgaagacgagtgtacacggtaagcgtttcgcgaggaaaacgtacacagtgctctgacatggatgaaaaacaagacctcgatcctcgcctcaacgaggctccaagcagacacacacgaactcgcgcgagtcctcagagacaagcgttgcacagcatccagtttccctggcgtttcctcagtgctattatgagtggaaacagaagaactcgtggacttttccagagcgtcagcgcctcctgttccataagaacaccaagaacgctttcgtagacaccctcgtgccgcagccgcgaggagcgagaggcggctttctccttgggggagcttgcatgcgtttctgttttctggcgaccgattctctttttctcttttcctcccgcacttctcggcttttctggagaccttttcgctgccttccacgtagtaagcgtgtggaaaaggtcggaggactttgcatctcaaaaactcgggaaacatggaccttgtgcccgccccaggagtgtgacagcgtctctccgcagtgggtttgctccatcggcgcgacagccaccgacatttcgtttcggaactgcaacctcctcacgaaccgtctgccattccgcttgtcgagcgtaccccgatgcgcctttctgttcaccgtgcattcctctcacggtttccgacttccagtttcctgccctgcggggaggagactgtcgagacagacgattctgctaccaccaagcctggtgcgttcgctcgctgttctctgaggcggcctccacccgtttgaagccttcagagttaaactcccgcgtttcctgtgttgtatgctctgctccttcctcgagcttcttcgtctcctgagacttcgacgagtccgtttcgatcttcagtcccgacgacatcacaccgccgtcgtctagaaggctggaaagagagctggcaagaagggagtcaggtgcagcttgttccgtttttcctggtttctgcgcgagaggaaggaaacgaattctcgaggacccagggaacaaacatgtgattctctacttgggaactcctgagttgagaacgacttgcagaggaggcttcgctttcgctcaagttccttgctggacggacttgtatgccctggaaaaa

SEQ ID NO: 3328 - DNA, 2592 bp, Toxoplasma gondii
accaatacacaatcaaggcacatgttcttgtttgtttagggacagcgaagcccctttacatttccattttggcggaacgtgctcgattcgtactcgctttgatgtggtaactttgcaaggtcggggaaacgcatgtggctgttggtcggacaggcgttgtttcgaactatacagggatcctgatgccgagctctacgcttactctctccacgcatgtctgtgttacttttgaataccaactttttcgagtaaacgggtgcgaaagcgcgtataatttccgccacgtatgtgaacctaacctgtaaggcaagatcgggactcaccggacatcagttggccactcagaaaccgtgaatggagaagccaaagacggcacctttcattttgcttccatcttttgacaagctcttcagtcagcacaggagagctaaaccgtgactatagttgagagcaagttgtggctggcagattgtcgtgagtaccatcctattcacacacaccacagaaagttcacttaacggattgtccgcaggagcaacattaagaagcaaaaacaaacagtagcttcctagagacgagtgtttgcaagcacgtcctacctatccacgtaggcaacgttgcaaatgggattcgttcgctgtagtagagttgcttgtcgatgaattgaccaaaaggaccgcaaaaaaagaaccctggaaactttccccgaaacatcaaggacctcgaccaaactcacttcctcaagtaacgcttcagagagttatcctaaaacaatttttcgatctttatctcagagtcccatgaggttcagcgttggcacctcaaagcatctgttctggactcggtagtggtctcggctaaacagcctaccgtccacagattctagccaactgtttctaagtactgaggcttcttattggttcttttctgttcctgtcgtcagtggtatccgtaattccactccttttgcttttttttattccacccgcaccttgaatattgtcgctgtgctctagctctgaattctccttgtccgtttggatgcttactgaaatgaccctttcggactccaagaagttacaggttccactgtagcgcttagatctacttcagaagcatctcgtgcacttttctgcttgctagcgcgatgaggttctgaagcatgaggcgactgacaggctcatctgcggacttgctgttaccgactccatacgtgtgctcagctccatcaatttcgagagctgacgtgacgaagcccctaaactgaggagagtatgcacagatacaaagcgcgtccacgaaacgaaaaccactttttcctaatcaagcctttcttctcagaaaccgacttgcaagcgcggtggctgtttgtgtccgctgcatgcagccacgaaaccagagttgaacttggacctgttctgacccattttcccttctttctcacctctatatgattattaattgaaaccgacacgcccatctactcgtttcacctttcaaatggtcgaaaaaggaaccgtgaagtgaggttgaaagaacaggaattcagacatgcagagaaccctccttccaaggtcccttgtatcacgagtgtcatcgggtgtgcttgctcagaagaaagtggatttctccgtgttctttcacgttctcacgacttccctctcttgcctgcgagggacgctggaatctccaccgttaaattgctttggtttgtctgtcttgtcggcttttttttgcaagaaggccttttcgtgtaggcgactctggaatgtagcttgataacgtgcggcttttcaccgtccttggcttttctgctgtcgagtttcccgcgcactgtcaacttttcggcttgaaagttgctttttatttcctcacaagaaccgcaggtgtgtgcgatttcccttttttctcgaactcgcctgttttcacgagaggtccgcaccgcgcgtatccaggaggaaatcggacagccggaacagaggcaaaggtctctttcctgcttccttcctgtcgttctctgcaagcattaaggagtagacccatgaaccgcatctcggttttggttgaaactcgttttggcaactttcaccactcgagctggtcgcatatctcgcgctgggactgttcacctcggagacaggatcattcgtgagttctcgtttttccagaagtcccgaccgagtccgttcttgtccctgtgctttgtccgttttctccgttttcttagaatcctttctctctgtttgctgcaacgcctcgccgggtcctcgagtgtaccggacttttgcggcagacagcattttcgaacaggggagagtcctgacccgtctttctttcttttcgtgagccactgtttcgcgcggatgtgtctccccgaactcgcgacgctgctgtccgtggatctgcaacgctctgcgactcgcgttgtctcctgcactttcccctgcatttcttttcgcgtcctctgccgcaccgcctgccgactcttttcttgtgcttctctgcgaaacaggctctcgctttctgcgagctgcggcgacctgggagacgcatgcggtctgcagcctggacccggctgaagagagaagaaga

SEQ ID NO: 3329 - DNA, 2870 bp, Toxoplasma gondii
tcaaaacatcgactcgtgaccgtgcaagagtgtgtcacacatactgggagaggagactcgcatggagagagaagaaaaggaaccagaggcgactgagttttcgcttcgcctgaaaggggaaaaaagcaaaaagcggctccctttgtgcttggagggcgtcgtgtacagacaaagcgcgacagacgcgtacgaaaacaagagctctactcgtgcgtagtggagggggttttgtgctacctgttgcacatacgtgagaaacggtgagaagagcgacagctccaagttgtcaaaaaagaggagagaaagtaaaggtctgactggttggtgtccgatcgctgcccttcggagctgtctgtgaagcgtgcttctgctccggggtgtctgtacacctagtggggcacacgggtcccgggctggggcgcatggaatggcaaaagacacccagcgtattccgcgattgggaatgccgttgacaagagaaaagaaaaagcaccatacgacgttgaggacgcaaagaaagcgaagatccgtggaggaacctttgggcgcgagtgctcggcggcagggcggcttcacgggttgtacaaacacctctgcaaccgagaaaaacgtggagcgaaagaagggacaagaaaatgagacgggaacgccgcgcttccaggacgcgttctgagtccgtggaatgccgtggacagcgaaggctcgagttctattttgaggcgcttgaaagagaagacagcaaaggatcgatgcgcggagaataacacagatccgaaatagaggcactttctcagtttaactggtagtcacggaaagaacagaaacccccgtgttgaaaaggagtcgcgcacggcttgatgcttctcgtacactttcccgtcccggggaaagggtctgggcaggtggatgccgagcagatgtatgtacgagagaatgcagagagctcgaagaagtctcgtccgccctgcagctggccgagaaagaaaggaacgggagcggcggcgactctgacgaacttcgtgtacgacaaggctacgagaaaaccagtctggggcggtggcctcgaaggctcctcgtcggactgtgcctaacagccaagacagcgcgagtttctcacccagaaccctacgcttttctctttccacaacgcacatacacctcacgcatcgtccactaactgcgctctcctctcacttgtcgcaagactacttccttccgtgcggagccgcgccggcccctgtgaacgcgtacagtccttagaaattcgccttttcttgccagaccgagaaaagaattctggaaaactgcagcgtgcatgtttcgctttttctcagctcgacctataccccagtgtcgctgtttgaggccaacacccccccgaccactcccccctttttcaatggtgtcgtgtgcagcccccgaatttcccctgtgtcgacggcaaaacccagcacctcccccctccgaccgtgtcgaccactctctccgccctctcctctctactggcagctcggaaccgcgaccgctgtgtacacccgagcttctttcacgcaagaagcctctgtcgtagcgccctgtttcagaggccggcgacgaatcgaaaggcgcgaaaaaaagcggcctctccgggtggtggcgaaaagcagctgtgagcaaaccgaggtcttcgccaccgcggaccccgccgggtgtatgtacaccctgctagtcgctacgccaccctcctccagtgtgtctggcacacatggcgactggcgcgtttgcgaggaaaggcatcgtcgagaaaagtggagtgaccaaaaaacacctgacactctctctgtgaaaaagtgtctgttttgaaagccgatcgcggcaggaacgacgtcatctttctgccgtgggaggtggtctggctgctgggggaactgccggacacgtcgccgtttccgtccctcctcgctcccgtttccactttctcgccgacgtctcacgtcgcttttttggtagcaacatccgcggaaccgtctaaacgtggcgcacttttttcgaagacgcgccacaaagaggacaagacaaagcaccctgtcagtgcctccgagcgcacacccgccaaaaatcgggagaaaacagtcgcgccctcagctcttgcaggagacacgaattagcctgcgactcctccttttttgcggggtgtcgtttgagctttgggggtggaaggcgtacaaaatagtgtccccagctgggctcggcacagcccgccttaccgtcggatcacaagctagagtggccgtcaactcgactgcacgcggtcccgtgaagccttttttggaagcgaggacaaaacgggcaggcggaatacggatcacgctcttagtacgtcgtggtagtcatttcgaaatacgccagaaaagcagcagagtcgcagcaaggaacctccttgcctctgttgctccgccgttctctgtcctggggtacgggacagcgctgagcttccttctccaagagaatctcgtcctaacggtacaagcaggtatagcgttcttgacttcttgatgctctctcgggtgtgtacttgttacaccgcggcagcttggagtggagctgtatgtacgcctgattgggcggctcccgctccagcgtccccagagtgacttttctgcttttcactctagggttttctcgttttcttctcgtcgcttctgtctgtctcttttcccctctctccccttcttccctctggttccctgattctcttcactctgtctttccctttcttcgcctggacccagggcttttgcctcggcgtctcctcttcttcgcacactccggcgcatgcgcgcggccgcgccggggccttcctccctgtcgacgaccgcatgtcatcacga

SEQ ID NO: 3330 - DNA, 2597 bp, Toxoplasma gondii
gggtttcttgaactttttcgagatactgttctcattccgacagtgaattcttcagcttgggggggggacggaggtttttgactggagagcggattggcgtgccggggcaccaccatttctcgtcattaatgagaccagtgtttttcttcgtttctggtgcagacggggcctttcggacgcggagaacgcccgtctcgagaacgcaaagtcagaagtcaagactgtgcagcaggagatctggagagtggaggctgcttccggtcaaaaataaataactgtgtgcaaactccaacatcaccgatcaccactgcgccgtcattcgcgacaaacgaatgaactcaaagaaaaggtttttaccacagacgaggacggaaaatcggctcaataaacaatttttttgtggttaagtgcggagtacgtccaatggtacagtgttgtttttcgtcagtcgcaacgtcgggaaatgtccaataactctctgtttcgtgtctttttcagtgctcagtccgtcacttggatgctggctggactgcgtcacccctgctcttttcagatttatcagaatctttctgttaacgttctgtctatggagcgccgccacgcgggcttaatatgtcagatgctttcattcggctggtttccgtttacatctagagtatatggagcacctctccccacaagctcgcctgaagcacaccaaatagtcatggttgtggcaggcacagttcagaaaggcaaccaaaggggctgatgtggacaagggcacttccagagcatattaaactcactgcagtaaagctctcaacactcggacactgtgaccgagctcgtttctacgatgcggtcgcgggtgtcttacaccatctgttactttgagaaagcgcggttgctttaacgctcaatcgtctccagaaaaaacacgtagcattcgttgtgctgccacgtctgctactccaactggagtaactacccgatgctctgggttaagcacgttttggctgcgttcgctccggccgtcaggttgtcagcttgttcactctaccatactgagtaccagcagtacccgctgaactgaagaatcacggaactctttcctatttaataaaaccggacgttatgaggctttccttggtgtagtgtcgacatgggtagtggacgtctggattccgtctcgggcgcttagcagtctattcatacgaaaaccgcaaaaacaagtgttcacattccagcagaacatcgcagctgtctccgggactctggtggagcgtcctatcagctggataccggtgtagcgttgaaactggtgaggggctgaaaaaaacggcccgccatcatgagtattgcgtcatgaatccccagcaaacaggcggtttcagcacgggcggaaaaccccgaatggttatctagttgccaggcgagcggttacacaggaaccagtagagtgtggtaactcgagtaaagaacggagaacaacctcctggaacagcagcaccacttgttggaaaaacggagccgcagctacattgaagcactcagatgatagggactggggaagcgaaatggaaaatatctctcggcgaagcattatgctgaaagaggtgggtgaaagaatgcgccattgagctgaagaaggcattcgaaaagcatcgtggaacagtcagtacttgtccccgctccatttgttcgcgctgcatgcgtttcgaaacagctttgcaaaacgaacctttctcttcccgagatgctatttccagtcccgtaccaacaataaggactaaagtcgcgtgacgaaactggttctcttttcatactgtaacatgtagtgtcgggcgaacaggtgagaacctggtcacggggaagaattgtccgcgcccctgcattatcgatgttttttctgaacaaccaacgactttggtctccgagcactgtgtctgtgagtttcacttgtttgttgtggctttggaaagaggtttgccagacggttaagagaacagacctgtagggcgggaccgtcttccagacgtctgttcatgctgctcagaacccgttcgttgttcgcactgagtctttgtgctccttgtcttaaaactgcttcatccgttctctaattcgaaatccaaaagagatcgctttaattcgacttcttagtcggacagacctcggccctagaagacatccctactccttgtgggcttgtaaccacgtcaaaagaatctctgtcgcgttcgctggagattccttctcggccttctaacagtggaatcttgctgcgtccccttgagagagagtaaaacccgtgtcgtaactgaaatgttctcctaaacaggttcatgccttcgtccagctgacaccttgaatccccgttgctccccacgacgtatcggcttaccacatttaaaacccacggcttccgcaaaaccatatttctttgagagaaggccgtcgccatttggttcggaagacaggaaatcgttcactggtgtctcgcgaacgcaagagaggctggaacgccggaaaagcagcagcgtacgtgaagacgggcacaaaccccctttccgcgtgaagtttcaattgaagcttttgacagcgaaactttacca

SEQ ID NO: 3331 - DNA, 2560 bp, Toxoplasma gondii
gatccagtcttgattcctcgcgatcagcgtcgacttggaaatgaggcgagtctgcatgagacaacggacgcgcgaaacaaccaagggggggagagaagagatctttggctatccacatcgacgcagggatatttgagtctgaactcacttgccgagaagactctcgacacgagtcgtctgcggcagagcacccaccgatcggttgatcgcgctgacctctggggtcggccttggagtcctgagaagacgaggaagagccggcggactttctcgaagcgtggtgcgaagaacgttgcaggagaggcgccttttctccccgaggctcatatggagtgtctacaaaaatccccccagacgcgagaaccgcgcgatcggggttgcatcgcgcaggagggagcctgtcagcgtcgcttttgtgaggtcgagagacgtcggtggtccgagtttggggaattcgagtcgagcccagaaaagctttacactccgagctctggctagaaagagtcactgattttcctgaaaaagaaatgatgcgcgtgccttctgggtaggaagcaacagcctgtttgggtcctacgctcgagctcggggtcccatactctggcttcagcgctgagtgttcaacgaaagccgtcgcatcctcgaaagacataatcttcagcgcatccatatctgtcggcgagaaactcagatctaggggttccgagggcgttttcccgagaacaagtgcgatcccatgttccccagtatcatcggtgtactccatctgtctgctttaacgtccacggtgcgctcaatagaggcgccgcggcatacacccagtgaaatggtgaatccgagacaggccggacagcaaacgcaaaagcttggagtggcaggagagtcgggcaggaaagcgggtatgcaatgcagccgcgaaacggtgtgaaagagtttctaaacattcaaataaactcgtgattttgagtcgaaaccggtaagtggcgcggctcttcaggtgtcatccgataaccgcgagaaatatgaatcgcaccagatcgaagtcttcgaaagagacgaaaaaactttgggaagatttgcgcctctcgctgcagaaaaacggtttgaacagcgacgaggacaagggaagaccgagtctgcgaagtgttgcaacaaatcgaatagggctcagtatgggtcgagtgtcatagatttgtttcagcgctcaaaaagaaacgaacggaaagatatgaaatcaagacggcagacgaaaaaacggggcaggtcggaagaacaagcagaaacgcgggaaaaactaccctggtcttgtggctggaaagagtcgcctcaccgcgggtctctatggactcgccatggggggggaggggggaacctgttcgggggctttaaaaatgagaatggcgctttcatcggggagagaatggtcgtaacatctactccggctgagattattggctgcgaactgtgaagaaagttctcgcagcaattccgacacttcccgctcattcgaaagcaccctccagcccgctgctgttgtcttctggcaaccacgcgcgcgtcgggtctcagaaaccgtgaaattagaggaagttttcaagaaagcagctggagactctagcgcgcatgtcgagcgtgacgagaaagctgaggaaaagacacgacgcgagagacccgctttgagccccaaaggtcagaagacaagcagcaggaggcgcccccccccttttcctgcgtgtggaggtggatccttgagtctagaaaagaccaagttcgttcagtaaccaacgggcgacacggcttcttccgtgtcgttctggtaaagaatcattctccagtccatctggcacagagagagcgcgacttttacggttgtcgccgcctcgagtcttagcgacctaactgtaaagattcactccttccataagccgctacactttgcaatgctagcagcgtgccgcccgctgccccgatttctgaacagctcgaaacgcggcaaaaaagagagggtgttaatggaagagcgtcatcctttcgcgggcgtttgtgagaggtggacggctgcttgtctttcggcgcaagttctgggaaaagtcgaacaattgagaaattccaaacacctaggaaagtgccggacgaaagggagttccaggcgtcctgcgcgagcgaaggatgagggattggcgctgattccggagtggtacggattccggatcatttcgtcctgcggttgtcgagctcggtgtcgagtcagaaagtcgcgggaatgtgctctggtgtttaggtctgtgcaaatgttgttacactcgtggtggcaacatcgaattgttccacagggacgcaaactgggcaaagagaactcggcctgttttcgttgtttcccatcaccgcccgccgaccagttgcgtggtcacacacagcactcaggccactgcgtgtacatcgttttttcgttcaagagaagctggcggatttaaaagccaagtcatttgtcttaccgcgcacccttgacgcgagctttgtccgcctgcgactgtctgcaagttgattcgaatcacgaaaa

SEQ ID NO: 3332 - DNA, 2190 bp, Toxoplasma gondii
tttttcttggtgttttgcactgtgcgtttgctcaggtggcccgatgttgaacgcaggctatgcagcccttgtgacagcgtatcgtcttgatgtgattggattttttcttctggtggcggcggacctgctcgctgcgtacctagccacgcttgttgtgaagccgtttgcatgcgtccccgaaaagaagcctgtagctccagcgagaagaaacgtctctgtgtggccggaacaaagcacagagaagcggaaggcagagtagctaagctcgtgccacatacttacctgcatgcacaagtgaacatttggacgcggtgtcagctgcagttcattttgcgccgcccggttcgtagctggatcggacaccaacaccaacaagaagcatttacatggcaagcagcgaagattgggtaacacgttaagccaatccaacaatcccaaaagttaggtcggcaaatacttggtgccgccagaggatacccaagttgcttcttgtacgccattcggcgaagggacagggcgacgtccacagttcagcagaggatctctgagaaaaaagcggcatcgcaaatttgacagggcacagaatgtagattctgtgacagttgaagcatgcactaactgcgagccaagaaaaaaagtggcgacgaagtctggggccgccgcggtctggtggtgtgacaccacgggctctacagctctgctccttcagaactgtatgtgagaacttttattgctgtgacaagtcgctcatgctgcttcgcattgttggtttcgcttccggtcctcattgccgtcatagtgttgtgtgttgtatgttgctcggtacgtggcgggcgctgcactattgcggaaaccgctctccaatgtccgtaggcaagaatacatgatgttgctaggcgtattcacgtgtatctgcacggagtggtattttgcgacgagcgggtgctcacagagaatacacacatataaccgatgtgtacgcatgctcttacacattgccgtcacttttgttggtatgtgaaacgatgtgcttcagagtaagcagtgtgtgaagcttgataccatggcttggctgaactttgacgggtgctgtgttctccagtgtccacggccatctaaggaagtgagcggattacacaccagcccgtcagatgagaaaagtccgttgtacagaatggcattctcaagttcaagcggtgacgctgttgacgcacggcggcagatatttttctccagcgctgctgcgtgcccttgacgtttgcgtgtgagggccgcggttgcgcccccttggattttctcagtgtctcgttttttgccggtaacgagggtgtgagcagtgcgaagtcgcgatcttgtcggagtgcggaagaaacaagcaccacagtgcaggttgtacacatgaagtgaactgtcgtatcctcctggagccataggttgattggtaggcagcacgactacattgcataggaaaggactaaactcgtcagaatacctctttcacgaaggaacacaactatagcagatttcagttaaccgagagtaacggcggcttggaagagacgccaagctctgcgcagctgttcacggagcctaacagaggctgcgcgttgctaacagtgttgttctcatatgcatctctgccgcgccaaatctgtatgcccagaagagcgtatttttcttttccctcagtgtggtcttcgccgcactggcagcaatgcacctcgcacctggctacgctcgtttcttgcacaccgcattcagcaaaaaaaaaagaagcagctagagctcgatagggttaagatcggaaattgagacgagcacacagacgcagacaagagggaattccggctttcctgtttgaggttcaaaaacggcgttttggtaatctgaaaaggcgaagaccggtgtatatccgctatgtctaccagacacactcgagagaaactacagcccttctgtatgtgttgggtttcgccgtctgatgaactctcggtggctgttagaagatgttacgtcaaatcacaggcgcattcatctagagatggtgctttttttttattggccacaagtccaaaaaattaaactgcttgaagccctgacgccagcaggtcgtttttaaagccttcctggagcactcaactatcgagtctattttcaccgcattgtaaaatagcggcgacctccgcgata

SEQ ID NO: 3333 - DNA, 4067 bp, Toxoplasma gondii
gtgtacagacaaagagcgagatccacagggaggtcctcgcctcgaatcgagagctcaagaggcacagtcacgtccacgaaaggatcttctctggcagggccttgcctgctaaattccctcgcgtctccgagtggctcttcttttccgcttctgtcgccgtcgacgcgaccgccgtcgtgttggcccttttgttctctcgctttgtttccgccgcccacggcgctctgcaagcgactagcgaccagcgggaccgacgcccgcagactcgtcagagcaagagcctgactcgagtaaggtccttcgcatcctcctgacagtttcgtttttaccaccacgagcgccgatttgagagcctctttgatgtcggcctttgtaaaccgtcttcgcgaagagaggtttctgcgcaacgaagacatcgcctggacgcttccttgttcgcgggagaacaacgcatgagcgtcccccatctgcacgtccatgccgcctcgctctgtctccttccttccccacctgcctcccccgccctccgctccggagtctgtacactgcgcgcccgccaagatacccgcgccagttcggcgctcgccgacttcccggcccgtgtgttttcttcttcccgtcgccgttctccatccttggccatctcctccatcgtcgtagctcccactgtctttccgaaaatggccttcacagacctcgccgtttgcatctgcaacctgcccagtcatcccagcccccgacgcgtctccatgcggcctcgaggcgccggcagggggagagagacggagcgggagagcgaggtggacgtcgtaaacgccgttcagagacagcattcgtggagctgcatgcaaaactggcagcgacagagaggaagcctgctcggactccttccccgtcgtctctcgcgcctcgtctgtctctgcgaaaacgacgcctgctctggacggactctgggtgtgttggtcagtccgccttcctccctcaacagcgacttccacctgcggtttcgcgcaagtgtctctgctgtttccgccgcggctggctgttgcgcgaccccaaacacaggcgtcagggactcgtccgaacgcgagagcgacagcctgtttcgctgacgtttctcgaggccattcgacgcccacaccgacgtctcttctgggtggctcgcctctcgactcagctggctggagagcctctgcatgcccctcatgtgcggagagagaagaggaagagggctctgaccagtgcatgcagaccacgacattctctccccacaactcatcggttggagcggagaatgagacagagtacagcggcggagcttcgatgtctcctcggatccccgatgtttctctatccgaggagacagagcgttccagagtcccccgcgcaacagctggcgatgcacagagcttcgcagagacgtcttcatgtgcttgcggcgcatgcgttttctgctcgccactgaccataccatgtctcgcgtccctcctgcctccgcctgctcctccaatatgagtggcgctctgcacaccggctgtctctgccgacgcagggggggtggtgtcgcctctcggaccgcctgcctcgttgtcgagggccttctctccctgaccgagacgtggtggatctgcgtctgggtgaacggctgcatgcaaggaaaaaaacgcagaggccgggagagagcacggcgaagtagggaacgagagacgcacaccccagccgttgtcggggtcgctgaaggcctgaaagagaccctgagtggggagccaggcttttccggagggcgtcgggagaaaagtggagaacgacgaagcgatttgtctctgcgcctcgccttcgaagagaggactgaaagcagaagaaaaggtagatggccccgacctgacgaacggctttctgtgaggagcgcttgccaggcaatccggcgactcgccgtgctgctgaaccggggacgacatctgaggtgtcgagacccccgaggagacgcttccctcctctcgggccgcttcaaacgtccccgcagcttcgggtgtatcgacacccgaccaggaggtgatggccgcctccctgagggaagaggcaggtccgctcttcgtcgcggatcctccatggctgctcagcgaggcatttgctccgctggacgacggaaggggagcgggatgcgaagcgccgatgtgcgagcgaggcggcgcgggtgtatggacacctgggaggtgcggagggccggggatcgtcgccaggggcgaggcagacggcgccctgagtgcggcgacgcgcgcagagagacctgcgaagacgaggagaaaggggagccagacgagacagccgcgaaggctgctgagagcgctcgccattctgtaggggagagggacatacagcacagcgcgctgcaggagagaacaccctgaagcggacaaagagcggagccggagaatctgagtgcacagaaaagacgggagacttggcgagagaagcgggagacttggcgagagaagcgggagacccgagacgagccacacaaggcgaggcagccgcctggagagagacacaccacgcgcttcctcccttcttctctgatttctgtcgcttctacattgcggcggaaggcgatgcgttttttgcgtctcttccagtctcccttcgctcggctttctcccgaggagacacggacgcattcaagggaggggcggggggggggggggggcagagaggagaggagaggagagaggcgcggagagccacgcacaagcagcggcgatgaagacgttccgcagcgaggaaaaaaagcagaggtgaagaagcaaaaggaggggaaaacgacagagaacaagaccgaacacgagagctctttgtctccgcctctcgggcgaaggatccctgtctacggcgccttcacacggagacggaaaccggcgagagacggggggaagcgaaacagagaagcaagagcgaaggagacgctcttctgacagaaaaaactcttttacacttttcgttccaaattgtctcggccgcaaacggacaacacacactgctgatttcctctctcccgccgagcgcgcagtcgctgcggcgagaccgacggcgcccttcttttccccgggaggcacctctctctctcgcttggtctctctctctctctacctctatctctctctctcgcttggtctctgaggagccgctgttcctaaacgacgcaaagaagacaagaaggcgacacgaagagggggaagaacgcaggtgagaagaagggatgcgaaagaaaaagacgagagaagagtcgattgctcgttctgggaggctgcttgctgttgaccgacaccacgagaaagacaggcatgtgcactgtgcggccaccggagccccgcgtttcgcgttttttacgggagagaagaacgcaggagaaagcgagagacgcggctttttctcgaagtttttcttctcgcagcgaggcttgtctcctcgcgcggagctctcctgtttctctctcttcgtgtctctgcttcccttcgttttcgcgcgcgacttcgcccgctgcgctggcagtccctagcgtcctcccgccaagtaccacgctgtttctcgctttcgcctgcttcgccttcatttcgtctgttccgcgcttcttccggctgacatttcagatggaggtcgaagccggcggttgccgcttcagtcaagcttcttcctctgtctcgactgctgctccgtctgtcctccctccctccctcccaacccagggaggcagagaaagcagccgggacagaggaagaagcttgactgctggaacgaggacttcttcggtgctctgcgggctgtacagacagcgtgtgtgccactggcttctgccgagtcgcttggagcgcgagagaggttcccgaacttgaaaaatacatcgactcccccttctctgttcacttctttctttcgacttcgccgcgaagcccaggaacagactggagacggagtggcaacgaaaaaaaaggaggcatttctgctgcatgcgagcgcagaaggagcctcgcgaggaagaagcgaaacgaacgcatgaagatggcgtagcagga

SEQ ID NO: 3334 - DNA, 2832 bp, Toxoplasma gondii
aaacgcgatcgaacagagcctgggaactctacagcgttcttctctcgccaccggaagcctgtctgagacgcgtcgtcactgccaaacacagcacaggcgagtctcgcttctcgctcctctcttcctctgtctccgcgcgctttctcttcctctgtcttgccggacttcttcgcttgcttctttcctcctctgtgttcctgctttttgacgcctaccgtctccgttggagtcgaactccatgaattcctcgcggatgaaggcctcgtcgtcttcgtccatctccctcccgactttgtgaacggctgcttcgtcgtctgcactcgtccgaggctgcaaattcgctgtcgacggacttgcgtccttcgccgtcttccctgaagcagaggcctgtggggcggctgcggcttccacggccagtggcggcgccaggcgcgcgaaagaggacgcgcggcaaaacagagaaagcagaggaaagagaaacacagcggagcggcagagagcaccaggagagacttgcatggtggcaggaagcgcgggggacgagagacggtcgcgtcagcaagcggcgcagcggcagaggagagagaagagaagagagacggaacgagagaagaggaactcggcgaggagaagacggtcggttgacaaaaagggagcggtggggagatcgccaaggaagctgaagtttgccaaaggtttggaggaacgcggcgagagacgcacagggcaccagtggaaaagaagaaaggttgagagcagaggctcttttttgcagggatggcgaggcgagaaggcaggatgccgcaaaaagccgcggagacacaggcgagaagcaatgccgatgttcttcagagaagcttcttgtgagaagaggatgaccgacgagagagagcggctgcctgcgaaacagagaagagacgagaaaagcgcctgcctctttcctgacacacacgcgtcgttcctcttctagaaagaagacaagaactgacagagagtgacggcgccaatcctgctcgcgggcaacagaatgggagaaaaaaagagaaagacaccgcgagggggaggtggggaggggaccggagcgcgacggcgtagaacgcgagttggagttttccttctcccttcaaaaaggtctgagagcgaaggagtctttttcatgtgacacgcgatctctctcggcgcgagacgcctcctctccgcgagggtcaccggggaggaactctgcacctgtctctctccctagaaaggatgagagacagaaacgcaagagaaaacagagccgaagacgcatgcacaaaggaaagaaagagaaaaaagggcactggacgcacacaacgtcgcagaaagaagaacctcaggttccacgcaaaggcgagagcagatatgggcaacgaggaacagaaaaggatttccgacggctggaggagaagacggcgccgccgaaaatcctagacgccacactgcgttccctaaacggattggtttcgtcctctgcgttgtcaaatttcttcaaactgttgctttagcacatggagaaaaacgcattttccgatcttttccccattctgcctgagcgcacaaccaaaggcgcgaggaagagctttcgagagacgcttcagcgcgcattgttttgtagacatacgagacgcgctgttctgtgtttctacaaaagcaactttcttctcgcgaaactccgagagaacatcgacacccagagaccaccgaaaccgttttttgaactttaggccggctgtcaagggcaccgcgagatcttctggttttcggtgtgcgaccgcccgttggtctccgtgcatcttttcttctggtcttctgcgctagcttctctacctcctgcgtttctcgcgtcttcctcgttctttgttgttgtcgataaacactggtggaagacgtagagcagcgtcttgagcttctcgcgcgtggaagcgcgtcactgccctgaaaacctcgcagaaacgcccctgcgtgatctccatctcgcggtgtgtgcagcggcgtcgactctcgatccttctcctaccccgtctgttctctgttccctctcttctttcatctcttcagtgaggtcgtccggccctcacctgtatggaacttccttgcggctcgtttcgcctggttcctccagtctcgaggactccaggtctctctctccctccgcgcctgtctccctcccgccgtctctctcagaaaaacaagagcgacgggaggaagaagacacgcagcagtcagctggacgaagatcaagcagaggtcaaggagagagaaaaaaaacagatgagaaggagggcgcctgagtcagacgacgcgctgaaggtggaaagaaaccgcagtgacccgggggtcctgcgaggaaacaaaagtgcgaacaaatgtaaatcttttccttgagaggcgaatctcaggcggagcctctcccggaaacagttcttcactgcttcgtcctttcctcgtcgtcttcctctcgtcaccttcggacgccgtcgccgtccccatctcctttccctgcttctctctcttctttctcttcttctccctctctcctgtctgtctctcttcactctcttctctctcttcttctccctctctcctgtctgtctctcttcactctcttctctctgttctctctcttcttctccctctctcctgtctgtctctcttcactctcttctctctcttcttctccctctctcctgtctgtctctcttctctttcttcactctcttctctctcttcttctccctctctcctgtctgtctctcttctctttcttctctctcttctctctcttcttcgctccatcgttcgtttgcacaa

SEQ ID NO: 3335 - DNA, 2232 bp, Toxoplasma gondii
gtattgactacaaggtaagggaggtgaaatgacacccatctttatagctgagaaacgtccttttggtacaatacccagaaggcttcggatgctcttgtaacccagcttaacaaggcgttgaaataggtcgttgactccaaggtgttggttatatttctgctccgttgctgtcgcaggaatttgcagagctgttcaaatgagaagctgagcttgtaacaccaccgattcgacagaggcaacgcgctaagtattactgaaacgcgctttgtagaggcaacgcgataaatattattgaaccgtgcttagtcgaggggcattcataccacagcttgcggtggcggacgaagacggtggcctgctgcctttccgagttgaaaaaaagcgtcctctttttaggagataattggaccgatggttttgcttgtggaaggagaaccaaaagactaaacacagcgcaaatacggacgatgtacgggaaatgcaaacacatgcgacgtgaaacgaaacgcatagcggttgtgtgaaacggaaggcggcagaaaaagaagattgaggggtgcagagaggcaccgcagaaggaagatgatggaataaaaggagggtgaaaaaatgtgctacagtgaaagaggaaaatgtgacacagaaacaactgcttagttaacgaggagaattagtccactggacggcattttatcggggcctgcccagttaagatttgcggaaccgaccacacgaaggaagtggttgggggccgcgaataggtattggaaagctatcatccagaaacatgggcatccctgtgccccctgtgttctgaactgctaaagccgcgcgtaaactggaaacgtttttctgtcttgtgtgagattggagagagaacgactgtggtgtaaaagttgtggcgccgtcttccacaggacttccgccatcttgagagcacccaatctgttacgtgcatgcatagaaaaaggaaatgtggccgttgcaaattaaccactttcgcttatacatcgaaaatacagttctaaacaaccagctttggcccaggaacagaccacgactgaaacccagaaggaaggaagcggtccgttgttactcctgtaggctgcgacctccgagaaagaactatatatctgaatgatgtcttctgccacgcgtatacctgcttaagaaaccttgtgctacgcaaacagctctgttgtcaaactaaggggtaacactcctatagcgagcccagtgtagatcagattatccacaattgtcccgcggttcctctcctcaactatttttttgacgaacctgagtgtgcaaaatgtgtggtgttgcgtctatcttgctactctcccgagaagtctttcacacacccgtggaagtcttatatcttctcaggcgttttattcgcaaaaacggctgcggcggaatttgtctcaaattcagccactaccggaaagtgacggtgctcgttccaactgatcattttgtggcagatgttgcgggagctaacgacatttgggaaattcctacaaaatgtacttttgagatgactccagactgccacgactaggaacccgacaccaattgagagcctgtcgacgatgttttgacgcgcatgcacatctgccggcacgtgagaaaatgtgcatgcactggcattttcgttcgccaaagtccacggcttttcttccctgtttccgtcagacacgcgaccacccgttccctcctgatccgcttctttctttttcctagctcttcatcatgtctgcccgccagctcgggtacaaattgcttgtgcgtatgcattggcaccgaaacagttctcggtcgcatgtgaatccttttcatcctctatcttgcaaaggcaccggatcctagttgaatgccaggacgagtcttacgacggcatcccctcagagaaattttctttccatgtccaggttgccacccttccttcttttctgatgtcactgaagacgtttctcttcaggtcactcgcctcccaacgacctcaccacctaccagagattccacttgagcgtttctgcgaactgtttgactttaaatcaaactagccgattcctagaagggccgctgctgtgtcggcttcgtataactgcatgcggactttgaactccgcagagactggaataaaaggcacagaattggtactacgaagaagcgaccgcttctctgacggttgagaatcgggcgttcgctagaggcattcttccgcca

SEQ ID NO: 3336 - DNA, 2605 bp, Toxoplasma gondii
aaaagtgagggagagcagaagaactgaccttcggagagagaggaatctgagaggaagagagaggagaaagagaagaagagagagaaggagagagagaaggagagagagaagtcgctagtggctggtgaggctcagacagaggcgaaggaggcggaacttcctgccgcgggcaccgagacaaggtgtgaccgaggctggggcgcgtaaacggagacagagaagaagtcggagaagaggaagaggaaggcgacgaagaagaggaagaagaggaagaagaggaaggcgacgaagaagaggaagaagaggaagaagaggaaggcgacgaagaagaggaagaagaggaagaaaaggaaggagacgaaggaggggaagatgaatgatacgactctacatttatttcttcctgggtaaagcgggaagtgggcggaggttcttcagagctcacatgcccagaagacgatggagagactaaaggcagtgcatacaactctgcacacgaggaagaggagacgacggaggctgaagaaggagacgaagaagttgcggacgaggaaagcgcttcctcatcgccgcagagcatctgcatagacagagagccttgaaaagcattgcgcgagcgcgaagcttcagaaggctcgacagcctcgtctctgaacgtcgaagaaagctcctgctcctcgtcctccatgacaggagcaactgaggggaggaaagagaagggggaagagccggcgcgaaggcgcgagaacctcgctttcagcagaggcagagcggcagtccacgctctctacgcgaaggcgacaatcacgaggttctgagacttttggaagatatcgaaggcgaaaaacacagagtgaagcagaggcaacgagagcagcggagaagcttgacaggggcagagacttgttccaggaaaggtggagcaagagacgaaggaaaagaggtggaggacgagaaagaacgaagcaaatcgagcgacagcgagaggaggaacgtaggacgacgcggcgaaggaaaggagtacacgagggaagagaaaagagaagaaaaaggagaagaaaaaagagaagaaaaaggagaagaaaaaagaaaagagagaagagagcaattgtagaaggagaaaaggagaacagtagttgactacatgaaggggaaaaaaggaacgcaaagagacaaagagcggacgatgtagcgcaggcgccttccgcaaaaagcatcgagaggagaggaagctggcacactctttctcgaacgctttgaaacgtttttccagaaaggttcgcgtccttgccttgcgtaaaagggagaaaactcgaaagaacgagagcatatgccatcgccgttctcgtgtttccctgtgcttctctttcgcgcggatcgtcgcgctggacgggcaccgtctctgtcaatttgctgtttcctccacttttgcgtcgttcgcgtattatctttaacggcgaatctacacccttggtgcgccttttcttttggcctcctttctttccgagcaactgaggcgacgttttgaaggcaatctgggtgtcttccctcgggcatggctctcaggcctcgcgagacgaaacgagctggaacttgtgcttgcgccgcgacagcgccgatttccggctcccgtggtgtcgaggcagagtttcttcctcacacctgcatcgaaggctggagcgaattccccggccaccatgtccaggcgacgtttgtaccatccctggcgtttcacagaagaaaaaaaggcctctcgaacggacatttccgtccctgcgccccgctctcggcggtttgcgtccctgctccgagtttctcgagtgaggcagtgaaaaggcattcgtttcagtccttctcgtctgcgcaattatccgccagactcgtcggcttcttcgaaaaccttcttttcagacgggcgcggaggcgttcctgggagtcgcgaccggcgcttgacactgcggagagctgcgttcgatccgacagaggggtcgcacacactctcctttttacacgaaaacgctcgcgaaacacgggagcggggaaagttctgccgaaaagagctgactgcccgaggcgggagggggaccagcgttcgctcgaggctggaaaaaaagaaagacacttgcagacgctcgtgagaacgctgcttcgacagagaggacgccagcggcgctgtactcgcgagtccttcttcgccgtttcgccgtgtgaagagaaagctggaaaaagtttgtgtcaatcctgcggactgacgatcggcttcgcgacacaaagcgcgggagttgacccaggctgacaagctccgtctgttttttgtgtacggtgtgaaccttcgtgtaacagtccgcagttcgagttgagatgagacctcgactccgtcgctagttttgagcgcgaacaattccgacttttgggggttgagcgtcgctctttcgcgacgacgagggtgttttgacgcaagttgcgcgtttgtgtctccagttttttgcgtttcgtatcgactctcgcgagagctccagaacgcgcgaacacaggccgccgactctcgcctccttgacattcttctgcttcttttcaagagcccggcgacaccgtcacttcacga

SEQ ID NO: 3337 - DNA, 2337 bp, Toxoplasma gondii
cagcacgaactagaaggacgaggaccgtaatttcggcgcttgtgttgagacccttcctcgaccgaccggggaaacccagatacagatgctgaactctgttttaagctggacagagagcgtgggaactccctgtcgagggccgtgagagtgcaagcccacggcaactgattttcttctgctctgaggcaaaacggtttttcttccgcgaaggcggccttcaggcttcacgagcgtccgccattgcctcttgtggggggtcccgctcttcttctctgattctctccgaggctctcgggtcccgccagcgtcctcggccgcgctcgaagagccttgacttcatctcgtgtctgcagcgagagtggagcaggaagccgcataagaggggaagtcaccacgaaaagtaatgacgggggatcagagaaatgccgagagaagtcggaggactgagcagaggcagcgaggtcagagttggcgttgcagagagcaagagagaaggcagagaagaagaactgaacggaaaagaagagagcagtggggaaaaaagaaagaacacaggaggaggaacagtggcggaggagacagcggaaaagaggggaagagagaagaagggcagacgcagttctggacgggaggggcggagagcgtacaaccgagctagaaagtgcatgggcgtgatggacatgaagcgaaggcagcgagagaaggaaagcgaagaaaacacggagggacgagaaaagacaagaagcgaaagatgttgctggggcgaggaaggatgcatagaagagttctgcattctacgattctcggcaagtctgcagatgagacaggtcaagagggccgccgacaccggaggaagccgcagaccgtcgaagcatgcacgaaggaaacttcaaaggttttgaaaagcgccttgactcctcggagagctgtttagcccacgcttggaaagacaacttcccgcagtctctcacgaacagtttctccctctgatacgcagtcgaggtccgagaagtcgagaccaagcgacaggagccgcagggctcggagatggaggctgtagaacgcagcgcgcgaagaggaggagcggcagagggcacaagaggcgaaaaatgaagaaagacgacttctttctggccctcagaagagtgtcgactttacggagtgaagcgatgtggtacctggaggatcaagaaatccactggcacttgaaaaaaagagcggcaaacgaacgaaggtcccgggctgcgccacgactttcgtggctgcagatcgacgcctcggagagccatcgaggtggtatcaggtgtacatacacacccgaacgaagcactttcaggtgtacatccgcccagaacttgaggccgagagtgtgtcgaaaaaggcaaggaaatcacgcttccactataggcgttctttgtttatttgcggcaccactctcccgaggggggcagcttcttcgcgacgggagtgaaggcagacaagacagaaacgtccgcgcggagacacatctgcgcgggaggagaggggaggagacacgcgcaggcgacccacacacatcgcgaaaggggatgaccagatgcagcagaagctcgggaaaggcgagggcgaagcgggcgaggagcaccggaagaaattgtggaaaaagacgcacaaagtcgaatcaagcggtgaagtttggtctccaagaaatccgtattttttctgcgggacggaaggaacgggaatggcaaggcggcgcattgccgggccaaggaaaacgggccccggcctcactgtcagcagccaagtcgatttccagctgctgtctcgattttccggctgcatctactccgacgagattctccaaaatattcaaagaatcgtttctttcgtgcagacacaagaaatcaactcggcaccaacgcgtcctcggcgttcctgagatgtggcatcgcggagcgagttcctgtgtgagcgactctgcagttgcatgttcgggtgtatgtacacccgaggacccctcgatgtttcctcccacaacttctccgccgctctttctgaactggatgttgttgagtaggagcgcggaatgaagttttcctttcacctgccacggcggtgttttgtgttgtgtgcacacggtcgcgggcatttctggtgtctcccgaacgccttcttgtccacttccttggctcggccgggaagtgtacgtacaccgtaattcgccgccgactgatctcctcgcctttccaggtgtatgtacacacctcggcctcgccgcgtcacgctttacgcgcctccatctctttcgctagctcctccttgctcgcccctcggcaaagccatgaagcctcgcga

SEQ ID NO: 3338 - DNA, 2800 bp, Toxoplasma gondii
actcaccacaacagtgtacgcggaaagccagttccggtgttttgaagtgtgcggcactcagtaagggggtgtcgaacgggagaggcactggatttgccggttgtttcttcggaagcgactgagaagttgaagtcgacctgtgcgtctttcgctctcgctggagggagtccctgtcttccgcctctcgtgacaggggggtaaagaggtagtacacaagagaggtagctgccggtgtgaaaaggtagacactgcgttgttttctacagtgtaggtcccgaaggcggttctagcaaccaacgtgtcgggagagcgagtttcttctcttttcgtaacaatgtgtacagggagtgacgcgttttttgtgtcggttcttgctgtgatggcaagagaaaacttttgaactcaaccgcaagcagggcttgagggcgccgagctgacgctctcctctttccttctgaaaatggcttcgctgcgctgctcgcaacaatccagagcactcgatgtgcacagcgacaccaattgtattccacttcgactcattcacctaaatctctttttcacgtgcgtttcgattgtgctagcgaaactgtcgaattcgcattcgtcggcatttctttcgatgcgtgttcacagtgacttcatatacagaccaatgccgccacggtgaccgagtgcgtacctccggccatggaaataaagagcgctgtgtcatttttgcgttcttccatccccgattctccctttttttcctccagtctcgtttgactctctggttgagttcctttttctctttcgcgacacccctgtccggctcgccggattgtccagatcgtcgcggagtcctgtgagtcgattaacaccggatcaaggcgcatgctcgcagaaagtgaagagtgtcgcgttcttctcgcggaagcctcccgaccagaaagcttgcttgagacagagtcggtcgattgttcacagaaaacacaaatctgcaggttttcctgccgtcgagagactgaaatgcagaaattgcaggatcggccggtatcgttaggatacgcaaactcatcctgcagtttccaaccctctgttgcaactctggaagagtctctcgtggccgggagagggaaacgagctccctccgtgacggtggactggccgcacagttcacagttcaaaggacagtgtgctgcagagaaaagaagggatttgccggcaagttcgctttcatgtcagcacgagcacgtgagggtacgttgccgagaaaggcttaaacagcgacgccgggaaaaacgagacctgctgctctctaaaacacacgaacagcgagaaacggctctactttacacacgctgcgcaatgagtcgttgcctggagagagaaacggcttattcacaggaacacaaaaactactcaaacgtccattgtaagttttcatagagatattgtaatccatgaataaagggaccatccccaactccgctacgtgttaatcacagagctacaaaaagatctgaaaattccgtttcctgtctcccctcccagtgacaagaaacggttctcgactttaactgcttatttcactgaacaagatggattgctttaaattccacggttgaactgtgcaggcggaacgtcctaaggagacagagcactgaagaaaatcctcaggaatctggcgacgccgttcgccggctctcttctaaatggcaactggaggcatcagcgcaagcattctacccccgcgtcagatgctgaaagcgcccatggtgcggaagaacagtttctcttaagaaactcgacaaatctcgcgtgaagtccacccaccttgggagtggtttgcttttcaaccttcaagcgcaaggtgaactggcgtgtacttcgcgcggcaaccgcgtgtgttgtgtcgaagtgcctgccgagcgagtccgttgaagagaaagggctgttcctctgcctttgcctcgtttccctccacttcagtcgtccagtgaaagaaagtcgaccgaagaaaatccagcaaaatccctgcatgcacacggttgtcttttgactgtcgtgcgtgtccagcggagaccagctgtagaagtcgctgtatctcgacgatacacgagacagcttttttcctcatttgagaactcgaacaccccggaaaggcagagggatttccccagttactcctcgaggcagaggcgtgcgtcctcgctgtggcagaaaagttccttttcgcgatttggttccttctttgcccgcaagacatcgctggcaggtcggctttcagcacacacacacacacacacattcgattgtgcagaacatcccaccgtttagaaggaagtcttttttcgtgtcctgctttttacgggcttcctcgtccatcgaatcaccgtttttgtccggtaacaacgaccttggcttgtgtctggtcactcgaaaagttgccgttccttctacccccctggccgtctctcgtctttctccgtttcgataccggagcttctgctgcatctcaagcgtttcctattccttttcttgaggcagaattcctggagagaggcagtcgccggaagttcgcagagtctcctccatccgacgggtcggaggaccccggcgtcgccggccaccgcgagtgccggctgcctccctcgtcgttttttcgcgtttttcctctgggcgcgtgttttcttagcttcgcagagaaccgcgcagagaaacttcgccggtcggaccctcgcgtcctgctcatgtgtgacgagaaccttccctctaccgccgcagacgaaactcgccgtcaaccgctccgtccccaaaa

SEQ ID NO: 3339 - DNA, 3159 bp, Toxoplasma gondii
atgcgtcggaacagaagtaaatcgaaaactgctctgagcagaacaagttgaggaaggagacagtcgcaagggcgacggggcagagccagcagaggggacagggtcgcctcggtgcggaggagcagagggtgcacgacggaggcgcgagagggaaaccgtggcaggcgaggcagaaggacgctggagagaaaagcgaaacggacgagaagacggagcgaaggagggcgcacccagagacaccagagaggcaacagcaggtgacggagaagcgagcggagaaggagatctgaagagagccgcgtcggagaaaggagaaactgaggcatcaggggcgaagagacgcgcctggagttcgttctgcggaaacgaggtctcctctggctgcttctttcctaggtcaaggaaacagagcttggcctgaagttgaccgccgtcctcagcaacgcgcttctcttgactgttctcggcgcagacaacgcatgggttcaccccaagaggagacacagggaaaagcctctcgccagcgccacgcacgcagtcgcccttctcgagctcttatgcgggcagactcagctccgttgatgtctcctcccttcggcaaaaatccagttcaacaggcgacttctttctcacagtccgttctcctgttccctctggcttgccgagaagaacgagaggagccgcctctgtggcgtcagtacgcctggcacgaggcacccaggaagccaaaggcactctcgtggcatgcgcagccatgctgcctccgagtggacattctaaagcgtccagaaagaagtctttctcgggtgcaagtgcaggtaaacacaccggcggaggggtcgagacagagccgcgtcgcaaggcatggacacccactcagttcactccggtcgcaaggaccaggtacagctgggtcacctcgacgcgcagaacttgcgcgaaaaaaagaaaacaaacgacggcgctgacaagtctagaacgctggagaaggggaagggtggctcgaacacacactcctgaatctgtatgtcttcggagtcgatatgggatttctctgcatgtgcacatagacggctgagccgtaggatagcagcataatcgagattttgactgacgaggcagcctacggcagcataagggaaaaacgccgcgggcgcatcgagcgtgggaaagggcttgcgggttctcgataatagcgtctcggtatcctcggaacgtctgttgttcggaaaaaagtgcagacagcagcgaacgctgaggaagcgaaacaccacggagacctcagcaagacagggacggtgcgagaggcaactgtggacagaaaccgaccggggaatagaccctgtcgcgttcttcagtcgctgcaccgcatcatgtcggaaaaccacatgctcgccgtgcaagtgcacggatttccacacaaactcaggatttccagcgagttccagtgtgtgctggactcgcggagtagtggaggttctgctcgaagccgcgtgtcgaaaaaggtgccacgcgctctgaagaaatcgctgtgaaaaggttccgaatcggcaactcggtttcggcagacatgcgttccctggtcgccagccggcactcgttctgcacactttttgagtgccgcgttgcttttcgtgacccactttttgccagattttgtacgattgccggaccggacggctggtgcggtctatatgggaggaaacgcactcgaggctgcatgcgcgagacggtttcccggggcttggagaaccgcgcgtgcgagagccccggtcccgcctgcaggtttttccgcgttttggttggagacgtccgagagaaaaggcgaatcgacgcgagcagcagagacccagcagacacccgccgatttcctggagaaattcgcggggaaaccacccagattcgcgcacgcagttgtactcgcgtggcagactcgaccgccaagcgagacccagctgggcgatccggtgtatgtacaaccgaccgccagcggggcacggcacagaggctgagcgacagaccgtcagaagtttcacagagcgtttacggctttgtcgccgctgagaaaacgagagcttcgctggagactcgcggctcgtcgccttctctccagcagcgaggcagttgctttttcttccggtttttgccccagcctcgcgaggtccttgctcgaccagccgagcaccaccgcgtgctgcagcgcgttgcgggaggaccgtgctgccacgaaaagcctcgagcaacctggcgggagtcttccattttccgttgcttcgacttgccttgtagacgagtggctgaagttcgcgagcctcgcctgattctgtcttgcgcagggcgtgttggagcaacggggcttgctcgcggcacgtgagagctgctgctgacagcagagcgcgacttcgcctagcgccacgattcactgcagcctcgcagcacaccaagttttctttccactcttcccactcccatatcccgaacccgatctgtttcgtcttctggcggacaaagccccgagtcggattgtttcgtcagtaccttcctctcctgtaggcatttgctccgcatcgtccagcatctcgaagaatcgacgctctgtcggtccggctgtctgcacgccttggagagaaaggtctttgagagcgcgcgtttcctctcgattcaaagcctttcttgagagaaaaacggtataccatgacccttggcttccttcaggaccggtgccgcgactttcgaagcctgagattcgccagtctacatctggtcgaacccacctgtagtggagaagaccatcgagaagccggcctcttccccttttttcctcttgcctcttgtccgtctcctgttgtgcttctttcttttgtatcgtatcccggaaccgagccgcgctgtcctccggcactggctctcaggtttcttttttccgggcaacagttcctttgaagagacaaagcagctttccaccggcacaagtcgtcgcggacgttcttttacagcgactcgttgtcaagcgacatttcatcggcaccctttctctgcggactttctgtgtctgtttgcaacttccaggaccgcgtgtctcctcttgtcttcccgtgtacgtctccctggtcttctggtcagttcccccctgttccgccgcctgctctttttccgcga

SEQ ID NO: 3340 - DNA, 2567 bp, Toxoplasma gondii
gaagaatctcctcgacgtcctcgcgaaatcccatctcgagcatcctgtctgcttcgtcgagcaccacggcctccaactgcttgcccgcaatctccccccggtccatgaagtctttgaagcgacccgggcatgccacaatcactgacacgccgctgcgcagcttctgcagctgcggatactccggcgcgccgccgtacagacagacggaagccaggcggccgccgagcagcgtctcgaactcctcctgaacttgttgggcgagctcgcgagtcggcaaaagggtcacgatcctcggcttctccttcgagttcccaggctgaggcagcgacgcgcaaactctctccacgagtggcagagcgaaggcaatggtcttccccgtccccgtccgcgcgcgaccgacgaagtcgcgacccgcgaacacgtgcctgtacgcggcctgttggacaggaagtaagcgagtgatgcctcgcttctgcagagacttcagggaagtcttcgacaagttgtagtccgagaggagcccagaatcggacgccggccggccggactccgcgtcgctgtctccatcctgctcatcgttttcctccttggaagaactcggttcagccttcaacaggtcgtccgagtcgtctcgacaccgcgtcttcttagacgcggcagacctggaggacgaaccggagacagtcgcactcggcttaccggcttcggtcgtcgcctgtctgcgcttcttcgcggactgcgcctcgacagtctccggtgtgtccgtttcctctgaagcctcttcagagcgtttcctccgcttcgacggtcgcgcggcagccccctcctcgcgagagaaacgacttttcgcagtctcgggcgccatttcagcttccgttcgtgcagttctctagcagtagccgacttggaccacgcagttcatgcgcgcattcgaagagtccgcgagagaaacgaagagcggcggtcgagctcggactggcggctttcgaaattcaggagcaggcacacctggagcggcagccagctacggtgcggaatgcgtccccggaaagaacggcagtgacttctgcgagcgatttgctgctgtgaacgcggaaggtggaaggccagtcacctcttccgaggtaagggaagacgacaagtgtttgaaaagagaagacagagtttgactcgactacgaggaacgcccggaacatcgacacagcgtacgcgccgacgaccagcgtgtacgggcgacgaacgggtacaagggtagacgcggtttccagtgtcacagcacgcccctgcgtggtgaggcgaattcgatggttcaagacacgagactgagccagcaaacaaggtggggaaatccaaattcgtcgatttctttagcggatcccgcatcccaagtcaacgtcgtgcgacctgtggggcagagtcggcgagagtgccaggagcgggcggtctctcggggaggagtggaaaaaatggggagaacgggaacagaaagaaagatggggaagacgcaaagttcgatctgttgctccgtcacgagaaacttctgtccttcaccgtccctgctccatcgtttgtctgtttctggtctccatgtggcatgccaagcaattagcgagctctcgcttttctttcgctcttctcgcgcttgcatgcacaccggcacagagagcatgggagctgtggctcccctcgacacgccagggcagcgactcctgagacagacggcgcctttttccaatttcttcgctttctggccgcacatcgccgaaggtgacttgaactgagatccgagctcgaacgcatcgactcttctctgctgttccttttcgcttccttctgcagaaagccggatttcctgactgctccgagtgtcaaagatcacgcgcggaggagacagcccaggctcagcgttgagagacagcgcagaggcgacggagacgaggcttccacccgcgtgtctttgacctgcttagatttgcggctttcgcttcctcgccaagcagaccgcgaggctgaaaggcgagaaaaacaacaggtgaattacgcgttctacggagctcgcgcagctgaggacgtcagtcctccctccgtccagtggcgacgcataactcacgctctcacgacaaaatctgcgctctgcatgcggattcctgcccgcgccgaaacgtgattttctcgcgcgttttctgctgaaaacttgacacctaggctttcttcgatccatgcctcgaaacgtacactggtgtctcttccgcggacgtttcttatcacccagtctccccccacgatctggcgaggcctcagacaactggcgacaagtcgccttcgcatctctcgtacgtcgagagaacgattttcctctttactgaactctctctcccatactcgggctcgtccaccgtctcctttgtctccttcgctcctgcctcctttgtctccgtggctcccttcttttctctcctcttctcccgcctctcttccttctctttcctttgcatcctctccttcgtctccttctccttcgtctccttctcctccgcgtctggcatcttcgctttcttcgtctcgaa

SEQ ID NO: 3341 - DNA, 1217 bp, Toxoplasma gondii
ttacaaaacactcaataaactatcaaacggctgcgtgcgtcgagaaagctaaaatttcccaggcaggcaaacctcccagcccctaaatgttgtgccagtaagagaaacaagaaaccaaagactcccacacagggctttctggttctgctccctctgctctctgagagaagcgaccgcaacctggcaagagtatcgcgagcacacgaaggacttttcgggaaaatttccgagtttcttggaatccccgcatgcaaacaaagaaaatctcgaggtcgtcacagtttaaacaccacatacacagttactgaatcaaccttagcagaccgtctgaagtccgttttccccggtacaccgacgtgcagttagttacacctctggaccatgagaacttagccgcacgaacccacgaaccacgcctcattcaagtgtctcaacaccaaataaaaaagagaaaatagtggccgtctcggtttctgtgctgggaagtctgaccgtgtccactacgactcgccagatcgctgcggcagcgctcgcggatttcctgtgggcgtggaactcgaactgaaagttcgactcccgaggaagagcctttttctcagaacctactgccaacttgtcgctgaagcgtcaccatcatgttgttgtcgctttcggcgacactccacccggaggtttgcaggaacttcttgaggtcggcgtcctgttcgtaggtggactgttcgtgctggatctcgctctgaatcgttttcaggaggtccttggaagcagcttctaccgagctgtcggcttcggaagagaaagctcttttttcagccgcaaaagcggagctctgggtgcccgtgagcggggagaagaagcgactgtttgtggctgccgccgcgagacccgcgggggctttgaaagggaccgctccgagtctcccctcgcgcagcaccgcagagcagaaggaagaagagaggaacatgcgctcgcgggagctcgaaagaaccccaggaaggcccagtggggttttggaagaaaagagacgaaaaacagaggcagaagtcgccatggtgatgaggcggggagacagcaaaaacgcacgggaaaggcgggaaggcgagaagcagacgacaggcaagaagaacaaaactcgagcggaaaaaacgacggcgcgagaagaaagggactcctgcgactcggcgaccggagagatttctcccgcacaagcagctcta

SEQ ID NO: 3342 - DNA, 1363 bp, Toxoplasma gondii
tcgaaacaatcgtgatccgtgtcgacggtgaactgactatacaaagtagtggcaaccaggtgcactgtcgtcatttcgcgatgtcaaaaccaccgcatgcgcaaagaaaccatcgcaaaccgtgcacaaagctaacccatcagattcgtccactcgccgcgaatatatctagacagaagaaggaaatataaaggtgtcagtgtcggccacaacaaaggttggcagtctgatggtgaaccgcggcgcgaatatacactgcaaagcatactcgatgcacgtcactcgccccgtagaagattccacattgcccctccggaagaacggatcgcaaaaacatccgcccattagtatgccacccgaacgggagctctttttgccacaactgattaccacgttgcgttcagcgtcaacccaatatggtccgattacgccacctcctatatcgctccacagcttaccgcgctgcagacttggtgaacatgtcgctgattcatttgtcccttgccgggacagcaacctgctccctgtacacgagatggatcatctccagaactgttcaatgaatcacgtgttccagctttcctctgcctgatcttgagttgttggcggtgccgttcatgctgctggctcttcgtgcaacgcatccgtgcagttttagtcctcttcggggcaaacttcgacaagaacttcttctccatatatgcctcaacgagttttttcatcgatgcagctctagcttcgtcagtggaagcgctatctttttctctacgtttccccgggagactggcgcatgcggagcccttcttgttttgcttcaccgcctctgaggagtgagacggagaagctcccacatgttttgtgcctccatctctccccctcgctgttgacaaagatttattcgacatcgatacattagcatatgctcaaaaaggtagtaagaaccaaacgaagtggggaaaatgtgctcaaacacagaaaagtatgagcacatctcgttattgtagtcactgctccatgcattatgcatgcaatgaaaggttgaagagttgctccaagcgtgcatgcatgaaccgcggagtaccgatgccgtcgagcgagcctgcagtcgttgtagtcataacagctcttttctccgggtaacatttagtatttctgccttcaggtcttacaaatcgtcctgtacccggcaaatgagtgccgttgaaggtttggtgtgtattgccagcatagtgtggtggcgttaggtgtctcagtcctcccgggagatatctggcagaattgatcttccaggacggcgacgtcgccagcaactcatacaaaacatgatgtattgattcattgtaatctgaaggagcactcagga

SEQ ID NO: 3343 - DNA, 2608 bp, Toxoplasma gondii
atgagagtaaaaatggaagtgagacagatttcaaggcgcaactgccgatcactgatgaaacacagacacagacaccttgggaagactgacctcagactgggtcccgagagtcgcagcgagcgcttcgggatcgttcaactctttcaggtcgtcgaccgtcaccacggggcgttcgaattggccattctggagggccatccgcgagctgtactcgacgcgtggcgcctggatccgagtgcctgtggacataagactacgcaagaggcgcttgtagcatgcaacatgcgaaattccaacgttgctgatattttttgaactcgatgttggacgccagcaagtgcacaagatgcttgtacgtctcgtcaaaaccaccgggacgcagaagatacaacggaatttcagcttgggagtgtctagccgcccccccttctaggtaggacgatactaccctgcctgagcacctccctgtgccagctctctcttctcaactctttcctcttcttctctgtggtgtttcgtggatgcgacggccctcagagacacgttggtaccgtgacgctcttgtgtggggatcgtactcgatgaaggcgcgtacacagaccatcagagtaagatccgtacctttgctggcacttcgcctcccgtttcgtgaaggaccctcgacaccacgccccagactgggctgttcagttgacccctcagctgctgctgggactgcctgaggtgttcgacggggttcgggcagaggaacactcgagttcgtctcctctgctcctctctcctgtcctcttggcaccgacggtctggactccggagcgtcttcgcaagacgatgccgacacgacaacatcatgcttttgcttcttctccgttgaagcaaggccgcccagccactctcgcgctcgtcgcttggcgtgtctctcagggagagagagagacttgtttggcgggggggaatctggatccatctctaaatccctcgggtcttggagctttcgcgatggcatgcaatgtgtgtgaagacacacgcggttttttctgtgcgtacggcagcctttcacacagccaccgtttgactattcgggtacgacgcagcaaggttcagcatcaccaactcttcaactttctcctgtttcagcaacccaggaaatttcgccacagtaatcggtgccgaagcaaacccggcgattcaagaatttgtcgtcagattcatgagatcggaaaccgctgcctcagcggccgggggcgcaaatgatcaccgtgccgggtaaaaaaacaatttatgtacgcataagcttgaataaatatatataaataaatatatctatatatagatatgcaacgcattacgcctgctgtgtgctagaagaggaaaaagaacagcaggggtgaatgagcgggcgggagcctgttgcgggcctgaatgcgcgtaacgccagccaaaagagaaacaacgggcaagaacagcaggcagaaggaactaaatcaaacacacgcatgtgtacgcctgtgggaacggcgcacatcatgaaaacaggtatttacagttagaattattttacacggtgtcgctggtaccactggtaaaaccgcttccgtgcgcatgaaactgcattgcgttcgctacgtgtacaggtcagctctccgtcacaagtgtagaatcggacactcccaatctccctctcgcaaaaatgccaagaaatggaggaagtgagatagcagacacagagaggggcgaagagtacgttgtcgttttttgcctcctcgttgtcaaccgggaggagtgcgacatcacaggagaaaactgctccgctccgcgttcaaaacaacgcaatttcgcggcgcacttgaatcagggaaatcgaactttatgaggaggctaagctttcatttgcccgcgtattgtccaaaagcagagtcctggacgtgcttctgaaaaaacacgagcctcctcagccaccaagcaaccaatcggcagtcgaagtcgtcccgcctgcctcacacagcaccgaccgagctgcagaacagcaaatatcctcgcgtccagatgaaaacttaaaagaatcagcgcagctccaggctgcctcattactggagggaaatgcgattgaattttataagcaaatgcgagaaacatgctgtgcccgttcaactcctgtgcatgcacaggaacaggtgctcgtgcagtggcattctgtcggaatatgagtcgagattgacggagatagtctctcataagaccgtcagtcacgttgcttgatgatgaaaggaccaaagtgatagcgaaggttgcttcttggatggtcttttggaagcacgaaagagggagttctcttgcagtaggtcttccacgtcggaaacctttaggcgggtatgtgctgacttcagacaccgcgggctcctttgtgggtcgtccattcgattcgactctgcatttctgcctcaattcgtcgctgttgtaagacacacgcattttccctctgcaacatattctggaacctacattgttttcatctgtttgcttcccatgtctaatgaattttgtttttcaggggggtagtgtgcattatgttccgcgtagtactggcttctttttcttcttgtgacaa

SEQ ID NO: 3344 - DNA, 2252 bp, Toxoplasma gondii
aaaaacctcgagaaacgtgtggctccaccacgtgcggtcaagacaaaggagaccctcaccagggcaatgcacagtggcaacacattctcgtcgacacttcaccagtgctaaactggtgcactttgctaattcgcagaggtccaggcagatgcgaatgcgcaaacactgtttgcaggggcaaggacggaaaagaaattagtggacgccctcgggacttggggttgaatgcagacaccgaaaccactgaaggagtgttttagttcgatgtggaatgccaccaaaaaggttcataagcattctctgttacttgcgcttaagagcacatgctttcttctgccgccctcgactcggaaggtgaagaaacgaaatgccatcgctgtacattaggggagtaaacggcagatagaatcaaaaacgtcgctctgaagaaagttgtgtttctggctcttcgattctcggaggtagacagctggggtcaaaagtcgtgactgctgttgtcgacgaaggaggaatcgcacagaggatcgacagcacagaggttacaacctcctcccaacctcagatagaacggtgttgtgaatctatagagatatgaatagagagaaatgaatatatataaagagaggtagatatgatcatccagatagatttgggtatatagatgtatgcatgttccgtgacgacctgaatgggctgtaggccacacagtctttgaatatctcacagaacacagctgtccgtggtataggtcgagtctgcttttccgtatcgcagagcagcatattgtctgtcactagagagctgcggatgcgccagagtttcagcaaagcatggagtctgacaatatgagtattcgacacatttggtctgttccgcgtttacatgcaagtgacggtcggtgaggccttggtttcgcccttcagtgcgcgcacacaaccgataaaccgttttggtctggtttgtccgccacacgcaaatgagcagagctggactgcgtttgcggtcgccatcgattgaggatttccttcggaacgcgaaggccagcacagagctttcgcacctctctcttgccttcgaggactatggactaaattccatgccgcgggcctcttctgagctttttttccgtccttctgaaaagtttcttgcttcttcaccagttatgaaaagtgcttttcccaggtttctcacttcagctgtttgtcttctggagatcccctcgccagccacatcaggcttgtcttgttcgtaccttctgggacctcgtgcgtccccccgtacgcgtgtctctggcgctgggatccctgagagtccgtctccgatgaacgagcacaccctgtcctgttatcttcgcagtcctttctctgtttcagttcgtcagctgagctgtccagtcagatgtccactttgtcattttttcccttagcgaaattgtcgcgagaggagccacttgccaagctcgagacgatgaaggacgagcgcatgcgcgagctgcagccccttgtcttattttcgcttcgacgcatttcctccgtttttcgcccctgttttcctattttttcgggtctggtcttcacaggcttggtcttgaaggcggactcaacaaaaaatgctttaaatcttctttttacgcaaacgcaggacacagaagaagaaacatgcaagctggcctgacagcgtcgatgtgcatctttctcgtctgactcatgttgctcgacgaccaacaatcgacgcatttccttggcactcttttcagcggtaaaacgcgagattatacgtgaatatttcaaagcgaccagagccgccctgttgtgaggtttgaatcggcttatttgtcttcgatccgcggccactctgaaccccaccgactcgagacaacttcaagattcacaggctgaaacgggctcgacttcttcgaacgctttttcccgaaggagacgcctacgacacaaccaccggcgggtggaggagccttgctgtctggcgacacgcagcaattcaacagaagttggttccagcaagcaaaaaccttcgtcgacgtcgtcgtgtttgcttggagaaaagtttctttcgatttctcggtgcttcttcttcgttttctggtcctctcgtttccctcgcagactcgctgtgtttccttttgaggctgctgatgcattttcgcctcttgctacgcaagactttggccggcttgctccaccgaaatccttgaacggaggttcacgtgttcgatcagcttttcccccatggca

SEQ ID NO: 3345 - DNA, 1691 bp, Toxoplasma gondii
cactttccactacttctccttcgtgcataaaatcacaagagactgagtaggactttaatgcatttgacatgatggtcgggagaagcacaactgaactcggatccagtgaacagcgccttccagagacaaaccggacgtcgaactcttggcgggaagacgtctgattaaacaagcattcgagcgctaggttctctctctctccacggaagcagcttggcagtagaggcttgactgtattttttcaccgcaagagaaggcggcatttctctatctcgtcctctgcgtcgctgcggactctgataacgcgtgcctgtgcagaatcgagtcagctggagtttctgctggacagtaaagaccacgaaaggatggctgcctccagagaaccctctgaagaaaagggtgtaaaaagtgccgggacacggttgcctgtttgcggcgcttacggcgctggaactcggggagatttttcaagcgctcttcgagagcgatctcttccttagttcgagttacaatttctttttccttcaccccctccgaggtgatttcttgctggtagacgctgctcttgacaaagttcatcgtgtgtcgaggaaaccagcaactcaagcggtcaatcatcaacagactctgtggagtccaggctccacaaacgcgaagtagttggcagagggtgcgctgggtccgcagaaggagtcagatgatgcgtgtcactgctcagagaaattccgaaaagaaaacgccggccggcgacgcgtggatatacttttcttctgtcgggaggcgggcaaagaacaacaacggatcgaagacacgacacggttgtatgcagcagggtcgcgcagacagacgggtttctgatgcagcaaaacctttctggactgttggggacgatgtacgaagcgcagaacagcaagttgctggcagttctacctctctgcttccggacgaggcgcgtgattttctctggacgtccaccggtgagacagaagctcgagaaaccaggacagtctcaaaacaagcagcgaacggcacgaagggtcagtcaagcgcttcgctgtgaagaaatgtagagtggaaaggtcctcaagtcgacgagagagtttcaaattcactctactggatgcatgctgccaagaagttgtcgcatgcatgtgcggcggccgagtcttgcaaccgcggccgtttcgcgtagccattcttgtgagaggcgctttctctagttcggatgtgtttgcattgtcccacgacgttctgtgcatctgttcttcttggcacacccgcttgctcagcgaagaatattttccacaaaggtcgtgtgctgccttcttttacctaggaacgtctccgtgtcactccgacgcttgcatacacgacacgcacgcctgctggacttctcacatggacatttccgcgtttttggctctcctgtaaatcggtttagtgtgatttatggtcgtgccgtggtgattcaaacggcacgtgtgcatatgtccgctagcaaccccgacactgctcggtgcaccgcttcggacgtgtggctcacgaaactgtgatcggttcgctcttttttcatcacaaagcgtttctggcctcgaaggatacgtccaacctgcagtctgccagctccaggtcttccacaaccactgtacagcgacagcgtaacagggaatcagatggcagggtcggcagca

SEQ ID NO: 3346 - DNA, 2049 bp, Toxoplasma gondii
attttgtgcgtgggctgcataggcgtagtgtttacctacgaatatatgcatgtacaagtatgtatatgtatatatatatatatatatatatatcgtgtaggacgagtcaaagaaatgctaggtgttttgtttccagcactctcaacacacacaataagaattcatgtggggattataaatgatggcacgtgattttgacgctttcatttccgacttactgatgctgtggtccgacgcagtgaacatggtttaagatggagacaggggaaccaaagaaatgctggggtgtccaaaaacacatatacatataaaatgcatcatgtgttcacttgtgcgtccaaatatggtacacaaaacatatccccaaatgtgcctgtacacgttcttagcttagacaccgtgtgtggggactactcgttattgtaaattcctgatttcgaagttcaactcgtcaacaagggacaaaacgataggcataaggttctgtcgcttaatgcgtcattcgtaatttttactccaatcttggaaaaatcgtgactggttaaatcagctggggtctcgctgttgcacgactgcaccacaaaacgaacacccttgagcttcctcagtgacagtgcgaggaactagaaaggcaacagggaggatgcttttcgcaggcgactttgggctgtaggtaaacacgatacatacgatcgtgggtacgtggagacacgaagacgattcataactgactggttcggtaaactgtcttgtaacgaactggacgagaagccgaaattaaaggtttcatcagttgtgcctatgtttgggcaggagccgtcggctctgctccgtcacacagtcacaggcactcacggatttatggatctgtctgtgcaatgctggggggcggacgcgagacgtataagctatgttgtttgattctttgcgttacctgcgtgccaacggggttttatagtgtgatccaaaaagggtactgtatccgtaggaggatttatccactgtggaaaagagcgatatcctgatcgagaaagaatcgggaaactgaaacgacctgatagccacatttgccccactgagcacccaactgagattaaacagcttgatcaagccgcctatacgagtaacatgaaatgagatgcacccaaaatggtcgctagcgctggacgtttccgtggtaagtatactaaaatgctggtgtcaacacatgtgtaagtaaatagctccgtagatagagatttgaagatacgtgaagataatccgggtcaagggattctcttaagagaatatttataacgagaaaacttttctttgataaccgcttccttagtcactccgtcggtgggaatgctttagacgtagtatatgccggatactgtcgctggcggtatagctcgcacatttgagagacagtatctcaaaacgcgtttgttaagtctgcagcatgggagtgctctgctaataaaggtattcccaggcattgcgtgaccacatctgcaaactccgattgacagtagtggtatccaggcgttctagcaagtgagaacagtgcccgacgaactccactgaaaccgttttacgttaattacaagctgcgtgcctgagcatctgttgagttgaagaccttctctggaaatcgagacacaactgtagtaccgatgctgccagggagagatgctacatcacgctcttgcaacagggtaacatagtcagcacgcgaacaaggttcatgcgattcaggtgcagtcgtgtcagttccgagagtcaacttgaatttttcgcttttgttgttctcccgtttggcatttctttgctagtatccttctgttttcgccagttggtattctatgtttacgtccgatgcttcacatcggtgtttattacgagcggcaataaacatcaacggcattctgtcatacgtgtgcagggcattgtgtttgcatgcaagaaaaaccctaacaggagaaaatagacgtaacaggcaatatttcatgttttcagtgctacaaattacctgtcgacactacgcttgtttcggtgggacagcca

SEQ ID NO: 3347 - DNA, 4079 bp, Toxoplasma gondii
cactgatcacttctgttgcgtcacttgcattccacgtactgtaactgcgctgtgttttcgatgtgaggaatgccgatgcgcacgatagagaccgtcgaatttgcagagacggcaaaaaaacggcagaaagctgctggaaacttggagacgcatatcacgatgtttacacgtaagcaaagggaatggcaactcttgaaagggtgacggagctggagagaggcagagagatagggagacaaacacagggaaggaatagaataccgataacgatgaagctgttttgattaacatgaaacccaagaattcgtgggtagcgaacagagaagggtgggattcacatcggataaaaaagatctggaagctgcagaggacaatgacgaaggaagaccagataaaacgaaaaaggacgagaggcagaggcgcacctgtcgccccacttagagcagctttccctcctgtgcaaactcgaggaaaaaaaggagaaaggaaaacggtacagaaatgttttctctttgcttcttccgtgcctcttcctcgacaggatacatgccacagaagcgtagcgcctctgggtgtctttcgtttgccctgtgctcctctaccactgcgtatgggaggggcatagagccgcagaaagacttttgttaacagagaatgtctctccctgagggcaagacgacaggaagaaaacgcagagagaggcttcctaactccgtcgatgccacacgacgctggcacggcagcgtgcgtcactcgcatgtgcaatggaagggagcccggagacgtgatcgagttcccacggtcttagaaatcgaaaacgctgcagaaagacttcctcgtagacagacagttgttctggaagtgtcggagaaatgttttccacaaaaagattgacgttttgccgtgcagtggacgcacgttttattaagagttgcatacgcatgcacgcatgcaagcgggagggcagcgaatcgagcaccttgagtcagggagagtcacagatacgccgacgaaaatgaggttttttcacaagaaacctcagctttgctccaggaaagggctggatttcagctgaatgtcaggatgtgaaaacaagccggctaaggatagttacgcacggacaagagtatgtgcacatgcatccaccaggtcactctaccctggtgatgaggcgcgtcactcattggaaactcatgagctcgaatttccatttttatcaaatccagcctctagctttccggctttcgtcaaatgcgcggtttccaaaaactgggtttcccttcgaaggaggcagctctatcctagcttccacagtgttcaaacacatcccgtgcaaaggccatgcattcgccttcgtttcagtgaaacagtagtctgataaacttcagttgcaaaaaccgccttactccaatgccacacttgctaagtcaacagagacgctcgaaacgttggcggtggtggcaccaacgcacactcttgaggttgcaaagtttcttccctgaccgtcaagtacggcgcaggacgcgcacttggctccgtcgacgcgtttcaggcaacatcaaacaaaatggcagtgggctgcgagtgcgggattttccatacccacaaacacgcgagttgtttttgtcagcgaaacgtttcgtttgtatagtctgtgtcgtcaagagatattcagactttgttgtattagtacatggtgttcaagcggttcaaattctacagtcatttgtcatcttctgctctgctagcgcagtacagtagatgttcatatgatgcactatctccagagtacatcgaatcacagaaccttgaactgatgtataaatctaatgtgccacggtttttcccgtacgaacaacgccactgaaaaacgatttgactgcttggcagactggtgactgcattcgcgagctgaaaaaaagcgctacacctgattccatcgtttagccgaacaggtttcccgctgcttgaggtcttgcttgcgtccagttgtaagtgaaagtgtttgcctcagacagcagcgttgatggataccaagcaggagtgctctccaacagtttgtctgggcatgcggacgaagtcatttaccaaatggtaaaccaggtagtaacaactttctaggggtattgaaagggataagttgcggaagatactcttgtttactttttacactaaccagcagccacgctgtctgaacgaggctagactacgggaagactgaatcatggcacgcgatctaggggtactgcagttggatgcaaaccatggtaggccttctgatccctcttaaaccgatggtggcgcgtcaatatacaagcccatatgcgaaggctgatcgaggcctttacccgctggtgacttgcccagaatcgacccagatgctgctcctcgatggctatgcggagtttccgggaagggcgagatcatcaaaagtctttcacgctggagatgagaaagccttccgttcggtggggaacagcacacctggcagatgattctccagtggcggcagcgagggaccagcaaaatagaaatatataccagatgattgttccatcgacatgctgagccgtatgtaacaatgagtaggagcccgtaacccgacgtggagcaacccatgttacaagtgttggaggtaggagcatgttatatcgatccggtgcgagtctggaggaggaaagattctatgcgggcagaacacgtaccttgtcaaacaaagtggtttttagcggctcaaccctgcatcgtttaactcaattaattagagaatacatccccatagagttgttaagactgctccagaaggcaatgcaagatgggagcgtgcaacaatgccgagtgaatcgtgtttggatatgaagttctctgagctggcatctctgacacttgatcgattttagttcttaagacggaagtgccacatgagggaaacgtcactcctcgatgtccgtgagcgattttcagtgttctttgatggaccgactaggagcagtaatcacaacctcccgtcggtcctggaaaggtgcctgtgcagtcgaagcccctggtgactgactcgcgcgccccgctgctgctgtgttttctctgcaaggggtcttccaaacataatcgtgtgtcattcgcgctcctgtagagtgtaacactgaatttttaagctggaaaaacttcttggtgttgggacgctgcagctgcaagtgtggttttggggtggccgtcacggcgtcatgacgctgtggacagcgtgctggcgcgtatctaatgccttgacccgcactttgtctcgctccttcgttcaggaaccgttttacagaatatttcaaatgccagtaagcgcccaacgccgtgtaaggaccctcccgccttgcgctcacccccaggcaagccggctccgaggggagtttcgacgacttgcaattgggtgttctggcgttagcttgtctttgcgtgggtgcgaagggaagcccgcctctgacatcagttccaagctcattcgtgcgaaattttacttcaccttccccgactccgatatacaattcaacggggtaaatgaggactagcgtttatttggctttgtcagctactggcacacgcgcagcgctgcgtggcatcggctgcgggaagtgtctctaaagtgcaaacactgtggctccgcgctttcacggttttctggaggttcacaacagattttctgcgacagactgctgtggagcgcggagctcggaggcgcgtgccacacgacggactaccctgggaattcacgcttgtgggtcgcgttggagtataggggcttgcatgcagcagacgggcaccagttcagcggtcctccttccgcagaatcagcctagaggctgctggcgtcggcagaagtgctgccagcataaaggcgtggtgcacaggaggcggggggcctctcccgcaaaggtagtcctgggaaccaaagcagaagttggccggcgacacgacccaactgcggttggctgacgaacagtacctttccgtgtttttttgtgtccacagtggccgcagaacttagtgcgtgcttttcgtttgtctttcttccctcaaccgcgttgacaaaa

SEQ ID NO: 3348 - DNA, 3386 bp, Toxoplasma gondii
cctgtgtctcaactttggatttctctccgcccgctacgcaggtcaccggtgaggacgacgacggaattccttgtctagaagagggaaagatgtttccgttgtgggcgtggaaagacgaagtgtttgagttcgacagcaagtcgcaacacgctcaccgccattttcactcgtgagtggatggactgtcactaacacgaaatgcagaaaaattctcagtttccctgtctcacaaagcatcttcatacaatggcgaggagctgccaaagaaaaatggtatgcgaaaaagagtcgagacataaaacgaaaacatttcgattgtgcaaacaggtcgcgggtgatgcctactgtgcatacgggcgtcgttgctagaagtgaagagggctgccagtgaaaaacgagggttctcggcgaactgctgtagtgtggagagagtgatgttcccggcggataatttcttacggctaggcagtatgcgggtgttttttatggctcttgcaatttgcggtgccataagtgacatcgatcatctcgaccttcttgctaatggaggggacttcccgtagttgatttgtttggggctcctccgacaaactctcctcaggtgttcaagaaaataaattttcaccgtttcttgtgccataaaagttgcgaaaagcagcatactaaaccttggcgcacgaatcttacgcgtgtgcaaactattaagagcacggtttttgtgaagaccgcctggtccggccatcaggaaggaagcacatttccaagaactcgaggcagaaaggaaataatttgaacatttcttcgattggaaacagtttcattttgatcgcaagctgtagaagaagctcatcagggagtccactcgtgcatacaggcccattcgatcgtagcatgcgaggaaacatcagggagtctgtcagtggtcacaccaccggcaggcgagccacggtttcgaatttgatttgtttgtattgatgatagtagtgtatgacgcagtatccattatcatggaacccagtaatttcgcaaccgacagactgtaactccggacccccgcacaagctctggcagactggaagccctgcaaccgagaagtctgaggccgagacgtcacgacgcggttctttcaatagggaagcggagggtgcgtcacaaagaaaagcgtctttctatggattagcagtgcatagggcaactataatggctgggagcaaacctccggtacgtgttagtcatcattttcctccacggtagagtaagagacggcaccttgaatcatgaacacacgacattgaggtgttgcgagccgcatgggcgaatattagaggcgatctagtcacccgcaaagttttgacatgggaatggcaatacaacagttcagacaggtcctatatttaggaagtaatgatgccgagatcacgtaacgcttcccggtaggtacgggtggttcagcaggtatgggggagcatgggcagcaaacaaacaggtcttaggacccgtgtagcggagaatgtgtgtgaggttgtgccatagattctcatttctgcgcaggcgtataggctggctgaaccgctcaaactcaccgggtctctcgcaggtccctcggtatgttaaaagttgcatgcaggcctgctggtgccaagatgcacagacctgattgtgaactcttcgttcccttgaatactacatgcctatcatgcctttgcaagggatcttcttcccctctgcagcaaagtatctctcacaagaacgacgccaccccaagggaattccgtgcactatccgtgattttgacgcacgatatgaacacggcagagactttgtcctcaattatctacgatgatgctgcccactccgagtgaaatgtgtgtacacaaaactgcgaagaaggtggatccctcggtacactttcatgccattaagtgtagaggtgcttgtcccaagtttccctaagacgaacgtcgcgtcacagttgcgttttgaaacatatcaacctgaaacgttttttgttgagtccccactgttttcccaccatgttgtcggcggaagaacgtaatcgcctgtgggtgccgcctgaactgcaccagttataaacgtgttctatggaacgaaaaaacggaactctcagacgggcgatgtcttttcttgtcttggcgctgttgcacatacggtggctgtttttcaagggtggctcgctgaaagtagtgccggcgggtctgccgacttttagtggatttgagaacaaagtgtgatggatggaacgtaacaaacggtgtcatggcacctgccgcagcctttttgcttaaaaagagaaagccaactccggagaggaaacagatggcgcaccgttttttctggaatgggcatgccgacctccccatgtgctgcagttccccgtttttcgccccttccgatcgcgcgcgagtgacagggtcgtggtcgttgcgatacacgaacttccacctccccgagcaccgccatcaactgtgaggccccgcgaccataagagagaacagcctttcttccgcccaacgggctgccgattgcttcatcgaaattcttttggcacttgctctagatattatctccctttgcggacgtctctacctcgcacttcattgtccggcgttttttgtctttgggatctcgaaactttttttccaaggtatctttttcttgtccccctcgcgctgtctaaggtggacttggtgcaaacgaagggaacacgtcgcttaaacctcgtatatgttcacgcgagattgcgttttgacttgccatcattcttggcggaatccggcgattgcgcttttttttcgtagcaggtaagaatatgcttgaagcaagcagctattttggaccacaattcgtggtgcccggctcggacggtgtcatgggcgacccgtgacaggagtggcggtttgttggccatccaccttccgctttgttcccttactctggtggacgaatgataagcatccccaccttgtgcatttttttcagatgattccggagctacgtttctgtcgtttatttgggtgttttctgcgttcctcctctcccgggtcgtgttttctgttaccgaacgtttccgtgcgtttagtccggcaagaatgcgcttttccctgtgcaccctgcacaagtagtgtttataacattgatctgtgtacatgtcagttattcgccccaagacatagagagtgtacacacgcaacaaaagaatgaacctatgtgggcgcgtaactgcagagtgacgtagctggtttcatggaacatcgcgtggaaaactggttgtcatgcgcatttgcatcactagtttgtcttatacagcaggtgcaactgacttgttcttttgtttgttttcagctggcggttttaacgcttcaaga

SEQ ID NO: 3349 - DNA, 4466 bp, Toxoplasma gondii
acttgtcggactccgcttcttccattttcgcctccggagttagaccctgggccttggagttgtctgcttgcttatacgagaaccccagcgtgccggaacggtccttgcctccgttgaattcgctggactaaagcagatgaatttctgcacagagacactggcgtgtggcacactctggagcgcttcgcgctccacttcaaaaacggcagagtgtttcgcgggtttgtacactcttgagattttcttgtttcggcaaaacgcccacaagtgtcgaaccttacattgcttaatgcaacgcggagatggtcaccttggccgtccacataaaagcagaacggccttacagacgcgtatagcgaccgcagatgtctgcagcgtccggggcacggtggacagagcctcgcgcgccgacgttcaagagcacgtggccgccttgcgattcgaaatagcgactccgctgagtattttgaaattgttgatacgcacgaaattcacagagacagtggctcagcctccgtgctgaggaaccgcggcatcgcgcttcctcaaacgacgtgaccgccacacgcgacacaaagacttttacacagcgggggtgaccaagttaccacctgaggcaaggaaaatctccactacccgccgctgaactcgctctgtacagagtggaaaattcgacacaggaccgtgttgcgctcgagttcgccacaggctcgcctcggaagaaagtttgtggcacgaatccaagcgccgcagagagtgggcagagccaccttagtgcgacacaggcgcagaacgcctggcgtaagccacagaaataacgctgagagtacagacgtcttccgcctgaggaatccgtttggaaccgaccaacgagagggaaaagggtcacagagcgcatgcagcacggctgaaagggtcgtgaccaaccactgtcaaagagcccggcaactcaacggcgtttgacagcgttttctaaaccgcggcgttcttcgcggagagaaaacgtagacggacctgagagaatgtggaacaaacgtcgcgttccgtcgccagaagcggatggaaacaatgtacgaatttacagacgctacgaagccggcgaggtcacgagtgggagcagcggtcacgggaatgttgagagcatggacgcgacagagacgtggcagggaaaagaaccgtggaagcacatcggcgcgctcaggcaatgtcaagaaaaaatgtttcaaagatgcacgcaaagaaaatgacaagggcagcgcatcaagcgggccgaccccaaacttgaagagttgcgatgccgcaaacattggctacgagacccgaaacgagacacgcacggactgagaaaacgatttgcaggccaggaagtgaagactatgtagccctcgcctgcgtcttgaaaggcaaagaaatcaacgaagtcctcaaaacaagtcggttttgtccgccactgccttcagcctagatcgctatgtcgtcgtgcatgcgctgaaacagttcaaagtgcttccaaatagttgaacacaactacgagaagttacgggtaaagcaaggcagaacattcttctgttccttcatacagaagacattcccttctttgacgactactctgacagaacaaaccaggtccgagagttgaagaaaacgctaaacgccccgttacgcagtagcatgtatgtgccttcacttcgcagattccccctttacgccagtgcttactgtctctgttcgccgtccacccggtttcttgctttttcttacggtaataatttatccagtttggcttcattatgtacgtctgacaaccattatgaaaagctacaataaagtgatgtaacttcaaagaaagtggttccgccgccgcattctgtgagtcttcagcttgtggcgagggaaaaggcccttattcttttgaaatttagctgcggatcgactgagtatacgttgcgtgatacggtcctatgtctttctgtgcgtgtagacacaatcctgatgagcgaatcttagtcaccaatgcctcattctagagggatatgcgtgtataggtgaaacgttcgaaaatgggtgccgttgtcaggtgcagaaaaaacaaagcgtttggattacagcgcagtgttgttcacgaagagctaatagaacatgaaaaagacaaggctcagcaagaaaccgtaattagatctgaacgcagtctctgccatcgggtactggtcacgcgaaatgcggtctataaaactgcgttaggaccactcaccgtaatgcatttctgattgggaattaaacgagtagaaactgataaaagcatgcgcacgttgcgggtcaccaactggtcctttctccattgcacccgacaagattttacggagctcgtgaggcctgcaatttttgtgagaggtccatgcagaccctgccgtgtgcactgaccggacctctaacgttgcattgtacaagaagaatcgttgttaatgcatcttttctggcttttctctccgggaagcttgttatctccacgccgtttagatagggaagactagactgttcgtgccatgttacagactaagctgtgttgcaagatacacagacagcatctggtgtttgcacaggtgttttttctggatcctgttgaatcagaaacaagtgcaggctgaaaaagacaagctcaagtatagatatcaatacaacacgcagttatgcaagatctagtagcaggcggtatcgtttctaccggaaaatactacatatcgagaagcgttaagcaagttttttttccgctgaaatctcgacagaaacatggttcgttgttgagcacgtctgcatagtatctaattctacaaaatttccgttcaggcgagctcagcctaagcccctccatactctgctggaaaaggtttggaaacagtgacttcagaaagaagctgggcggttcatcgttccccgtagtttgtcttctctccagattcaaaggaagaaggtgttaaaatactccgggcaactcgatgaaactcctgttcaactacttaaaaaacatcacaatcttcaggcgcctttcttctctttttattgaatcttattccgtgattcattgtcgcttcctctcacgtctgaaaaactgcgtactgtctctgtagaacacagtaggtgcagatttcaacttggacttgtcgtttgctatgcgcccgtatagctgacggagatatcaatacttccacgatggcttaccgtggactgttttgcttaccagcggcgtttccggcgatatgaacgccgcagtttttcgcctcagacagagcagcggcaattgtctttgaccgactacgtatgcaggagacgcactgtgcacgtgagcgcctatgaatatctcgtggattccgttccgtaggtttgttctgatcgcagagtcgcctcttcgtgcttttctgtgtctgctctcagtaatctggtgtttcatgtcctgaagtatgaccgacttggatggtactttccgcacagatcggcagattcagagctcgcgacactcccgactatgttttgaaaagactcgaagctcccatcacgaaaatcgatgtccgttctgtcctttcgttaccgtctttccttccaaaagacctcacaagcgccacggaagtagacggcatatgttctgttctgtttttctggtcagccgagctcacatcggacctttgtctcggcaggtcccagtcaccacgcatgcgcacacacgacagcacggcggttgccgcgcagaacctaacgcctcgcttttctttctccacagatgctttccttgcgaactttaccccactccattcggcgcattcattttatcttttgacatctgttgcttgtgacaagcgcacgtttctgcctgcgttccaagagcatgcgtggctctgctcaaaacctcaattcaggacaggcgcatgcgcagacggcagcttcctggatgttacagaacatctcttctggagcagacttcttttctggtggaaaacgaatctgttcaacggagcggatgcgcacgaaggacggggggaaagaaacattcgatcgtggtcgccgtacgtctgtgcggcgttccgtacacaattgccagcatcgggaggcagcgaccactcgtaaacaataccgactccgacagcgtttgcaagacttagaagctccggtggggaatgtgttatgcgtaccgcgtttttctttgtttgttttcgttgaacggaattcgtgtgtgcacaaattccccctgggaggtggtttacttacgttgaattcgcttatgtgttcgcacagtacactgtgggtatctcgccgttctatttcggatttcactcacttgaatgaccatttcttcctgttaacttatgtcactttccctcgtactgcagtccagcgcctggtcgtcagcaccaccgctgcctacttcgtttgagtgacaggtcgtacgcaaagcgtgcccggtcactgcccgaaaa

SEQ ID NO: 3350 - DNA, 4764 bp, Toxoplasma gondii
aagaaggcagagcgggcaagagcgaaaacgacgggagacggaagtgagagggaagacgagaagcactggaggatgaaagctgcagggacagaacctgaggagatcccgcaacaaggaaaaacagagagatcaagaacccagtcgagtcggctgtccaccgcgttttcttcctcggaggacgaacgtggagatgagaacgaagaaacagagagggtaccattgtaggaagggggcggggatgatttgttctactcggcagaagaatcggagaagagagtgtctctctccgagaagcagatgtcgcgctctcgtcttctttccgaccccaaagaagtccgctcagtgaagggagaggagagcgaaaaagaaaaaaacggaaaaaagcagaaaaaacgaagaagagagagagaggcagcgtccatcaaagacaacagggaagccggaagagacaagagctcctctggcgtctcgcttcgctgttttcacctttcctcttaaaacgaaactttgtctttaaacgtctgatctccgcgtcttctcggctcgaggcccagggagagacgccggagaaaatacaaaaaaaagtctgcccccggcagcgccgacgaaaaattcgacgttctccatttctcggagccaggacggaaagtccagaccggaggaagagacgcttcacgcagagaagaaaaggtcgaacagcgacagccaccgccagcctcatgtgccaggctcaatcctccagacggtggtcgaaaaatacaaataacgagagcgattcattttgcagggacatgtttacatgcagacagatatttacctctcgtatctgtgcacatattatctacacatacttacatatacatatatatagatatagataaagatattaacatatatttatagatatttacatatatttacgtatataaatatatattatgcagtgtgtatgcgtgcgggtttttgtagacttcgtctgtgttggagatgggggttcccgcatatctcggttgtctgcgtctcaagtcgcaggtgcaagaaactttttaattttttcagaacgcggagagaacgaacgtcaggaatctggcggatctgtggcgcgcgcatgcaacgacgcaagacgtcttttccgcgttcgagggaatgcgctggctggacttttagcatttccgagaagctccacatcacctcaacgaagtgaaaacgataagacaggctggaaagccaactgaacttcgccagctctctccgcaagtgcaacgcagcagcgaaagaactctgccgaacgatacactgggagagaagaagtggagacaacgcggaacagcggcgccggggagacggcgagaagcgttttctcgctcggcattgggagaaacgattcaaagacacacatctcttttctttctatcgcctttcaatggaaagcaaggagaaaagccggcagccttcggcgagaaaatccgagacggactggccaaaaggaacgcatgtcctcgagccttctacagcggtgtgtggctgctgaaaaaagcggaaggccggacggggcttctgaatcgtcgccgtcgctgtcttgccgccttggacagttgaggggaatgtcttctgtcgagttcaaggaacgagcaaagtggacgcgtggtggacgtcgtttacccttttctttttagagctgcgtagtgagctagacagcacaaatcagatacgatgcgcaggagcgtttgagaccgacactcgagccggcagatgttttctgacgctggagcaggcgctatacttgcagctgcgattctcagaatgcgggtggcggtgacttctgagcctggagctcgtcacacacttgcgtcaagggggaacgacgccggtgcgtctcgtcttcgcgcaggcgtgacttcgccgcgaaaaagccaacgggaaaaggaagagccgcgagagacgacctcgctgagacacagcacggccttcgttcaagtcgacgttggcaccttgtttgccactttgtcggttcgatgaaagctgaaaaagatagaacaaggtgccttttttggcaacgggaggagtgccatgccttggatcgctgaattgcccctctcgttcgactgtccgtgacgtgcaaaaacgctttctttcacctacactttgcgcctctttgtgagcgctgccgcttcttctgtccgacgtgaggtgcaggcgcatttaatcgcaaaaggtctcaaagacgaccacagtttcacgtgtggtagccaggcaacagactctgtcgggagctagtgagagtctctctcttggctgagtacagggtgcaaccggctgtcgaaactgttagtgcgcttgcctttcctagagggccgccagagcgttttttgaaaagtcacttgccagcactcggtggctgaagacaaaccacgcgaagctgtcaccctctctgcctcacaattctctgaggaacggtcatcaacagaacgacaccgtccacggatgttgaaccagctgcgcggaagacttgtagcccggtctcgatgtcgcttgatcggacaaacggctgcaaggcagtaggagtcttgtcatcctaaactccggaggtctgaccggcatttaatcactaacgtacagctacataagagagatccaccaaatacacaaccatccacgatatgtgctgatctattagtcgattcttcgttgagaatcaaaccagtttcccaaaaatgcttgtgtaaatactcgctggattctgcaattcttcacgctcgctccacgccccttcccgtgcataagagatcggagggtatttttttcttgttcttttgtgacctatcttgcctacacccgactgtctaagagcagcctggaaaagtgaaagaggacctggttgcacttgtcctcttttagcatcgcctgctctctagtgtcagttgttgtcgaagggaaagatcgtttcagatgtagtgacacgaggtcgaggagcagttgttacctgattgtatcaaacctagacgcttttgagaagtacactgacagtatcgcggtcccccgatgcacggcaaactccttgaatctatgttgctcagtgcatccttgaaattcgaccagaaaacctcacaaatggtgagggaagtcggagatcccatgacctattgacgcctgttgtagcattgggatgaacagtgcgagcaaacgacttctccgatgttgggtattcaatcccgtgctctactacctcggaaaaatgaagcttagattttcacacgcgtcacctgggctcgcgaagaagctatgtgcacattttccgtgacctcattaactctcccctcacttactctcgcagatgaccggcagatccacgttcatggcattcttctgtttgttacgaccgcgaaacgtccccctttgtcatacttatgttgacagttctctgaacaagaatcaaaccccggagccaagtgctcgtcccccacatcctctgcaagttgcgttcgtgtttgtttttcatcaaggactcttttcttatgcttttcttgttgaaacaatactggttttaaaagttaaggggagacttttcaggcgtgcacaaaaggcgagggcgaaactgtcgagcgaggagaagcgctgggattcaaaagtggagaactctctctcgtttttcgcctaccgcgggagagttttcggccgggcgtcgcgacggggagttctgcgtttttttcctgccctcgaggttctcccgcaccgagaaaccggatgtctacgcggcgtagctagtcccgcgagttgccattcttgctcttttgcactgctgtctgtccagcacgatggcggggtttctgtttccgctgtctctctttcactgcgactttcgattagagaaaagaaagcagtcctaaggcttcagagcccgtgaccgtccagccctcgagaaaacgcgcctttccgtgtgccagagagggagccgcgtttctcgccaaaggcgtcgcgtctcggtgttttcttcgactgaaccgtcctgacatttatgcggcgcgtgttcctctgaattcgccaggaaaaaccacgtcaacgatggctttcttctcgtagaactcgccgtctgcggccactgacgtcgcggtcacaaaaacagaagcaggccggggtccgtaaacccagcgcgcgggcgggaccggttgctgtccgaggcagccgagagaggttttgtggtccgtttctttgcgaaggactccgaaaaggatcttcgcagagaagaattaaacacaggtgtttcgggtctccgatatattttccacgcgtcccagcgaagcttttcgcctccaatttcgccccgaagcgcgagtgtgtctcgctcgagaacgagagttatgcgagagagagtgcgagtcccgagttctctcccttctttggggatccgagaatggccgttttcaccgcgaaggttgtctcagagtttttccactttgtgtcaaaggcgtgtgtcttccggtttcccgtcgctctccctgcgacccgccgtgcggctcgacggccgtcgaaaccgggaagtcgtccaatccctgtctccaggacctcgccccgtccctggaacagctgcgtagcggtcagaattcacacgctgaacctcctgagagcttcctttctctcgcggtagtgaaggagagagagagcaaccacaccgtcggtcgtccactgagaactctgttcctggagaacctgcgggtactgagaactttcgacttccacgacactccaggttcctgcccgtcaaga

SEQ ID NO: 3351 - DNA, 3995 bp, Toxoplasma gondii
gaatgtttgtctgcgcacaacgcggcactctgaggcacttcgtttgcgctcgcaggcgcgcgtctggagcatcgcgacgaaagcggagagattctttcctccgctacagagatcctctcactcggcgacactccatgcatgtctcctcgagcagagacctctgcggaggctgcgggcgccccctcctgtcgggagtctgaagccatcagaaatatcgcgttggtcttgagaggcgaggacctgctagccgtggaggaggacatggacttgaacccagctctctcagtctcctcggagcctgtcaaaaccgagtgcaaagccgggagagcaggctcggagggctgcgacaagaaactgtgtgtctgatcttcggttctccgaaggcgcttcgacggagagaaggcggcgacgctcgacggcgagagatcggagtggcctgcgtcctctcgtgctgcggtcgcaggggccgctagttgggctccacggccagagccgacaggagacgaagaggagagtctcgcgagcacaggacggctgggtgaagaagcatggcgaagagtcgaagacgctcgagaaggcagggggatgagcgtggtggaggagacgccactggtgcccatctttgggcgagaagagcgaatcgcagatgcgcgagacagatttccggcttgtcctctgctgtctcctgcgcttgcggcaaagcgtttctcttcctcctctccctcctcagctgctcgccctctgctctcatctgcttgtcttccctcttctccctctctcgcgtccaaggacgagagacgcgggtgaggaatgccggagacatcggcgttgagagacggtcgtcgcggcaggggagaggacgaaaacgaaaaggacggacactccgcagcagacggcggcaactgtcgctctgtgccgagtctaaggcgtgactttgaggagagtggaaatggagaaccggcatcgtttcgttcgcatggagagacgcgaggttctcgcagcggagaggaagaacctgccgcctcaggggcaggcccccaccgcgggcttcgaacgagaaccatatcgagttcgaagtaaaaacgacaacaaggttgactcctgtttagatcttgaagcgctttgtaaacgaaacccaagttctacagcgttcgaaagtgacatagttgagatgacgtagactggggggaagcggagcagaaaatgaacaggaagagcagctggagtctatggaaaggcgaaacaggaatggcgctggataatgcgactgttctgacagacaagatgacagaccgcaacgccagagaaacaggaaaacgacagaggcagagatacctgtctttgggcgagtgagatgaagcagatggtgaaaaggggaaaacggatgcaaaaggcctacacacacgcgacgtgacggctggaaaagcaaaagagacggagaaatagggtgcccaggaacacaggggaaaaaacagccgagcaaggctttggcgtgagaggatgagggcactgagagaaggagcagtggaaaaaggtgggcggtgaagacaaagccgcagagcgtagagaaactgatgagttgggggaagaaaaagacagaaacacgagaaagggggtacagataccgcacaaggggaaagatgacaaagaagagagaagcgagagaaaaggccgccgagaaagcaggcgaaaaaacaggtacgcggagtaggcgggcgagggggaactctgcgtatatgttcgttcgttctgctccaccgcaagaaggccagactcaagacccacctcaacagaggaagttgacgtgtctggcagtaacagttgctttaatcgttaagtcttcttttccagaataccacaaaactacggaaagcgaccatgccaaccgcggcgaaccctcccgttttttctgtcttcgacggggtgtgctcgcgctcgcggcccacttatgttgcgcgacaccctcgtgtggaccctccacctcttgatgttcgactgtttcttgtggattttctctgctgcgttcgtgtctctctctacttgtgtgtttctttcagttttctcgcgatgtgttcggcggacctgcggtcgaagtgcatgtggcaatcgcagacagcaattctccacggtgaccttctccgcgctttctctggtacccctggcagctgtattattggcttcgcagatccgtttctcgttctttgctctcccgcgcctctatacacccgcactctcgcgaatccacaccgacttgcccctacattcgagggaaaagttaagaaaataggaaacgccttttaccacgtgaagtcccgtatactgcctaacctaaagtccaccaaacccctgtgaaaggtgccggggtacttatcatccgtctgtttacacatgcagacatgtgtaggcgtatgtagtacgcaacagagaaagtagagaagagggccccacgaaatcgaattgaaaattaagatttagcccgaggaacggaccatatcagacacaacagttctgtcgttctcgaccacgttactccagcgagacctcttttccacgttgaaactcttcgttctgtttcccagttccttggttgccgtgaaccggcgcaacaatgctgcagaattgagtagtggttacaggagcgtggtgctagtagatttgatctgccactgtaagcacacgagcagtctgtctgcccagccgacttattctctaatagaaccgcgtacctccctgtgtcttcagccttgagagttgttttcctcggtcttcaggcgtccccgtaaagccgaaatgtcattctcttttagcgtttgtgctctcgtcggttcttcctctcgctcgggcggcttcagctttttgaaggaagtaatcgctagaggttgtgtgttaaaccgcggtgtggccgcgcttctctctctctttcgcggtcccaggaggggcttttaagaacagcagacagctggaaaactcgcgtttaacggtctatcagctgcccatgtgagtggacaaacagttgtagactttggtttcgccacgaacagcaggcgcgagaacctgggctactctttgaaaacgaagcggcatggggtccgtccgtctgcaaaaatgctcgggaaagaaggtgaagggaaagagtggcaatcgctctctattttacggagagcctggcatgatattgttatggtcttagctttcaggcaagctagttatcgctgcatcctatacacactcaggcccgagagatatttttgcgctccgtatactaaaaggcatgaagctggaaggcgaatgtgcatgcggacatacgtggaaactctgtccgcctgtgatagtctcgttatctctcggacactgagagagagagacaactgctttcttctgcaacgaccctcttaacgccgaggacggacatcacaaggacgggcaaaagaaaataacggagcttttctgaacagaaggacccatcgaaatcccgttttcgtctttaaatactaatgactatatttgaagagacatttgtatacatatgtgctcaaaactatccttgacgtacctactgacgtttactccacaggtacaccatgagcatagatgcacatataacatatatatatatatgcatttgtttgagaaatggacgaaacaaaaagtagtgacaagaaacgcctgcagggagctaatgttctcacgcgttcctcgggatgtagtgcctatcaagctcatctgcataactcttgttgcctggcttagggagtcagggcgccgttgttctctcgtcttacgcgggagcccacaatgtggtgaaatttgcggcttacggacgcaacgttgtctctttgttttctgtgtttgacactccagaaaagaagtctggaaagaatcgcagttctatcgaggttcaggtgcgacacaggtcacagatttagcgtcacggcatgtcttgcggttcctcaaactgtgcctgttctcttacacgtcgtctccgcattccacca

SEQ ID NO: 3352 - DNA, 4210 bp, Toxoplasma gondii
gctgtcgttttgggtctgtgtttcttcttgttattcaactcgacgcgttcttccatgatttttttcacaagctcctcgacggccgatggtctgtaccgcaaaacagggaagtcaataatatcgtacagcgctgtgtacggcgctactgcagtacggccaatagtgttttgtttgccctataggtggctgaagaggagcttctgacaaaatatttccagagatacatttctgggacgtcccgttttcctcgctgtcattgctataaacaaactgagatcgcaataacaataaagatggtaaagatgccagttttagtgactgcgcctcgcaacgtgaccgcgtatacataccttcccattgtggtctggggagaagcgacgtggaccgtgccaacaggtgctcctttgacttttgacacatttttcgccgtagtgaacgtcactgccatctgctcactttttccgcggcctttggagaagtagcatgcgcagtcagcggccaactgcatatgatgcttcgtcggtttccacgagcacccctgaccgcgtagaatcacgtgagctccaggaaagtcccttacatggaaccacaggtcggtaggccttgcaacgaccaagctaacacgctcgttctacacagaaaaatcacattcaaagaactttgtatgttgtgttccatcggagaagtcgtcacacagagcactgaaggtccggagcgcttgtgaacgtgtaaaaccaatatgcggatgatgctttcgtacggagtatgtgggacccgctgaccctctccagatgggtgagaactaacgctcttgaatcgtcgagattgcatgttcaccacgtgtccggcggagtcgtgtcagataatctgtcatcgatgccgtcctcattgccaaagggtagaccctcgtgttctgcgataagttttctgtatggttttagcgttcaaaaaaaagagggatccaccccccagtattcagaaaacgtgggtacacctaagccaaacatatttgcctctgcaaggaggtgcattaactttagtggactgacctgctctgccgtccgcccaattatcaacgtcgtccaattaccgtcatcctcgtcaatcttcagtgttagcaggccccgctctacacccgtgtctgttgtaatccatcgttggttcgactgcggactcgaaggattcgaaaaacaagaaaccagctcagcctacgcacatgggtagcaaacaccgggtcgaaggcgtattctttctgtttctgtatggatgcacctatgcaagcagaaaactgtcgcctcagaaccacgcagtctggcaagcatttagatcacatgatcaaagcatggcaagtccgctcaaagaaatgctccactttttatcagaagaacggcacttttaaatcggattccatggtgtgcgcaacaccgtttctgctgtctaaacctctccgtaccctgtgttgtcccactatcggggctgtcagctgtgacggtagaattgaaaatgctctcgggagatgatgcctctgtctcttatttgcctcacaatggtccgctagaaatggggaaatctcacagaaatgagttcggtgcggagtggcctccactcctgttgaaacaaaattttgcaggttgttccaggacgggccggaggtaccctgccatgcgggggtgtaccgcgtggagaaggcactgggaaacaagaagttagccgtcctcagcaatagtggacgatgatgccgcatcgcataagcgttagaaaagtgtaatttcataatacaagttgtgacaatggaagtgataaggatcagaacgccgtggcggtcttgcattcgggacccccgattcacgacttggaagcgccgttggcatctcaaacacgcacatgactccagtaagctttgatgctttcagatatcttaatgtattcaaagcaaagttaggacacttttcaaattagccgacacttccatgtcgagaaccggcggcagtttcctggagctcaaagaatgcatgcaagactcaacgatggacgaataagcgttggtacctctgccggtgtgttcgttgcaatggaggcggcagtcctaggagctatctcgatggtgggcggcttcaccttgacttggacgtcagcaggtgacgtgccggtgtcttttgtgatcctaatttcagggggatccaatcgaaggcctgattcgggcgatgcatttgcctcatctcttgcgtcaacagtatgtgtctgactcccggtaatttcttctgtgtcacgacccctccccagaggtgattctttctggagggcggcttgacgctgcgcttccttcgcccttttctcggcctcctcaatctcctcgagttcctcttttcccctctctgcggccacctgggcctctgtctgttgaacttcgcaattagctgcctccacttctgtttcagcgtcggcatgttcagccgacttcgagtcgcttgagttctgtccgggtttctgcgatctttgcggtgcgaggctgcgcatgtggcggttccacggacattgaaaccaagataggaatacgacacctcttaccgatctaacgtgtcctcgagcctggtgaacaatttctttgtcacgtgtgaccagcagaaactcagtgtcacggttacctcttctggtcagtcaccggctcctctgaggcgacatcatgcgcttgttcgctcatctaataagcaccagtggatataatggtctgactgaagcctttatttgtacgcgacacaccgtagatggtagttcttctcctgcagaaggcggtgcacaaggaatgtgtgcgcgaatgttctgaatcgtcctctccccatgatgcgcctttgtatgagccacattgagcatgtgttgtttgtgtatggcgtgttcatgctctattctccagacattgtatctgtttcgttagtctgagatgaatgttgcgcaaggaagatagagagtcatactttctggcgagctcgttgtcatgctcctttcgagaagacagaacatcctcggcatgggagatggcagcctctaactcgtcgattccgatatataactgaggaaagcgtttttctgaccacccatgcgaatgcgcagttgcaccgataccctacaagcaaatcttgggatgcgaacgacgtacattttccttccaaacctgattttgcccacctgccgcaggcgggttggaagagatttcccgcgtgtcgtctcatatccctggacggtgacccacagaaatataaagagacttagaaaacgcaagacaaggaatcccattttgtcactagattattcagcggtgcctcgttactcttttgaagattagaagcgtgggcggctaactggagctagacagtaaataacagtcagttgctgctgtacgtactcctcacatgagacatcaactgctgtacgaagctccttttgctcgagatgtcactttaggactggtatgcctcagaatacgaaactatctgtaatctttcaggctctgtgtgtagtggtgtcgaggtcagatacgctccagtgtgccatgcgtgggtggtcctcaacactaaaattaatgcagcgctgtgtcccaagcatcgcgtgtgaaatgcagaggaaatcagtttgcgtgcgtaaattagatatggtatggggcaagtattaggtgatgcagtaccttcctccccttcttttccaatccattccccactctttggccctacagtgtacacctggtatacctggtttttgtctgatcgacgattctgcgcattacgagacaaaatcccacaggcggtgcttcagtctgtattaggtaataaagcagcatcccctcccacggcagacagcaactgtcgccgcattgttagaaaaacacctgcattgtatgcagctccagtgtttcgactggtctttctgtgttgcctatgagccggactgtatgcatacctcccagcggccgagcatgggtggcgggataccctggcgcaggctcgcagctcactgcagtgattatagaggcagtctttcgtccttcgtaaacgatgaacgaagctaactagattagcatggagccttcatagccattaatttcttcctagattttctgctgtagaaaggtgcgtgcgtgtgtatattgtccgttcgcggcagtcatgcagtgagccctgtgtcatgggtaatgattggatataacttcggggggaaa

SEQ ID NO: 3353 - DNA, 1940 bp, Toxoplasma gondii
gtagcagggtacacggcagtcagaatctactctgttgcctcttcaaggaagcaagcagttgacggcgtgggacaactcattgcgcacgatcgcagacaagacgtaacttccaggaagagggaatttccttattttgaaaacacaaactctctgcgtttgaggtagtctggactaagtgacagcattcgagcaaatagtgacggcggtgaaaagtggggaaacatataaaggctgcaaggtattccgattaccgctcgctttcacagaggactcaggagactgatgcgtctttttgttccactgtttgcaaggaaattgacaaactgttttccatcctgtgtgcttagtcagcggttttccgacgctcatattcccgggtccaggcgctgacgctcccaaagtttatctcacgattcactcgattgtgaccagtccaatagttacgtattggatcgtagcgaggcgtttctagcccatgcaaatctcttctatgaaggacaaagcacttgtcgccacacacttccaagatgctgtgtctcgggcgtttcgttatgcatccacacggattgtatggccgtcgcagcctcgagcgttcgcagacctacggttccgttgagcttcttcaaatgcgtgggtgtccctcgatagtcaacgacgacacttcttactttcacagtcgtcaccccactgcacagctggcacgcttgcgagtttcctcctttctcttagattgaaacgagtcaagaaagtgcacgatctacaaacgaattccccagaactcgagtctgcgtttcccgattccccactacagtcggactttctgacgctcttctaggaggttttcgccacacattaccgccccgccttttccgctcgcaggcacacatttcctgttttggatcaagtgctttctacaccgcacaaaccagaagccgtctcttgtaagaagattaatccaattaaatatgatagctgtgatgtaaagaagcataggaaatgctgcacaccttaattgggcggtaggaaactccactaagacgatgcggattagtgccacgagccggtcggccggtattgagtttctgccatgagagacagacgaccaagtcctttgcgagtgctggacaccatcgcacccctggactgctaaatacagctatgaattctgaaaaccacgacgctacgacatttaggttgttgctcatcagttacgttttttgccttcctaagatgccgccagtgccgtttcggaagagaatgttggatcgtgcaacatcgcaaccatgccggtggttcttctctatctagatgttggctgctagcaaatgcccaagatgtccctgaagtaatcaggaagctcgcgtctaacaaattcaactgagtgtcaatttagatgcgctcagacgcacattaatccttgcactcttggccgcaagccgatttccaacacagattcccgtcgctgcatttcttctttgcgaccagagtggcgtagacagaagcgaacagtgtccgtgaggatggtaacagaagccgcgtgatctgtaggggataaccgcactttatcccgaacttgtgaaaggtcagtagatcttggctagggccgtgctcgccacaaacgctcgttgcatgcaactgaatacgctgccttcttccgggacttgtccggcgtcgactcaagaattgaaaatttctttttctcacctatccttctccttggtgtgtctgcctgcctataggcgtcatgtttttgctgaatgcgagtcacaaaggcacgtttttaggaaagagttccctcaaaagtctcatgtgcatgcgcaaaccgccgtcgattgagtagctgtcgcggcagccaggtgtcgtggcagctttaccagctgctttttttcgcccgcgtttcttccccattaattttcctctcaactccagaaacgtcctca

SEQ ID NO: 3354 - DNA, 3467 bp, Toxoplasma gondii
ataaggacagctgtcccgcccgaagttctgtgcaccggctatctacagaggggcaaacgctttgctgttttgcttcagcccatgcgaacgtcgcttccacggatgtgtctcgtccttgggctgattcttacacaggaaatggcgttcaaatggttacacgcaatttgtttggataagtttttgtgtggaatgtcgcgatgctaacctaccgccttgcttcgaccccgttaacagaggtattctctgtctcaacggagatccaagtgacttttttcccagagatctggaaaggaccctcacactacttcatacgttatgtagcgtcaccaccatcttggcaacagactccgcagatattggaccaagacaaagcggaagtcacacacgacgttcggttagacatccttttggtaatgctagcaatggtagctctgtctgctttctcagcgcttccagagcagaagcagacgtgtcttcgggggccaacactcccggcattctccaacaaaactcactcaacagaccggaacgaagggtgatatgaactcggcaaaaagacgcgcaggaatcgttgtaccagtcgtttccgtggaaccttgtctcagattgcgactgccgcggatgtgtaggtcgccacagaatcggagtttccttgaggatgtctggggcgttcttctctggaacggcgttgggaatgctttccacctctttctaatggggcacgacgtcggatggagaggcaagccaggcctgcacagaagctgctgttggcgcgactgattaagttcctgcggagggcataaacgaattcgcttttaaagggtttacggtttaggagatgggggaaaagatcctgtatcagttgcgtagattaatatttccaccgagacgaaaaggactgccaaacaggattcttatggcttccctcagtattgtccctgtttgctgtttgccactttgttccccgtggctcgccattgtagtgcggaaatggcttcggtcgtcttcaaatcattcgaggatactatttgtgtctagtagattatctgctttttcaattcactcagtcccacctttctctctgaacgctgcacagaaaaccagactcgatgagaaaaaagtaccgctttggcactcgttctggttgttccgtggcattgttcggaagcgtgacagattagcacagcaaatccactaccgaaacagaggtgttcatcgctacacttcaaagttccgctctgttcactctttttatgtttgtaaggtcaaaagcgaagatggaggttcacaacattcagcgagtcgccttctaaaggggtataaacgaacacagttgcggctctgccagggacagcctgcagttgagggtttcgttacagtcacgtaatcattaatatagagattatgtcctatgacacttccatagtctctttctgcttaagcgttaattgaccaacggccgacactctgtagcttggagaagagcaatttaaccgcctcgaaagcctctctaagcagattcgttaccacgcagcacgtgcctttaacataccataaaaggacaggagctcttgaacacccaacaacacaatctcagagagtgctacgagggattgcaaatcaatgtacatctacggaacgactagcttgaaatagttttgctgacaaaatgggagttatccgtgtgacgagcaacaataggagcgatacgtgattcgagtatgtcagatactgtgggtgccagagaagtgtaagagatcgtgcttttcgaagaattacgaacgcgtgaggtctggaagcctgcacggtcgcccctttatttgctgaaactttcaatgtggtaccacctcctagcttgccagcgatcaacgcttcgactgctactctggaagacggtagtcagcagaatgatactgtttctgtcagcatacgatagatgctttgggtacttcaaaatccttacatcgtatgcttctcccttcggcgtgtcatctccccacctccgaaaaagtggccgcagcctgttttgtttttcgggcattcgtcgtatcaggagtactcttgacatcattgctggcatcctgactaccctaagtggcttgtattccgcaccaaaatcaaccgatgactttccgatgtcaccaaccggggcgcctgcctttcaggagaaaacaggaacaatcgtgaactcctcgtctggacaccatcggtccgcttcaaatgcccgtgtccatgaggctcgcaatcgtgaatcaaaatccttacaactcggctcccttgcttttcacagatgcaacgatagtccggagaacaggccccgcgtggcctctagtgacctctagtagaagcgacttgtagtgggaggtattatactactctcgaagaaaccgtcagcagcgctaaccgttcagaagtcgacggggaacttctcccctctctttttgccctatgaagtgcgcctgttaactattttctacattggccctgcaattttcgtctagaacttttcagttctaagttctgcctcagtttggctccttggcggagaaccaccctgttcatcccacacaatcgttgtctcgctgtgttgtgggatcccctccagcgttgtctgcggaaggcagagctcgttcgagctgcaagaagttttttcgaccgcgggagatattcaagtgagaagccgctgagcagccgcgaagaaaaccggcgagtgactctttgaggcaaaaatccttcgcggcgggtggctccttccgcgtagagtgagcaactggaggggggcgttctgggagttgcggggtgccacgcactcctctcactcgtctgtaagagacagatggggcgggaccagggggaaaagggttggaaggagtcggaattcgggtgggatcccgtttgcgtcgcaacctgctgtgtcgctctcctctagttcactcgatatacgccgaggagagaggaaaggacggggggtagggggacatcgcgcgcgtgggtcaagaggaggggaggcagcacgggtcagagaaggggagggagcaccgaagaagtgtggaaggcgggggatggcatcctgggttgtttcagcctcgcgtcgcgcggcgtgcctccgcctccttcttctctgccctctctgctcgtgtctctgcgttgccgctcctctcatcatttcctcgagggttccgaaggacggtgtaacaccgtggggctgttgttagacgttttttcgtggttttcctcggctggcattttcgagcacgagacttgtctcgcccggttctgccgttgtgaaaacgtttttcgttctcccgccacccgaaatctcctccccacgcctgtgcaaccctgctctctccacacgttcgtttggggagactttgtttgcggagtaagacgcacttcttgcatacttccaccaggaattcttccggtggtttcgggacatttcccaaaacctttgtgggccaaaa

SEQ ID NO: 3355 - DNA, 1473 bp, Toxoplasma gondii
catcaacagtggctctcgtattggcgtgctcagttgagtcacagctgctccgtgagaagtcgctctcgagttctttcaccatcattttagagttccttgcaaagggccgcgtccactgccatttgtgcagggacagattcgtccgccattccgctgttctgaggatagaaacctctgcgggagatgcgcgcgcgactctagtggggtgccttttccttccacccccccccccctcacaacgtgtctgcaaaaacacgaaccaggtcttttttttcttgggatggcctcttcgaaagcagcaaaacgcatggtgccaacgtagctacgctggcagactttatgaagaaatcacgcgaaaatatgaggctgatttctgcacttaaacgcggaccacagagggagaagcctgtctgcacacgtgagcaagtccattcatgcgtgcagctgaggaacaaggaactcgaacccgtgacatggaagacgcttgggttatttagcctgcggacagaagacacttgtcatgtcgataaagttctggtctcaaacgctgaaatcgagcactttcagctttctcctgtccggtattctggaggcttctccactgccctattctttcttgaaagccatgaaattcgcgttctgagcggcagtctcggactccgctacacatttctttgttacagagattgcgagcagaagagatcgatgcctttccatttcacgggctcagtcgcaggaacgcttctatcccgagtcgccctcaaaagctctccatacaagacctatactagtcatacactcggaacactctgcagttcactggtgtggttagcagcttcaaagaatcctcaaaccaacacagacgttccgcttttgccagtacatcacacgtcggtgactccacacattatcttgacgtgctcacaccagccacttgcaccccacgtagaggtcgactaacgtttctccttttctgtgtttttcctcagaacaaaacacttccgtgtttctgccttcttccttttctgtctcagaagcactttcaaccctgagagtctgcgttcctctctacccgtcctcagtgtcctttcgcaactttgacggagacaggacgtgtcataggagactactccttggaggcttcgaccccctttgcaagtgtgattccccgagagccgacgagctttctacatgcgttgaagtccccgctacaaggcaagaaaacctattttccagagcagctgcaagccaatttgcgttgcagtgccttcagagtggcgtccgtgcatgcgtgccgttgcacaagaggcgggcaaaaaagcgggcggccgacgcggcgccagcgttcgcggtcactacggcttcccgttttctcgttgttttcttgccctgtctctctgtctggcgtttgcgccatctcgtctgcgaagcagaggaacctgagaaaggaacttggctctccccgttttcaca

SEQ ID NO: 3356 - DNA, 3667 bp, Toxoplasma gondii
agtgttcagcactgtcttgcgtcgttcattttctaccctcattaccacatgtgactgaagagctaccgtcgatcttgtttaagtttccagatcaatgagttatgactttggcttaacattgtctgtttcttgaattgttcgggcataccgcctccatcgtcgaaaaagcattgagaacggtacagttcccggcagctgcgttggatggaggaccctgcttcgatggcaaatgaacctgttttgcatgcaagacatacaccgccctttcggaaagagcgtgcaaccgagaactccctctaggtggtgctttgcgccgaaaatagctagcgttcttgtggtagaagttgcactgtgtacgctgtgcgactctaagaggaaactgggtagttttggtcgtcgttatgagcgaaatcggaaacgctctcccaaacaaaaacgtctttttgaaaaaggtgaagtctttaaagttcctgcacaccagctccgcatactcgacgggcgttgggtacgttgcactttcaagtttcactgaggccgccatccgcaaacgtgcggtcgcctctcgtgtaagttcttggtaccagaggtggcaccaccacgagacgacacattaaaaagaaaaacgattcaccgtaaagacgccagcaaccgctctcaacgcacacacgcacgttgcggggatacttccacttaaccgacaacacgagtgcgtatcgataccctgcgggtgagatgtgcatgatagtcgccttctgatccctttagcaaggaacacacctcgttcagagcaggatgccagctgcatcaccaaaaaccacaaaaacgttgtcacaccagaccgcctgactctgcaccacatccactgtgacaaactcgcacagtttccccgacatatatggtcgacgcttcttcccgcagagtataacaagcggtatcaatagtaatgccaagaaaattcaagtagataagaatggggaagagtgccaccataccgttgcatccccttgaatagctacgagtttcgcatttgacatagtatgttatagtatcgcatttacggactcacatgttccttccaggtcgccggagatccggaaagacatgtgacgtccagtgcagaactttcgaaaccgccacggacgctgctacccaaggtgacattacgtgcagcgcatttatccgacataagtgcagaataaacggaaaacgcctgtacatgttcacccccgaacacgcagaaagagcaactcgccagggtacacggggggcagtgctgcttgctttaaaaacacttttaacgaagagacaagcagttgcactaccacacacaatcaccctgtaccacgtagaacttcaagggacagttaactcttttaagccatggtgtcggaagccggttttgcggtgcgagagcacacggcagaaatcgcctgtgagccggtcccgcaaacacaagccggctgtcatcgtcagccgtgacaagcgaacgcgcagttcacctgaaaattcggaaactgctgcggaagtacaacttccagccaggatgttcatccacctctggctgccacagcatcggtgcgccacatagcgccagggtcgccacgtgttgtggttttatgatctacacagtggtgtggttgtgcactgttcgatctaggcacctgttgtacttttctaaaggagtgtgtcaaggaaagacaagtcaggaatggggattttctcgagcgcgacggagagtgcaaccaggagcatgcttgacaagttgacgtcttcgagtttagcggagtcaaacaaccacctggcgcccttttgctttgcttcgcgtaactcgtgagacattccgcgtcgcagaaacctttgtccgtcttcattctcttgcgcgtctttgttaggttcggccgcctcaccgccgactcctgcttcaccggtcgcgtcgcctgctcgctcctccgtttccttcgcctcgcggcctgccccgttttcgatcgcgacttccagcttggaaagtaaggccttcttcagatctactcctgacggaactcccttcgagatttccttctcttggtcgcgagcgagggcctttccggccgcctttagcgcctcttcaaactcggtgtccaacacaccaaacacagtctccgcaagtttcaggtaccggctcgcgtcccagaacgccggatccacgagctccaagtaatcgtcctcgacatttcgttcctcatctgcggacggtttgtggaaggagaagtacgcgtccattgtagacaggccgtcgaccgtgtgccgaccttcggcttcctgtctgctgctcgactctgcggcggcagccgttctcgagacccacgcgcagtgcgtcaacacggctaccgagcaaatcgaacacagtaagcgatgtagaattcgagtccgcttcatgatgatggcggaacaacagaaaagagcacaaaacagcctcgaggtgtccgcatggatcgcggatgaggggctcccgacccccacagcgtcgactcaagccctgcacgctccgccgatgaaacctttttctttcccttgccagccgataaattttctccctcgagctctgctgaaacaagaaaagtggcaacagaatcgtgaactgttcgcggtccaagagaagcagagggagaaactggagtttccgtaaaacagggctccgcctgcgctgcttggttttacctcccagccgccgtgacagcaatcggagaccgtgagatcgtggggctctgtcaagttcgttaaaaaaactgttttctgctaaggcctgcgacctctcggctttcgtaggtggtgtgccgtgcaaccgttccgtccactcggtgccgccctcgacagacagggtaccgatcggggtgccgtggcataaagcaccccttgaacccgcgcactgtatcccatacccctctggcgccttctgagctcgagtaagcgcttgagttgcggatttcgctctttgcgacttgtttctccggtggaaactgacgttctgcacgatttccccatggttttggcacactgcggttgccaagcagcggtcgagaggccgcgatcgcatgtcttagcagtttctttaccgtttccgcgtagtcctttgtggcgggagttgagtgcgcgcgcaacagagaatcttacgaaaccaggccacagggtcatgcatgtgacgtttttgcgcatgtgcagtgtggcaagtctggatcctcaaaacggtggcagcacggttggagaatcggtgtctcgcgtctcgaacgcaccgcttcattctgcactgtgacctgatttgaggctcttatcttttgcaccttcggtccgtcctcctcagactgatggcgtttgtgttgtgattgtcgcccgcgcaaaattgtcttttcgccggttcttgacgcgcgttgcgagcaaagcgcaccgccgccgcgttccgtccttgccagaggagcgaacgaaaaattgtcgcagcgagttgtgtttcgcttccactaaacccggactgggccagccggacagcgacaacgacgggactccacttcttccggccaagccgttgtgcggcaagacacccaccctgcattccgcagtcaccttgtgtagctgcggcggtttttggcaccgccttcaggcaaacgcttctttttcgcggaacgcgactccacaa

SEQ ID NO: 3357 - DNA, 2288 bp, Toxoplasma gondii
ttcgttgcagacaccagtctccgagtcacggagtgatgagctcaagcatgagccgaccggagaagcagcaatggaagggacagtggaaacccggaagcgatagcacccctagttccgacgataccagacagcgaaggcgcaagtttctctctgttgaggataacccacccgtggagcggtggaacgaaatactccccagtgggttttcacaccacctaacgcgaattaggacaccaacaggacaacaccataaggaagacggatgttactcagaagaacaaacgggaccacgcagagaggaaaacgggacatccctaataagtagaagttattcgagaaattctcaggcagcgccagcaagcccctttctggacaagcgctgttgcctcgcatgtgaaagaaaccatggaagaaaaacgtcggatgagcacactaaaatacgtcgtttttaccaatcaccagactccaaaaccactccgggtggctacaacactcaacggaattgtggaaacactgctgttcaagtaaacatctgtaagattcaaaacaaggcgctttcgagactggatatcgatgggcagtcggaggaggtagcaccgggtcgaggaaaaggtcaagcaattgctcctgacagaagaagtggacaaggcaattctaacagaacagccaaaccactccaccacctccatcgcagagtatccaaagcgagagaacaaaagagctgctatcaggcggatgacgaagcaagaggcgaagatgcggatccaggtgggaagtttacttgtgcagggcctagcagttccaagaatgcggtttcggtatccagaccgaattcctcaaaatcgccaaccacgcagaagctgacagagaaatatcgacggcgcagagctttgagaaggaaggaaaaggaaaccgtcacgggcgacgggaacaacagcagggacattcctcgtaattcggtgtgctcacatgaggaagcacatcagtccgcagaacctagacgacgcacagagaggagagaggccaacgatacaccacaatatgaaggagaccacagaattcacgaagagatatactctttcactgagcgcagctccagcggagaggacaagcagaaaagggtgtgcaacgagaggagggttttacacaaagaaaaatctctctgctgggaaaggagaacgtggtggttaccggaaccggcatctcgcgaccaaagaggcagctttctatgcgcgcgaagagtgagcaaagccagaagttattcactcgcccacagcaattcctgcgcctcctactgcagagacatggcagcgtgcgtaacgaaatgcagtgacactcgggaagtgtcgcagaggagcgcaacgacccgagaccattccgctgcaccaccaaatcgaccagacgacgaactggggacgtgtacactttactcacagtcggcaagagcgcctaccgacccacgaactaacgagacgcagagccgcacgagcccccgcgtatcggcaaagagacccaacacttcatctaactctctgttggacgtgttccagattgaggcaacgtcgttcgcccatgcacttcgcacgagagcagtaccgaagcagagaatcaaagtctctttgctgacaactagacaacacacggatccggtccaggatcgtgaccaagcaaaatagagctcgaacaccgagttcgattcggcttcggcgtgcctgcgggaaatctgatgttcagcgacgcatagccgcttccgagggccatgtagacaccttagttaatgtacgattccgttcacgttgtcgtggctttgtgattaaacgtacagttatcagatagacgagggctgcaactgctgtacaactagattcatatgttgcgatgcctttcctatctctgttaggccggacatcatggttttgtgtatgttgctatgccagtgtgcgacgttcgaacaacggccacgaaacgcacgacgtttgataatgaatgaatcttcgtcacagagcgagctgaatgaaggagacgtcagctagtactgggtcactcgtcgctactgccagatgacgatgtgtgcaacgacagtagcgatttcgctgaacaaactggccgccgcggacgcgttacgtcgtgactgtgcatacatccgaatgtagagaaccaacaaccctactttcaatagcaattatgagcccattgttcgttctcaatcttgttgagctcgcaacgaagctgacgctgaccatgtcgcgaagagttcagtacctcggggaagtctcccccaggatgca

SEQ ID NO: 3358 - DNA, 2925 bp, Toxoplasma gondii
gatagagaacatgtttctcctcgctctcgcgacgcgtacccagctggttgttctgtctgagctgggcccggctcacactcggcctcgcgcttccacgcggtgaccgcgcagtcgcgataagtttcgctggcaccagaaccctccatgttgtcgtctgccgaaagcgaggcgattcccgcgatacctttgccaccgtcgggtctcgagtctcgcgtcgagacactgtctgtaatctgctccaagggacgggctgcgctcgccgaaaccggctttacagacgcttgacggagccactgagacgcagatgtggactcgctacggaccgcgtcctcggaatccggagaagctacgaacgccgctgttgcctccaagacccccgctgcttcatcgtcgagaatcggaaggtgcgaggaacttgtcccggagagcggggagccactcagcgtggagttgggcgctggaggagacctcgccacactcgtctcaggggaagtacagggcagcgaagcggacgcaggttgacggctaccagagaacgcaggagagcaacacgcttggttcggagtctcaggagaaaggacgggagggaagggagaagacgaagccagcagcacacgctctattggtgtgggcgaggacagcgatgccatcgtgggtcctcccgcggcgcccgaagccaatttggtggagggcaaatctccccgaatcacagacggaccttcggtcccattgagcgaagacgagacgcggaaggcggagacgactctccggccaccagcaaaatggacaggcggccgttccggaaagcgtccgggacgcctttgacggaactgatttcagggcttgacaatctcaaagagacacatgcgaaggaagaggacatatcgaacaccgactgaaggaggaacggaatgtgcgtgagaagcttcgggaacaaacgggagagacaggcagcttctagcaccaaaagaaacaggacgcagaacgggcagataaatcggcgacacggcgaatccaagcagaagacagattggagtttatctttgcagttcgtgatcaaagcgttgtaaagagatccaggaacagagaccaaagacgagagacggagccacaaaagaaccgaactgagacacacagcgagaagaccgacgcgtaataaactcataaatagccgaaatagaagagcgccaggcgccgcccttctattcaaaaaaaaacgctttgcttctaaggagcggggatggtcgttcagtctacaataagtagtgaatgaggagccgaaagacaaagtataacgacttcgattctacccaatggagagggaactgaacaggattgctggcgtcccactggtgcggtctggcggacgatgagaaggcgaaaggaaaaaacgcactcaactggcagaaaacgtgggaccacgtgaggtacacaacgaaaacagaaaccggagagactaaaagctttttttagccagacgaagaactggctcgtgaaacggcgcggaacagcgacagcgagaggcactgtgtttcacatgaataagaaaaagaccgggtttctgtttcagttctccgtttgagaggcaagccaaggggcgatgcatgagtttctcaatgcacagcagacaaaaaacgaaaaagtcttgaggaagaggaaagacaggttcccctgaggatggaaacaagaagggaagaaaatcgcactacctgaatatcaaattgttagtgaagcaaaagatgaaatatatagcattcacatcaactttcccgttcagagcatcgtccgctgtctctcttgttcgctttctcccccttcggctcagtcgcgtttttacagactcaaactccccatctgccccctagtgtcgcgcgcgataccaagaaagataggcggcagccacgaggaaatttgttttcggctagtgatgtgagaatcacaacggccaactgtggtgattagggggccaacaaagcaggagcgacgaaaaagaaggtacggggaacactgcgaagaaaagcaatgtactcactctttagacagaaaagggatttagaaaggcatggcacactgcctccacagcaaggagtattttccctccgcattttggatactttctgtgtaccgctgaagacacaaggatgttcccgccgtttctacgaaggcactcaggaaacgcctttctcttggtctctgcagtccgcgtaacagcttttgccaagggttctcgccacacagccagcagtatctcctcgctacaccaccaagcgccagctgacatttcctttgaaaataagccgaagcgccaggtcacaccccagcagagctccgggcgtcactgcacgccgcgaggtatggaacggtttaaagccacaaacaatcagccagccaggagacaagacctgttactcgaacccactcatttgcttaggtctcccttttcaccatatatgagtcaaaacactcttccgccgtggtgcttttttttaactctccgagctcgtcgaggtaaaacgttcagttctagttgtccggccgttttgtcttgtcggggtagcttgctgcggcatcccttgtcttagcgctctgccgcgcataacgagctgctgccattctgcatcatcattcgatgcagaactcgaaggccgtattgagtatcaggccagtgggaggtctcgtggcgaaacgagcagaggcatgtgttgagcgggcaaaatgcgtgacgggggcacagatgcaggacgagtgtgagagggtcatggcgggagaggcaggcggtcgaccaagtcaagagtgaccgacagaggcccacacccagatcctcacgcattttggaactttagtcaagtgagtcggctagagacgaagattgacctgggagacggctcctgagggagccacgaatttgcttgtttgatgtatgca

SEQ ID NO: 3359 - DNA, 1901 bp, Toxoplasma gondii
gaggcagttggatcaaatccgtctttctcgtgcgagtcctgccaaggcgaggcttctggggatgcgcgcgccgctgtcagtgacaaggagaccgaagaaggcgactctgaagagagcgagagagacgaagaatggcctgtcgactccgtcggtgtctgtacagaaggcgaacagtctaaaaacgaagaacgtttcgagggtgaaggcgcagaagagggcaagagagacgaagacactgaagggtatcctgtaggcgaagacggagttgcaggagtcgtcagagactccgagggaagcaaggagacgttcgcctcgggaatgtcttgtgaaggaagaagaaagggataccgaggaacgctgacgctcggagaagagaacgagtcgcggcgagttgcagtgtctccagtctgtgagagctgcgaggactcatgttccccaacgggagaccggcagtgcatcatgccttccatcatttcctctcgtacaggcgaaatttctgcttctctctgcttccttcttctcctggtttctcctctcttcctcttcttctcgtctgtcttctcggctcgcgcctagggcagatacacgaggcgcagggaggcggagggaagaggggagggtgcgagggaaaatgagacgcgtacggagaggaagatactctggccacgcgaagaggacgcaaaatgaaggactggggacctgcgaggatttttgagcgaaacatcccgctgcttgagactgtgagaagcgaggaaccacggcaggtgcagcgctgacagcaaagagagaactccgaagaaagccgatgcagcgaagtggacgcatgcggcagaaaactttgctgttctctatacgaaggaagctgtggacagggcaaacatatctccgctctcttcttcttgctcctcttccttttttccaccgttcttctcgcgctggagaggtcaggccgcctccgtctgcttctgtcctctgaggcaggacagaagtcgcggaaactcgccgtgaacaagttgggcgaacagcaaatgcggaaaaggggaagcaacgcagcgaaggcgcgaggagagccttgcggcaggctgtcggaggagaaggagacagaaagagcgcctgccttccagaaactgagaaatcctcgacagacatcagagttgccgacccccgccacacacctctgttgcgaaagacggaagaacaattccaaaattcatttgcgctgcgtctgacggcgacctgaaagctcgacagacaaagagcgcgggcgggtgccgggagagcgcttgcatgcgcgcagcttcttttctcgctgtttcgacgctttgacgccggctcagagaaagaaagaaagagcaaatgctccacgaattcgcgttcgtctctctttcaatacggtcctcgttgaatcttgtcttgtctggcgctggagaaaagcagagcgtcgttttccttcctctctcagactacaccgaaactgtcgaacgcttcttgacacactgagtcgagtcttcctttcctctccttctctcgcttttctcttcttctctccgtctgcctctgccgttttccgactctccttctaagacttctctcggccttcccttctcttctttcgacctcagtcctcactgtctcctccgtttctgctgctctcttcttctgttcgttctcaacctcggagtgccgtctcatccttcttcaaatcgggagaggcgaaacctttcgtctctcctctctctcctctcccctctctcttctctctcctctctcctctctctcttcgctttcttcttactgctggcctgccgtcgagacgaagaacgcgacagggagagggcgcgagaggaagaagacccgttcgtctcgattcggcgctcccagcatcccctctggaccaacca

SEQ ID NO: 3360 - DNA, 2377 bp, Toxoplasma gondii
aaatgcagagttctttgtttcatctacatgtgtacgcctgcacaaaagtcagaatttatatccatatatatatatatatatatatccatatatatatatatatatattcatatatatatatatatatatccatatatatatatatatatatattcatatatatatatatatccatatatatatatatatatattcatatatatatatatataaatatgtgaatatatatatgaatatgtgtgtgtgtgtgtattttgagacagtcttttgcgttcaagggggacggagagaggggcagcaagccggcgaggaacaacatgaatgcggcaagccatgaaaccacgaaggttgtgttgcattgcgctcctcagctatgggctggaggtgtacgtcctgctggaacgttggattggcgagtgaagttggaaaagcagaggaaacacaccaacgttgagtgtgatagtccttcgcaaaatacggcgaagacagggaaggattgtgtagaagaaggcgtggaaatgacagtgttgcgtcgtcaaagagagtggggagatgtgaagagggtttgtgcgtcggttttctcggatttctgtgctgcatttcccagacggtcggtcgcagaacttccaatccccggatgtttttcacggcccggtcgctgcgtggtgctgtgtctcgttgctcagttcatcgtctttgtctacctgtttctgagtctgagtcgacctgtttcgtcagtttttctgcctttttcgcctcttcggatggtccagatgctttgcggacattctcgcagcgcccgcagaccgcggaagcctctctttgttctcgcctctcggctcggtttcctccgcactgagagtgctgagagtgacgggcacttttcttgcttttttgcgatgggcataggcaagcagagtcgacgcgcgttgttgcgctgctgcctctcttggtgtgcgaggaagggagttttcaaccaaaaaccgtcgttttcttgtcgttctggcgcgctgcgacttccggctctttctctccgcgaaacgagacgctttttcgcttgccgccgggcactttaaccggagagagctgtcggtttgtgctgtgcatatatatacacatgggtcgaccgcgcagatgcgtcctcgcgcgtccacgttcgacgcacaaatagatagatgtgaaggtcggcagaaaggcacttgaatcacggggaccggctgcgagtgtcaaaactcgaggacgcgtgtgctgtttgcgtgaaagcgtggacaggcttcttccactttctgtctgcaggcgaactgcctttctgcctcgctcgtgtctcgcaacttggcagctcccggcgacagtcaaaaacgcgggcaacgcgacggcccgcgtgcgaggaaaaggggattttcggaaaggaaaacgctcgctttgtccactcgcgccgccacaaaattctccgcccgccgtctctccctttctttcctgtgttcccccctccttcggcctccccggacaacgggagtcctgtgtatgtacacctcacacgcactcgcctgcaaacatatttacggcgaaggcaaatcggtctctgtgtttttgcgcccctcgtctctttctctcgacttctttttgtgttcctcgtcgcctgccacagacgaacggcctgagccagtcgggcagaagtaccgtagccacaaaaacgcagagtgccctcatgaccgcaaggattcacatgcaccctcgcagccagactgtgttcggtgtctcagtgcggtctggcgacggtctctcgagttgttcgcgaaacgcagacgctggggtcccggacgtttccgttctctctgccttttagccgacaaccgtctggcctgcggggtgtagagtgacgctcgagcttctcgcgttgccgtcgcgcctcgattgacctcggcgctgtggccgctgcttcgtctttccagctgcctttctgtcttcctctctggcgcccctgtcgcctcttttgtaccagtctgctctcctctcatcgagaacaccctcggtttgtgtcggtcgcgtcctggatctcccgatttctcgttcgaggtttccgtgggttcccttgtttttctctgtcacggctctcttcgtgaacctcttccaggtgctgtctccggcgccagctcgggggttgcgccttcttcggtgctgaggccagggagaagagtcgccagtcagaagcctgagacagcgggaggagacgctcgctatttttttcacgaacgcgtcgtcctgaagtcgaagacacagtcggagacagctgcgtctgcggctctggaggtggttgcgcgacgctctgttcgttaaacgaagcatgtgtttgcaaagcggggaaaggcctccaaga

SEQ ID NO: 3361 - DNA, 1789 bp, Toxoplasma gondii
tttttaccagtggttttgcttgcgtttgcctaggagtcgccaaaaaggacgcatgcactgtttctgcattcctgagtctgagccttcgcttcagcttcgggaagagatgcacgaatttctgacctcgctattctcgaggattccatttcagtttgtgtagtgccccgtttgcttcgtgagacaatgccgcacgtgatagtctggccctgatagcacggcattttcattcccaactgcgtcttgaaaatggatgctgaacagtgtcttctgccgttactgattcctgcccctacagtagccccgctgtacctaaacctgattcaagaatttgcgcgccagtcagtaataagcggttttcccgccaaaattataataacgaatatgaatcgatagaccaacgagcaacggtgaggcttgttgcatgtccttgccggcttacgcccataccttcgtccagcatgaatagaccgcgatacacacgtttgtttttcgaactcagcgaacgcagcggcctgatcggtctccgctactggactgaggaaatagagtaggtcccaatgtttttgtcagtgggcggtatggagtagaagctatgtgcatgtacacctctctacgactatccaaatgcaacatgtagcaagctgcaatatcgaatgtaatacagtggttctaatgtgaggtcagatacgcagtaccctccaaatgggaaatgtaccgaatatatggtattatcctgtggagtaaggattcagactagctgcatcaaagagacccatactcgtcactcctttcaagggagagtgacgactggtgagagaggaacatgcagttcaccaccgtggtcaccagtttcttgtacccttttgcccgtgtaagaaagtcgttcagtaaccagcgttctgagaagtcgaatgcttgcagcctttcagttgctctatcgtgggaaagacaataaaaacactgcagaagacctgcttcttggacagaagctttacgcttggtagcgccaatttctaacgatgggagagctggcccgtgtctgcgtgaccctcggacttccacgcccactaaaaacaattgaaacactttagtcaacgcgtctgaatgcattcttcgacagaatgcacccatgatgaacgaagatggcaaatattaccgtcagagtgtgtaaggaattaaaatcctgtcaaatgtccctggaaacgacacgcatgcactgttctagtcaacgcactacctttaccgggtacctgcgtgtccagctcagaaacacggtaccagtaactcagtggctcttttcgcgaaactcgtgcatcgaagcaagctttgaggccaagaacaaactggcttagagggctccactgggaacggttttcttgggcttcttcggacaccacaccagcctgcgtttggactgactagaaccgaagcgtccgcgaatgtgttttgatcgaaacctgctcaagaggtcggttttcgagagaagctgccacgcgctaaaatttgcatgtgttgcatccaaaaagggaaatcggcttatagtcgggcaccagccccacaagcggaaggcgcatggcgtggcggtgcgtgggggcagaggctcctttcgcgaaatgtcgatgggcgttagagaaattcgccttttttgtcacgtcgtcgatttcctgtcgagtgggggcgtcttcgccactttcattgtaggatccgtggagttttgcggccgcgtggtatttccgacgtccggcagagcgtgccgtttccgtggctgttttttcttttctgtgcacaa

SEQ ID NO: 3362 - DNA, 2823 bp, Toxoplasma gondii
actgtcacgcatgaatgtgtaagagtaccctaggttatagccgaatgaatgatcctagtcctgcacagggcgctagagaacggtcaatttcacagaacaataactgcaaagagttatgtctactttcgggaacagtttttactatccttttgcgtcatgatccaaccctcgaactgtctcgtggttttcgagaacactggggatactggctgacaaaaattgtcgcctactcctcggtagaactgtcaagcctcttttttccaatggatttcgtagaaaacctaaaaatcgcatatctggctggcatttagcctcatagtttcgtgcggcttgtgtctgaagaaaattgtagctttacgccgtgcagagtggtgtgttttctccggaaccgccttctccattcctaactactagtatacgtactgtaaaggtaatagcccgagtgtagaacactagctgttttagtggatggattattatttgcgtttactgtatgaagcccttagttgtacggacgactgagatgcgattgaatctttctttggcacagcgggttcttctgcgtgtcacctgactgcgacagagtgtcagacgataagaaagaatcaggaaaaatcgggagggaaaggctttttaggggcttcctagtttccgtacgagaggagcatctttttgtaggtggcgacctgtgggacgacgcgtgtcggtagggaagtgaggacaatggtgtgatgtttgtgtcttgtgaaagaatcaaatgtgcccttaggagcggataagcaccccatagatgtttgcagaacaactccatttgagcaggatgatcagactcacatgaatgacttgactctcgctcgctaagcagtttgggggccgtccctgtctccgcttctgttcgaatcttctttaaactccgcaatcttttcttcgcccgtctttctcaactcccctaccgcatccctgtatgttttcccccattctttagcgcaccagcatctttgttttttctcccttttcctatgcggaatcagtcgctgttgcatcttcccgaatccatcttgctaaaaactctctcgcttgcagcgtgatgggggccttctggcagaaaaaaaaggaaacgacaaaaagtgaccagtccgacgagaatccttaccatcttggaacttaaacgcccacgggaagttcaaacggcacgctgaaaatgaacgcgcgtacgtagcttgccttttcacttgaaaggacaaaagattcccgcgtagaactgtcacgaaaccgttctagaagtacgcgtctcgatacttgctgggctaatccttactgctgcatgacagtgcggcttccatgatacaaaagaatcactcaaaaaatccaaatttaagctgacccacctgacgatgcggctgcgaggaacgtcacaaaagcagggcacgccgtaagagaagcgaggcaaacatagaggacagccacatagagtatggtagcattgttgacgcttttagaactcgtgcatttgcggttcttctcgttcggagcagcctacaactgcgatcgtggaaaatatggtcggttttaaaaaaaagccaagagtcgttttaccgaaatatcagcttggaatgggtcgttacagccgcccgcgatttccatcacgtcaaactccgcttttcctcgtgtcgcgccgtgcggttgtgaccataacgacagcgacgagttcctacttttgtaggcaaaatatcgaccgtctgtgcgagcctagcctaagcgccagtagagacgcgttttactctgggtgtgcgctgtttcaactcgacttcgacttccttgtttccctcctacgctgtcccctcgtcacgatgcttgtgatgcacataggaaacggtgcacttcacattccatgtttcatacttcgtggttcgcgtgtctgtcgataaccggactatccgttaatggcccacgggaccacagccgcacattcgcggctctataatcaagtacagcactcgccccgtttgttttcgtggtccggttgctacgaagttaacacaagttcccctttaaactcgctgatcaagatcggcagagaggagctgcaatcccgatccgaacgtcggccgccacgaacgcgctgagacaacgatcgacatcgaacgaaagtctcaacttcctgtctaggataccatgctcacctgagctgtgcgagacctagcggtcgggactgaaccgctagcgacgattctctttgacgcgggagtttgtgcgaacgcgcgaccgtcggtcgcatttgcagagttgaagtttcgctttgtaggaatgtggttcccgtgcggaatgcaaatctgagtttcgcggggagaaaccatttcgattttttggaaccgcggggattctttgtgccgccgatgttcgtgtggctcgttcttcccgcgcgcaaacgatcgggtcaaggtcggctagcctcgtggagtctgagcttcgagtctgctttttcgactggacttccgtggttccgtgttccgcatccagagggcttccaactcatttctacctctctggcctggtttttttcggtgtgtccgcaagcggcgcagcagtccccagtatcctaaaattttgctcgtgcgccaacgactgagagactcgctgcgtcgtgaggcctgcaccacccttttgcacccaaactcgcttttcgtgtgcttgccattttcccttcggaaatggccacctgaaaactacctacctccgcgcgtgccattccaccagtccaccgcccgtccaccgccaccctgcccggaaaccgtggccgtcagttcgttcgcgaaaccacca

SEQ ID NO: 3363 - DNA, 2828 bp, Toxoplasma gondii
tcaaagatttcaatctcttcccagactctcgttgtctgcttcgcacttagctgcaggcactctctctctccatatatatatatatattcatgtgtacggaactatacatacatatatatatttatatatattgcgtagatataacagcggatgaactgatacgtacacagagattcagagcggttgtcgaccgggggaacaaagtggagatacaagtgaatgcgtgtgtctgtacagcgaaagccatactgggtgtgcatgccgacttagttctcattgcgtcgtgcattaacatcctgacgctcaagctgagaacgttacatgcgcatctgcctagacatattccacttttcctcagcactgtatcgttacaggtatgtctttatatgtgtggttcctgcctataaatataggccagcagagcatccgtggatgtctacgtaacgtggaaaagaaaagctgatgtctgtccgcccttttgggtctggacttgtgtgcacgatcgcgacatgccgcggagcccaagtggatttttacttgtgggactgtgtgtgagcagtcgaggcactcgactttgatatttttcgaaattcggaattcatgcaagtaagacggtcaggaaacgaagcaagctgttcttctcgccgttccgatgacttcagagtatcagaagtcgctgcgatctctacagtgtcgcgtgacatgaggacgaacctgcgaaagaggcatcgaccttggatgtttgtctgtcacctgaggcgacaaaaccgccaacgaacttacccctccacagcttgcaggtacgacctcatgtttgccgacgagaggggacagaccacaaaatcgaaagaaggcgcaggaaaaaatttgaatgtcatcaacagagaagagaacctggcagacaggaaggagatcgttgacagaacacacatcctgcctctctctctctctctctctatatatatatatatactggatatatatatatatatatactgaatatatatatatatactgaaatatagcgggtgtacggtatctaccttggacaggagtaaatacaaatatggacgtggttctgaaggaggtttctgttattcatgtagagatccgcagacggatttccacttgcccatttaggtttttttttgtgcgcgaccgtttcagagcgagtgccgtgagtcagtcgactgcgtggttgcgcgccgttttgatcacagaggcggagcacccggaagagcttcaaaggatcacagcggcgacaccagaaaaaaaaggagaaaaagagaaagtttctttttttaaaaaaaagctgacgacgatgggactcgaacccacaaccttctgatccgaagtcagacgccctatccattgggccacgccgcctgcgaggctcttggggccatcttcttccctcggccttctccagcgcaagacaatcttcttgcctcctccggtcctctcgaaaccgcttcttctcttctcttctcttcctccgagaagaaagccttcactcgcgcgactccagggatcgggcgcacagacaaaacgaagagaataaagccgatgatggcgaggatgcgtcgcctctctgctcatgaaaggggggggggtgctgtctctgtgtgcagcaacgccagtgtacgcgcggctctcaccgtatatcctggagtatacaaacgctacaaggcaaggtagacgcttgattttcgtctttgtaaattgagaaaatctcgccacaatcaggctgcttcgagagctgtgtcttgggtttctcgccggctctcaacattttgtctcaatttttcacgcaaattccaggatgagacacacaagaagcatgagggccgcagcgcgcgccgcgcgaagaaacgaaaaagctggcgacagaaagctggcgaagactctcaggtttgaacgcggacagcgagcgctgtttctcacgaacggcagagcaaaaaatggccgcgcgcgtggaaacaatgaagatggtccagaagaaaacgaattcctggagtttgcgcgctttcgttcggcgtcttctttcttcgctgcggtggccctgacttccgtggattcttcggggatttgctgctctggcagacagctagagcacgtcgtttttccggatggttttttccagaaagaacatcaaaaccaacaaacggaacgggtgaaagttcgccagactctcgccgtgagtgtcgagactctctcacgcacactgacgcagacgttttcttccccgccgcgccgtgtagttccggagaagaacgcggaacggaaagagaggaaaagaacgaggaaggtcgagaaaaaaggaactgaaggggggcgagggcgaggctggtctctcttctgtctcgtctcttctctcgcgaaaaaaaaggagaagacgcgtcttcacactcccttcagttcctcctgtctttgctcaccgcagcttgtctgagaactgaaggaacaagggggcactcgaccatcctcgatatgtcactcacgtcatttcttcttcttcctccacagtctttttttctctccctttctcccccatcctgctgtattgtctctctccccaggcctttctccttctcctctttccccaggcctttctccttctcctctttccccaggcctttctccttctcctctttccccaggcctttctccttcttccctcgattatctccacagttgggttgtctcgcttctccgcagtttgctcttttctcttcgttttcctcaaccgtttctccgcgcgttgcctcctcacagtcttcttttcttctcactctgctctcgtcgcttcgatccactctgtttcacga

SEQ ID NO: 3364 - DNA, 1541 bp, Toxoplasma gondii
aactcacactttcgtacttaagttgattatcacagacacactcccacaaactcaaccgtatgcagttgagcacgcacatggacagttatatccatatagaatatacatatacgcccatatacatatatcaatgcatatctgtatctatctatctacctatgtatacacacatatatatatatatatatatatatatatatataggtatttttatgattagatgagtagatatctcggtcgtatttctatggaaagaggccggaagaggtgccatatgcctctctcgggattttcggtgtacatacagctgggtgaaggggcgtgaactatgaggaactttatctgtgaggccgaaatcgaaggcgaaagcgccggaatttctagcactcaagggacgaagagacacggggagagcgatggctgtcagataccaagactcagggcgcaagcgttggagagagcgagaggcttgagggaaagaagaggaggaaggaaagagcagggatgatgttgcggggagtgacaccggcttttcgcagagtagctgtcactgcatgcacatgcacgaagaaagacccttgcagaaagactcaccgctggagaaagaaagcagtctggcacattgaaaggaaaaaggaacagcctgctctcgattcgtctccttcgttcttctgccttatgcacggaggccgcaagcgctgcaagaaaacaacggtcggccgcaggactacggagagcagcctccgcagagaacaggagcgaggtacggagggaggagagagaaacagactggcagaaagagcgagatgaagcggaggcggaaaggcccgagagaggaagaaaaacgagcgtcggaggagtgacgtcgaaaggcgagagaggcgggaaatgcgagaacccacaaaacgggggaaagtggcagcgagacgagattcgtgaacgtgaaaaaccaagtagctcaaaaaaaacttcaatcgaaaactcatctccctgtatccgacgcgaacgctttgcatttgtttttctggagactcaccgcagaaaggcacatgcgcgttgagactaacgcgaatgcatgcacgcgactttttcggctcgtcacttgtgcacggcgaacagacggtccagcacatcgcgttcggtttctgttccagacttttctttcctgttctcctgcacatgacgctgtttctcatgattctcactagcgtgactctcctcgtcccttccactggtgtgcgcctctctggtcttttttgcttctttctgcgcatgcccgctccatcctccctaattcgtctttccctcgtcgcgctgtctttccgagattttttgcgtttccggtctctcgactgaggtgtaggtacccggcgtgtttcctcaagatttatcgagtcgttttcgccaattttccgttcgtctcgccttcctgccgttctcgcgttttcccgctggcctcgcgcctttccccttccgtccggtcgttgcgctcctcgttttccgccaggctcttggggttcccggcgccttctccagcctta

SEQ ID NO: 3365 - DNA, 3506 bp, Toxoplasma gondii
agaatttattgtcaggatgataaactaacaaagtggagccgagttgggttgtggagaagtgggagcgttggttgtctcgctgcggatcgcatccggaactgttggcatcctgtcccctctatccgagataactccagcaggagtgtggagcacatcacgtcagagaagtcactggagataatgcggtgtgttttcggttttctccatcgtgtttgttacaggactccgtgagggggaaagttcacatgatcttgggggcccttaccccctttttgcgagctctcgccaccctcgagaaggagatctctgtggcactcggaagcgatgcggcagtcaaaaacgagcgaaagctggaagcgaactgtgaaggacagtcgtgcgcgtatttccttcgcgaaattggcaacaattgagagcttttcaaaagaaatacgatgctgcagggtgcagtgcaacacttcgcgtagttgtggcgaagggtagacaattggaaggcgtgcggaagcgtgaaagcagttctgcagcaataaagtttagtgagtgtggagtgcgaatggtacagtaatgaattcgaaaacccacgaggagttttaacgcagtggatcattgtccactgacgtggctgccaaaagagaaggacagcgacatacctatgtggttgaaggcccagaacagggtagtttgcttttccgtcgttcccgagaactcttgaaatacacctaaggaaagggaactatttcgcggtgatactggacgcacaggcgaaaggtctactgatacggcaccgtgaatccaatgcgcgggcgcgctcatctctccgtgcgagtagcacctaacgctgttacggagacacagatcaagtcatctttttcttgatcacttcaattggcacagcattaagtaagaataaactacgggatcaatatcggaaacgtatgttggcttaaatgttcacccgcatcctgctgaagatgcccagtactcgatgcgtgtaacagaaaagtgagccagttggattgaggaaacccagtcgtttactgtgtgatctaatctgatgcagactcaaagcagaccttgtccacgctgtgtgaggcctccgctctgcacgtgggctccaagtgcagcgtggtagcaggttactgtctccgcaagaaacagacagaggcactgtggaacgggcactagaggcaatagagactgcgcaagatgggcagcgacggggtctccttctctgtattgtgttgccagggtacttgtgcaagtgaaatctccatttcaggtatcatggtagtttgaaaaatcggagaaggccaacagttaccttccacttttgttgtgtgtgacgttccaggtatcgacggagggcgtcacgacctcactcctcagccgtcagttgccacggacgggcgccgagataatggagaacaggtcaggtgggtttgccagagtgttcgtttcttttgcaacacacttccgtcccgcatcaccatgaaaggtggtcaacgcagtagaagggtcaagaaaaaagagttggctggtggccgttcaatgcgacaccatggtcagggtattttgtgttgcggctgttttcggcctgttcggcgcaactcgtgtgagtggaagcgtcgacaacgggggtcttgatgatccgaacgcctcacgcatggctatccaatactggcgtgcttgccaccgggggagcgggtcgctggtcgaagacattaatattccttacgatattgcggatcctcctgagctaccattccctggtgccgagcttcagtttgctttagtcgctcagcgccacggtacgcgacgatcgcagtatttgtggtcgaagtcgccgtacaacaaagatactgtgactggtcagttgtcgatttaaggcgcttacaagcaccatgtgtcagggattgaagtccgtcgctactttcagatgtacatgcaccacaatttccttgagcgcggggtgagtcgatgccgcgacaatgttcttcgtgaggtgtgtggtttgcgaccttgagcgcgagtgacagtcgtttggcctcaaaagagagaacgctacgccttcggggtacacacacggacacacaaacgatactctgcggcgagaatgttacggaaaggtgaagcgtaaatggattagaagcttcaaaacttagcgagaattcttgctagtgtactaggttctgtctcccgccacgctgctgagaaagaagaatgctggtcacacctcccatcaggattatcacccacgacagagtgctccgctgctctcgatgtttcccaaaacagtttcacggaacaggtgagatcgtaattattgcagagtgattgtgtgtcatccttttgtatggcgtttgacgcgtgcgtctttgtgaagtcagaaaaacaaagcagcaggttgcgggtacttcgttggttttccgctctgtgagtgtgaacaccgaacagttttacgatgacactggggggtcgagtcgtgtttctctgggtgactacagtggacaccgcaccgcaacaagtgagaacaagctacgcggtaaacaccgagaagcgtatggtggttcacctgttcagtcacaggctgttgaagactccatctactcggtgtatataacgaaaagatgagctagttgaattgaggactctgctcctgtaccggctacctaccaccgggaacgacgaatgtaaactaaaagtcgtccttcagcacattgtgtgaagcttcgtcagggtgttgactcctgtggctcattcggattcggttgtcatcatagtgtgaaacggatataatacaagactaaggcgccgtgattcgggtacgggaaacagtgaaaactacacacggacaagcttgtgcaggaagattgacaggaaagaaagagacgcccgccgcgtgtaggttgggcgttgcagtggaaacgcggatgcaccggcagtcagcaaccgaaaccccatagtctactccggtagtaccccgtccaggctactggtggcgaactggtttggcgcatctggagagctgttactacgcgtctgcctcgtgatgatccctatcgtttacagacgtcgtcgagactgcgtttcccacacctagacgatgcttcggcgccagacgcagtgttgctgggcgacgtgtgtgggcagaatgtctccccacgtggtcgtaggtgcgcgtatcacggtgcgagttcgtggggtgtctctatgacggtggttgtcaaccagttttataatttttgcggtgcgtagattcctgaagtacgttgaagtcgtccgccttttttaaaaacattttaaccggcgtttctggactccttgtactcagttctcgctagtgaactttcgtttcactaagtatctatcgagtcagtgcagtaggggtttccttcaagtagattgtgttgtattccggtaacatctttgcgtctcgagtgcatcgtcttgagagcatctctaattcaacacagaaaataccagcgtggttatttacagcggaacaa

SEQ ID NO: 3366 - DNA, 1204 bp, Toxoplasma gondii
tcctccttcatcctttcatcctcatccctcgaaatgaccaaaagcatacatataaacctatatatctatatgtacatatatatatatatatatgtatatatgtgtgtgtgcaccacataattacaggcacagatcacttaggtcttttacaactctgtctccataaaatcaagcaaagacatctatgtatatatatatatatatatatatatttacctgatggctctgttgagcattccggcgatgtgagaggtgcagtctcccgcgtcgttagtgaaatttccgaaggaatttccatctcgaattgccaccatgaactggtagagcgacatggaggcgtcgatcgcgatgacacgaccggtgaagctgccaggctcctgtcgcttgattgcgcggggcgcaaagtcgccgacgaactttccgaggcctttaatccccatttttttcaggaaacgctgaaatgcggtgacgcgcagaaaccgaagatcctcaaacactcaaggagcggcgaaacaacaaagaagcgacgcggtgctcttcacagactcatacacgtacttctacttctacaccctccacctcctctatagaaatagacatgcatacatatatatacatatatatacatatatctatatatatgtatatatttaaatgcacataaaaacaaatgaatctacatagagatgtatgtgaatagaactccggcgtatgttgttgaatctctctgtagtttgtggctgcgttggagagacagagtcggaggagtgaggagtccagacacagtggctggaaagcaggcgagcagttgcacaaaagacagagagatgtgcagggagatctccctctggcggaaaaaaggcaagagagaaaatcgagagagggacaaagacagaggcagaagacgaagaaaggagacaaagagagacgcgaaaagaggaaacgcgaggcgaggaagcgcgagacaaagagagacgcgagaggaggaagcgcgagacaaagagagacgcgagaggaggacgcgcgagcactgcgtttcgctgcactcttccgatacgaaaagagaaaagaagactgaaagaaaaagaagagggagaagagagaagaggcagccggaatcgaaaaggaaaaaagcgaggagggaaccggcggcgtctgcccgcgcgggtgggtgtggcggggagaaaagtcgggggtgtgttca

SEQ ID NO: 3367 - DNA, 2065 bp, Toxoplasma gondii
gcacagttgtaatctaagtccagacggtgagggttaaaccctatgcatgacgtgcctcggaacgtcgaaacgtcagatttagcctagttcctcagctcatggcatcctctgcatcagttcccgcaaatacgtttggtgtttcttaacgcgttagacggtcagaggataccgcagcagtctcctgtgggaagggaagcgttggaccagtcaacaggaggaacacgctgacgacaagcacgggtgcgctactgttgcttcgcatgtgactcctgcagcagctgccaacttcctacttcaaatcgcagtaatggaatgtaaatcattcgctggtgtgtccacgtgacgacagatttaacattgtagagggtggcatgttcaagtgtgtgtacaccagagagcacgctgctaggaacccgtagctgccggctgaccgcagagcaaaggtgatcctcgtttatggaactctcagcttattcgtccacgagtatagaactaccgccccttaaggttatttgactgaatgatcaaacaatgccgcggctctattcgttcgtcgtcgcatgctggctggcacaaagttcgcgttcggtggcccacccagtcgatgatattgagccagaagctgagcctcccgctgtggtttatgagacctcggatccccacgagtgagtcatgttcatgagcggaattggctaagcggaagttcaaatgaaaaaactgttgtccagcacagcgataggctcgatcgaggcaattctgaagcagcaagtacaggataatgtggcagcaaacaaccgagatttctcactatcctcagggggcacaaccccttacacgggcaatgcagcagctgctgccgatgaggctctgaagcaaatactgacagcaaatgaacagaagaaagctcgtgttgctgaagaacgcgaccacatcgacgaggagcgtagtcgccattcacgccgtatgatggagttggaggacaagctccgccaaagcctagacaaacttcaagaaagagagaataacatttatgcgtcagagcataagcttgaatcacagctggagaagggtgaaaaagaactgaaaaatctcgatcacagagcggcggaaggacgtttcctccacaagagaatacacaaaagtatcatcgagggagaagaagggaagctgaagtcgaagtaccatggtcgaattcaccctcatcggcatgaatttgcgaaatagaaatagtcaaaagtgcagcaggaaatggtatcaaaaagggcctttgaaactcgtggattgttacgtcaagccaccagtgccatgtgcatcgaaggcaatgagaacatcttgtatagtgctcgcggttatcacttatggggcttcatgaaacaaagtgactacggtggattgaggtagacaaaggacctgtctttttttctgttcacatggacctgctgccaccatgttgcgccgggctgcagacagtttcagatcgctgctacctttgtccgtcggctgtctttattctctggaggatatctaattttccttttttctgtcgctggccggaggacagcacgtgtcttctgcgcgaatgtgtttgcccggagataagggtccacggggtcttagcgtcgtagctgcatggcggacggcgcaaactctgcacgcattctactgaagaaggaactgcatgcatattggagagagctgttcgtctggaaactaaacgcatgtgccttaactgccttcaacagagctccgcaattctatacgcataaatagagatggcagacggagtcagtcagtttgactcaagccatcgtaggtaacgttgtcggccgagaatccgttcatgaattgaaaaacggagaacacttccctggtgaggcagcgttagtcccccgtgtgtctctacggatagacgtacaatcttcccacggattctatactgttttctggatcaagcaggaatttgtgattgttgtcccttcgtcttgatgagattcaccccaaacggtgaagcatacatccaggagggtcgtcgcatctggggggttgactggcggtgagaagagaa

SEQ ID NO: 3368 - DNA, 2006 bp, Toxoplasma gondii
caagcgacttgagcgattaagagcacagggagaaacgaacgaaattccactgagatctgcgcaggaaaaatccaggtttcttactcaagaaacttgcctgttcaacgtcagattcgccaccgagcaagagagctccggcagacgagctcttcccagacgcgggtgtgacggccgcctccgtggccaggcgcctcagaatcgtcgcaggttcgcgaaggggaggaaacgccggctctgctcccgcgccttctttggcagccaggagcacgggaagctccgcctgtacatcaaaacattagtacatcgaaaacggccgataagacagagcacatgagacatatgtatacataaatatacatacgtaaataaaggcggaggatagatctgcaaacacaaattggtggattacagctgctattatattcgtggatggccggatgcgtctataaagcaagaaaatatagagggaatagtcgtacagccgatgcacagtgaggcgcacttttcgcacgaatagtggcagtgctaacagacctcttgggctttcaggtacgccttcgcctcattgccgagaaagcagagggacagagagagcggcggctgtcgctggaggagacacggctgaacatagcgagccaagaggacggtggcgagagccgcaggcgtcgagtcgtagatgagctccatggtagctgagcgaaaggcacggccggaacagagcgcacgagaaaactgaagagaagaggacgcaggagaaaattcaggaggaaagaatgcaggagaaaactgaagaggggtggacacaggtgtcaagagagagagggacggtgacgcaggagaatgctcatgtaacacgcgagcgaagaccgccaaagaagggaagaagcgcctcgctgagcaaaaggatggcaggaaccggaggtgacgatggggacggggaggcagtacgcgtctgacgaggggagtagacaccagcgaagtcgcgaagctcaacccggtatccatgtctggacgatgccgggtctcctcgactgagtgtttttcttttcttacgggaagggaaaaaggtgacgtccacagaacaaggtaaaggaaaactgccacaggagcttggctggtctctcttgatgatgcggaaaggaccgactgatggcagcgcgcgccaaagctgaaagggtcgacaaagaggaacgacagacgggtagagaatgctgctttccgataggaagaaagggatggcattcgaacgcaaaagcgacgcactttcgtatgttgtaatgctggtgcttccatcgcactcggccccatggttccagcccgcgcatgcgcatgcgcaagacaaagatgcatgcttgcgaaaatccgccagaaaatgttgacgaccctttgaggttaactgcccaaagaagaccacaattgatttcgtcctcgcaaacgctctggctcttgatccacatctctgttaagtttatcgctgtttattgcctcccatgcggcaagtctgccccacggggactgccttaaccaaaaagttcaaggataaacaaggtgtgtccgattcctctggttttcctctcgttcgtttctcgtcctggaaggttcctttaggcgactggactcactcactgcgtatcattccctcccattcagagaatcggttgaggtcagaaatgtcgtattcgcacggcgttgcgcggtggcgtgtgtggtggacttaaaaaaaggatttcctctctgttctccgtaactttttattcacgcattctcgcttctcataggtgtcacattcatgtttcaattggaaacctggataaggtaagctgttactgcatcgacgtttcaggcactattcgtaaaccgtcgttccacttgtgttgtaacccgtaatcccacttctgttttcgagattccttcgtatagactggtcgtgctgaaggcggtctgcgagtcaattgcctcctaaaacagaggtttgtcgcattttgttcacctaccgtcttcttcca

SEQ ID NO: 3369 - DNA, 2673 bp, Toxoplasma gondii
tttcttgacaagtctggctacagaaacgcaggttcttcacccttcatcgcgtttttttgccctctcttctgtgtttttctggtcgctcgcactcacggcgacccgacttctcagatgttggtacgacccgtgtgtcatcagcctggggatgatcatctgaaacaggccaacggggactaccacgagcgtcttcctgcgagctttccaccatcaatttagagcttcgtgtttctctccctgacttcgttgtctgctttctcaccctccctcgacgttgattgcgagtttgtgcggttgcacctctcccccaacttcagcgctgatatctgttccgtcctctggggggagagactggctcttctcatcggagggcgttccacgccccttcgcctcatgcagttgtcggtgtattttcgcggcttgttcgtcgtcaactttcgaatacacgtggagatacaagcgctgtcgcgggcagatttgcttggcatccggggcgcgagccggggccggcccgctggtttctttggcaagcaggcagtccaggggaagcgcgtcgatcgaagccgcgaggaacgtcgacaagttcacaaagaggccgcacggcgacaacggactgtccaagctgagaagacaggcgaaatcacgaccgcggctggcgaagatttccgtttccatgaaagagtgggactcgttcagcaggcgtttctgcatctgggtagactgcacctatctgtacagccttaacaacgcgccgctcgggaaactacccgtgaattcaaaaggcaacaaaagaacgcaacaatccgctggcagtaccatagctattcacgcgctcgtctcgatgagcaactcgtccgctgcttctgctgttctccgtaaatgtcttttaccgagagcattcctactcgccttctgaatcacggaagagcattcgcccgcgcaggtgtatatccccttggcattcgctggtttcctgacctcaacggctcacttatcgggtgcacataattaacggaactgggcaagaactgatcttgtggtcgcaactacctgcgtgcctcgaactgtcaagcggctgttcacctgtatgtacactgcgttttgacaaccgtgtccatgcaagtcgccacgcgcgcgtgtcccagtagagtccgcagttccaccagaagatcctcagtggcatcttgaggcgtcgtttccgcaaatgcgccaaagtacggggaaaacgggagagttgcctccccttggggacgtggattggccattgtggagtcgcgttccgcgaaaaagaagcgtttgcctgaaggcggtgccaaaaaccgccgcagctacacaaggtgactgcggaatgcagggtgggtgtcttgccgcacaacggcttggccggaagaagtggagtcccgtcgttgtcgctgtccggctggcccagtccgggtttagtggaagcgaaacacaactcgctgcgacaatttttcgttcgctcctctggcaaggacggaacgcggcggcggtgcgctttgctcgcaacgcgcgtcaagaaccggcgaaaagacaattttgcgcgggcgacaatcacaacacaaacgccatcagtctgaggaggacggaccgaaggtgcaaaagataagagcctcaaatcaggtcacagtgcagaatgaagcggtgcgttcgagacgcgagacaccgattctccaaccgtgctgccaccgttttgaggatccagacttgccacactgcacatgcgcaaaaacgtcacatgcatgaccctgtggcctggtttcgtaagattctctgttgcgcgcgcactcaactcccgccacaaaggactacgcggaaacggtaaagaaactgctaagacatgcgatcgcggcctctcgaccgctgcttggcaaccgcagtgtgccaaaaccatggggaaatcgtgcagaacgtcagtttccaccggagaaacaagtcgcaaagagcgaaatccgcaactcaagcgcttactcgagctcagaaggcgccagaggggtatgggatacagtgcgcgggttcaaggggtgctttatgccacggcaccccgatcggtaccctgtctgtcgagggcggcaccgagtggacggaacggttgcacggcacaccacctacgaaagccgagaggtcgcaggccttagcagaaaacagtttttttaacgaacttgacagagccccacgatctcacggtctccgattgctgtcacggcggctgggaggtaaaaccaagcagcgcaggcggagccctgttttacggaaactccagtttctccctctgcttctcttggaccgcgaacagttcacgattctgttgccacttttcttgtttcagcagagctcgagggagaaaatttatcggctggcaagggaaagaaaaaggtttcatcggcggagcgtgcagggcttgagtcgacgctgtgggggtcgggagcccctcatccgcgatccatgcggacacctcgaggctgttttgtgctcttttctgttgttccgccatcatcatgaagcggactcgaattctacatcgcttactgtgttcgatttgctcggtagccgtgttgacgcactgcgcgtgggtctcgagaacggctgccgccgcagagtcgagcagcagacaggaagccgaaggtcggcacacggtcgacggcctgtctacaa

SEQ ID NO: 3370 - DNA, 2559 bp, Toxoplasma gondii
accaatacatggaggcagaccacgttccgtcttggccgagacaaggcacctcggctagttttctaacgatgttgctctctgaggacgaaagggcggatagagtctcaccgtactgtgtactctttctaaactatttgaaggccggtcgtggcgcccaagcagctagaagacgtttgtgttcctgtgacaggaagaccgttcctgtgaaactggcgttgacgggcagaaactttaggaaccaaatgagtctctgaggtgctgcagtcattacagaccggttttataccgttgccgtttatagaacaaacaactaaaagtgttgggtttcagtatcatacgacagcaaggctactccacatcagtcgcgttcttgatataaggcaaactcgcaattggctgtggaaaacaagcgatcgccgccatctccacaaatgaacaggaacagggaagtagtggattcagccggcggagcaaagaatctacgctgcccgtgcagagtgtcatggacgaaacaatttcgaaggtatttggcgtttcaatttccagaagccgcgagaatggcatgtgttgagagttccacagtgctctataatgccgtgttccccggcttctgactgtgattcgtatcccacagtactggcgtcagtgagaatgtaaggctcacagcaatcgccacagatcgcttccgaagcggtacgtttctcaaaagcagccaacgactttgctgaaacggctttcgttcccgtaagaaagccgtaaattcaagcagatgaagcgtgcgatagattttctcaagaccgctgtgttcagctgcgacgctgatggctttgctccatgatgtgcgtgatcggtgtgagtgcacggagaatataatctcctccttaccatcattattctgcgacgctgtctgagaaatacagaccagtgaacctgcgtgtgatgccaccctgttgagtctgggtattttccaccatgtactgtcgtggtcgaatcgaatgaacagactctagaagacggaggttcctgagtactctcccaccgcgagagtgacaacgtctgcacttcggagtcgtctgaaaagactagaaaaggcgccgaggctctcgatgacaacacgagtctagcagcacacctaacggattcgatatttcgcgatttaagttggattctcgtgatcgaaaagcagacagcgtctctcaggagagaccaaggcaccatccagttgtgttctgcagattgctcacaactttgcgaagagaagacctaactgtgtgtacctggttctcgggcgattctcatcgggtggcattaaatgttgtgtcgttactttccagaggtgaggctatttctgtgcgatggttccgctgaaagcgacgaaattgacgctgcaacgaacatctgtcctcgccgttctccagaaagaacaggccttgttcttttggtctcgtcttgtgtggagaggagcccgcttttcctgcacacctctaagagaaggaacaaaaccgtgcgctggcctccgttctttgcgcgttttcagtggagaaaacaccccgtagatgcaaacgccacggatccagctgtgtcttttctcaccttcattctatttctaggaatttaccacacctttttccgtgtttcagtgactttacgaagcttcgtgggtgtttcaccccgggatccgacacaggacaccgcttgcaacggatccttcgcgtctatctctcgcctgttgcttgtcgctgctcccgctaacttggcacgcttctctgtcgggtgctgatgatatactgggggatgagaatcggcatcagctgaaaaggattttcgttcgagttctgtgtcttttctccacttcgtttcttcgctgctggaccacgcaaagtccacataagtgcacgtattggaccggttgaaatgcccggcttaacagttgggcatctgtacgtgaaaacgctctgtgcgcgtgacaacaccgacgaacatctgaagtgtttgaacgtctgatgactgataattctggagtgaacgcgctcctctgagatctctggagaaaacttcccttgcgtttgtcgatctagatccaacctctggggaacgacacacctcgtttttgtttttctttcttcgaaaaatcagtgtgccctccatgtgcaggtgcctttgtttctctcctgctaccttcagcctctcctacattgtgtccctgtctttcttctgcctcgtccaccaagaggtttccctgcgttttgttctccatccccgtccactcgctgtcgccacaattgccttacaaacacactttcctttgggtttgaaaagcgcgcctcgctcattttcagtctagattcacacaacggctcccgactccgcgacgttccttcccaagcccattttctgtcgccgtcgttcccccgatatcaccgcacgcgtctaccttccacagaacttctttgtgttctcacgtctgaacgcggatctgacttttcttccagacgcgacggagaatccagtgacatctctagctcgacgcagccgcttttgctttctcactcgcgacaa

SEQ ID NO: 3371 - DNA, 3018 bp, Toxoplasma gondii
ctttcccttcagcgcctccctcccggaagtcctctttgtccttctcgcctgcggcatctgtcacggcgccgacgtccaccttactggctacgcggccttcgtgttcgtccgcgaggagctgctccttcgtcggcttgggcgttgccgccagcgaggccgagctgtcgagcgacatgagctgatcgctcacgcggcgtccgaagcggctcggcccgtctgagtccctcatcgttctctggggtgaagttcgcgcaaaaacgcaagccgcgggcgcagcggagactcgaggaccacggagtgcgacaaaagcaaggcactggggcgaggagagactcgcggcagcggcaggcgaggaaacaggcgatgcaagcgaccgtcggggagtgaggtctcgcaaggaagagaagtacgggagagagccggggaacgcgagggaggaggcggtgcacaagacaaggcggagaagagggcggcaggaaggacctgaagaagagaagcgaggaatcaccaggggcaagggggagaggggcaggtggggggcgggagatgtgacgcagcggagaaaaggagaacgacgaagagagagaggcccaaaaagaggagagagacagggaaaagcgagaggggtgttcgaggtagggaagaaaatgaatggaaaacacgaggctggaggggacagcttgcctgtgaagaagatgcagaacaagagatcgggtagagacgtttttcggtgaaggccacagacgcgaagtcccctaaaaacgggggggaaaacaatctgagggagaaactgccagaacggagtcgcagacgggaacgtcactgcccgaaggctaccgatgaagagtcaccagcgaggtcagcaaacgcagaaacggaggaaccggcgacggaggccgaccagaggcgatgcgggaggaagcggcgaaaaggcttgtcaagggaattccttgcgcgtgcattcagaacggcggaaaaggcagacctgctctcgtcggcttgcgttgtggggcatggccggccaacacagcccgaaagctcgaaatcggcgcgggagggagacgaggagagacgaaggaaatcggaaacaggtcttctgatcaaggcgaggcacggcgaggaggtggagtgaagacaagaggatttacgaagcgtaaaagtgggcatcaacacgcagaggcgcgacacagacgaggcgggacgacgcggcgattcgcggcggaagaaatggcggaaacaggtaccagaggaacgcctgacaagaaacgcaagggtgaacgcctacgaaaagagtagggaagacaacagagatgtggcggcgccttttctctcggtcctccacgacttctcttgacaggcacaggacccccctacactttctgcgctcgctgtgcgcatgcggcggcgagtcctcgcgagacgtcgcgctctgtgggccaccgcgagttgacgcgcgcgcggctgcggtccgcgaatctggcggacgaaacgcgactgggtttagaggaaacgacaggaatctgcatttcttaccgggcgacatgtcgccaactagaagccagagtgccatagatggtcctctcggaccgctcaggttgcggaggcctgagaggccgtcctccagggggcaccctcctggaacacgaaaaatgaaaagacagacaagacacacctgaaaaaccaactcgcctcggccgcagaacgcgttctgcctctcttttcagctcggtgtgagggcctgcacccggcgcgagccacgcagacgcctcaagaacgaaactgctctctggaactgcagcttttgagctgggttttcccctgcgagcgcgagtctcgccgctccgcaaaccccagtcggcaccgagaacgcctttggagccgaaactcgcggcacaccagcgaacaaagaacgtttgctgctgtgtgtggcggttggtcaaactcaggcggccgctccgccaggtattgtcgaggtgtcgatacaccccaggcgacgctgcgccgaggcggacgagtgagctctccagcccgcaaagaagcgcgaagacttttcagagtttgcgagacttttcttgccctgcacgctgcatgcgcgaactgccaaccgtttcgtccaaagaatgcgccacgaacggagaaccaaaggaaggcagacgtcgaaaatcgaaccgcagcttacgcgacggtttcgtctattgggattccagaagggaaccgtgagactccgcgtttcgaacgggaaaacggcgcggacccctcgcgcgcctcttgcttccagagccccaaatcttcgagagaagtcccgctgaattgccttacctcgtgatcagttctgttcctttgccttttccaaggtcgctctttcaatctgtagcccacttgccacggccgtcgggctgcgggtggccgaacgcaacttgccgggagggcgtcggcccgtttcgcctcggtcgaccgcaagactctctagctcgagcagttgttgactgttttccatgtggactcgtgagtccagaaacgacgctcgccgccggaattttgtcctcgtttcccgcgctctccaacgacagtcccccgttctgtcaacccaagaaggactgggccagacaccacgcactgccttggcacgcggcgcgcgcacctctgagtcactctccctcgcgtgtagcccgcgcctcgctctgagaaaaggcatttcgatctctttcgtcgcggaaaggccttccgatcggcaggttacctcgtggactgtcttgcctttcttccctcccagtcttagtcttcttcaaagcagctctcgcacactgctgctctgcgcctgctctcctcgtcgccccgactgctgtgtagaggcttgttggagtactggcgttcttctttgatgccgactattaaaagactttgtggacaccgggcagaacagggccaatgaaatccgcttcttcgtgactgtttctcccttgtttagctggctctctccacgcgttcgaaggcgcgtctcctcccaacttcctacca

SEQ ID NO: 3372 - DNA, 1983 bp, Toxoplasma gondii
gggaagagaggacaggaagtagagagaagagcaaacgaagagagagacgggagagtggagaggagagcgacgacagggggaaggactatacaaatccccccgtcagttacgagaggaggagcaggaacgcgtcctcgacacttgctctccgtgtgaagacgcgtagcgcttcctcttcttctccgatgttgcgtcatcggcgccatcgtacaggaagcatctcgcactgcggtgacggttccccaaatccttgtgtgtattccggctgactcgtcgtgatgagggacagtgtcaactcgcatcacgcccgttgacaagaaggccctactcaccagtcggcacatttccattggagtctgcgagagggccgctcaaacgctgcgtgagctcctttatcagttgctccttctctgcaacttgctgcggactcaggcgctcttccccgccgtcgaagaggagaggcaaatcgacaggcttctctttctcggccttgtcccccgggtgtgcagcctccccgggagacgcaggcctgccaggggtcgaggagaaggcgcaagcgagtctgagagagaagtcggatccaccgtcgcccactggcagagacgaaacggaggggaaagcaagtgagtggggagcgtcacagaagacagaagcagaactcgacgtcgtcaacagactgcgccgcctccacacctcatgcctcccagtgaaaccaacagacgcagagaagcaagacgaacagaaacgagtagaagagacaccagaggcagagacacgagaggaagaagaacaagaagaggaagaagaggaagaagggaagaggagggtgctcggaggagacagcgaagaagcgaagcgacggccggagacagcgcgtctgaaacccaggaggacggagcctccaggtgctggcattttggcgacttcttggcagaaatccggggagacacacggggagaagacagacgcgagtcgcgggaaacgacgagacactggaagcggaaggagatgagagtccgaagaaaaagacaaacgcgcgtttgtctctccctaaagagttctcttcgttgtcgtttgtcgtgtcacgatgcagtctcacgacgacgagactaggaaatccgctttatcgctagcatgcaacagaggggtctttcccttggaaacgccaagcgtcagaaaggagagactgcagtctgcaccggcggcccgcgtgtggaggagccgcttcactttcttttgcagagtcttttctgcaaatttaagcaagcgtcatccacaactcggggggtacagagaccagagaggatgcggagaaaggagttgtctcttcggcctgcagagcagccttcgacttttcgcgcgaaagccccacaggcccgtcagcttgccgtcgattcttctcgcgtttcttagtttttcggagaaacctctttccttcgtacttttccaactgtcttgtgcgtttcgcggacgcaagaagcaggagtgcggcgccttgcatttgtgatttccggtcttttctcgaccaagtcgctgctccgagtcacagagaaagagagagaaacggagacccagcagcgcgagagcgtcgagagcgccgattggcttgtcgctgcacagtcgagaaattctggtcacttcataaaaacctatttcaaagaagaacggggaaatagaagaagaagaagaaggagaagaagaagaagaagaagaagaaggactgaggagacagaggcaagtgtcgagggcgaaagaggctcgttgatggagacagaggtcataagaaaggcggagtcagagtggcacaacgagaggagctgcgactatcttcttcggcttcccttagatttgaacggaacgtggaacagatcctcctagacaaatccttttgaagtcccaagaccctttcctctcaacagaggagacgcgctgctcagtggcggcaaaagcactcgaagctcaaggagaaaaacttttctaaaa

SEQ ID NO: 3373 - DNA, 2097 bp, Toxoplasma gondii
gatccactcactctggcgtctgcagatcagacgaaatgtgcaattgctggaaccacggaatcggcgaacgttgcgcttctctctttccttctccccggtttagaaaacggaggagcccccgtggaaacgagcaagaatcacactggaatcgaaacatggccagcaaaagttgattcggtgaaacgcatgtagggagctttgggcgtgtgtgtttcaccgctgcaactcgcttcaccgcgaagcggctacaggcgccgagatccgaagacagcgatacctccagtcctttctaagtggtgaaggcattcactcaaagggcagtgaagcattgccgaggttggagttcactcgagcaaagctgaggtcgaatccgcagtttttcgcaaaggaatgcaaacaaatcagcgaaaatgccataaacaagccctgaacactctcgtcgagtccacaaatgtttagatacattgatacatctatcacacatctgtatgataaatatataaattcagatatatatatatatatgtatatacatctgctaattgtctgtaatatatatatatatatataattcagacaattttgtatgtttatattcgtttggcggtataacgttggtacactgggacgggcaagtgaggctcgttctccgtgacagccgctttttctgttagactggcaaggacagggagagcgaggagaaagcgtgaagagagtggtgggctctcctcttccgggccatcacgttcttttcaggcgcccccatgtcgatgggtttcaccgatctcggctccggttcagagggagaaagcggcaagagtcctgaacgttttttcgaccaggcagtgccgaatgcacacgaagtgtgtgtatcaccgttcttagtctgctgagatccgtggtacagcgctgttcttccctcatgtttgcggtgctttctgtgaattttttggtttctcttgccacgcaaagagctggaaagacgcctcccgggacatacacctatctttgaaactaaatagatttccatagacgatccaaagcttcatcgaagggataaggttagatttgtctccattcgccgtggcaatgttgcctgtgccgaagttgagacaggacgttctgtctcctctctcacttgtctcttcaacgtaggtcttcaagatccttcgttttaaatcccccgcgcgaagaaaagcatgctcttcgcagctttctctgtggctcctttcctctctggatctcatgacgtcagtctgaaagaggcgccaaggcagttaccttttgcgcagtacgggagaaacctggacagtttctagagtcgacttcgcgtcgtctcaacccagcgttgcagcctcgtttcgacatggcgacacaggccagatgcaccgtttgcgcagaaccgtctgtgtcgacgcatggataaatagccggggaaaagcagagatttctcgcgacagtagtgaagtgtcgcttcaacgaaaattcggattcctggttttcttcaagaaaaaacgtcactctttctcgttcccgctgaacccagatgcgtgcacacacacagtccacgtcgcgcatgcactgcctcttgtgtagacccggccgtcgcttttttgcagctgccctgaaggaaggaaatcggcatgtctggcgtgagtgaaagtgcgactgaaagaccttcgtaagtcttttccttcatctgaactgcttcgctccctttcatctttcctcctcgttgtcctccccctgtcaagtgcgaatggagaggccgctcgccgtctaccgcacccactagtggcagactggaaaagacctctttcgatcaagtatttacgttgcacatctgtttctgttttttcgatcatctcttgatttcggctttcttcgtctctgttttcttcctcgtttcgcctctccgtccgcctgtgtccgctacggctgcggctcccttttcctcagaaggcttcgcagcccccaaccggggaagatgaaaacgcttcgcccagagtctctttgagggttcgcttctctcgagtccctcttttccacaattatttccgcgtctcttcttcttcctctctctcctcgtcgcagaaa

SEQ ID NO: 3374 - DNA, 2723 bp, Toxoplasma gondii
tcacacttcattcacgcaaacctggacacggatattctcatcagtgaacaggaagaagaagtggggtgcacgcgaaagccagaagagctgtacgacatcatcgagcggttttgcctcggtcgccgacgcatcgaactttttggccgagactggaatcgccgagctggctgggtgaccgttggctgcgagttcggcctgaccacgttcgatgccaagacgtaggaaaaatcggggagggaatgaggaaaaggttgtgtataacaaagacgcagaactaggaaagctggtggaaatgcatgtgttctgggtcagacgaaaggcgttcgccagtcgtcctcagaagcggaggtcgcgcacgcaggtctggggaaggtgcaggcgagagtttagagagcgtggatccgactggcacaatttcggcagccaaccatacggattttggcgacgtctgctgggagtctgtttttcttttcaggtatgcatcgtatttcgatggcgacgtggcgtggccagaagcgacggactacatgggcggacggtacgttggaacgatgcctgagattgaacagctgcgcccgaagtcgccgacgaaatttccagatcggagtgcgggaggcacttaggggactttgaccggtgaaacgtcttgtttctcctaaggaagggaagccgaaacaaacaaagttcccgtaccctcgcgcaacgccagcgtcaagaactaaaagaacggagctagaccacggagccaccgagaccacaaggtgtcacattttcgacagtccttgacgagaatctccaaggcgcatgacacaaggtgaaaacaccgaagaaaggtgtataaaaggcatctgtcaaggacagcaatgaacttccggaagccgagctctatcgtcgcatcggaaatgcgaatgcacgatactagcctgtccagcatgccacacggatacagttgtgcaagcgttagaacggacaggcggtgtttgtcggagatagtgtctaacgggtttacatgggcacttttcgttagtgatcctctcttgctgcagcgtaccccggtctagtcaagttacgaaagtcccggcggtacgcgtggtgacactttgctgcgaataaagtgtacgctgaaagtgagaagtttcggacgaaatcagtcactgagacgctggcttcaggtgtggacgctgcgtgctatccagacagtgtctctgtggaaacgcagcgtttctctctcagcttctcttcgtacacggaaatttggttttcgctgaacaggtgtggcttgttcacgagctacagcaagtccaccaaacagtcgcccacggcagcagcttctgcctcaaaggttgaaacgtctcacataaactctgacgcttcacagaggaaaagcctgtgaccgaccgcacacttggcataacaacgtcgaatagagcactttgaggaaaaaattggtaaagttcaggcaggcaggaccaatcagacaggtgaagctagactccttgttacacgtgatatagtgagactcctaagcttctataaactacctttttctggggtgtcttttgtagtctggagaaaaaggggatctgcggggtagcacgtgcaaatttgtacaggcgttgaacacccaattttctcctgcctagaccacaaagtatcacacaactcattcactgtctcttcttatcgcacctgacgccaaatacgtcgggcgccgagcgactccagcagtaagaaattcatgttcggaattctgatttaccgattgtgtaagggccgagtcgcctcccctaccgttgaaagagattcagttagaaacttagcctctgagagacccatacgagcgctcaaaatgtccttcggtcagtttcttatcgaaggaagagccacattcaacaaggccaacatacaagaaagaaagcactacaactgctgcgagtgaaacgcctgccccataccttgcccgcacaccgttgttcggggtcggcgtttgtgcttttgaaggtagcctcgtcgtgtggttttccttcaggacactgcgtcccctcccttatacagcgtgtatggtctatcatgagtacccgcagcttgtgtcgcttctcgtttcctgcagtgtctaccgtagtcagctactatttgtgtatacggttagtcttctgaacgcagcgaaggatggctgcaccacttcaactgccgtcagcctgtgttctgctggatgtgaaactccgatgatgtgcgtttacggactttttttctcatgcctctcctttgttccctctcccacttccctccctctgcatatcgccgcacaggggcagcacgttgagtcgcactgtgctgccattgcatttgaggacgcggacgcggatccgcacacgtacaagcgggcacttcgtttccgtctgtttcgcaatgggctacaatgtaagtatccaaagagcaccccatcatccgataccggacgcggtgcaacccatctcccaagaaacgacgtgaacgctgatagcacgagctacggtgcacgtcacgcggctgcctctgccgactctcggcacccggttacgtgttagtagatctctggaaacgccccctggacgcggaacggcggtcgcatgtctcatttgaaaaatagggtgctacgccaggggtggtcctcgctcaagtgccccgcatcgtcccagacccaccaggtgtttctgtggcatcggtaatcttgtgggagacaa

SEQ ID NO: 3375 - DNA, 2571 bp, Toxoplasma gondii
gtaacgcaacttcagagtaagacaacactttgccacttgaaagagagccttccggggatatccttttatggaaaactgtagagaatctcagctagcctttacttccagaacgagcgactctgtaccatgtgtaccactccattcaggagcttaccgttactttcgatgactatgagtgttcttggtgtaactcaaatcgaagaaacagagaacccggccgctcgtaatacttcttcaagcatctttacccaacaaatagagcgggcccttcatgtcctcactcgtctcccccaagcaaacagacctgacggcttttcggttgcctgaaacgatccgagcagcgagcactacgtcgtgtcacaggcttcactgtgagcagcgccgctgagttacttgagtacctcaaccatatcgaagggattagagccacgaaaaccccgctgtaactcgccaatatccgtaatggaacacccttatctgtctgtccgagctacgttggtacgcgttgaatgtctggaaaaaaaggcttcagccgcaattcccgctgtctcgtgcctaggaagtggtaaaaacgcctgtcctagatatgatcctccctgtacggtgcctctggtcgcacaccggcgtctgagtaatcgttttctttcgctgttactacgagggaaaacaacactccacttttatttgcccggaccacaacagatgcggctaaccccatgagaagagaacgccaagcttgacaaatgctgcttcctctcatgtttatcttggaaattgccggatgctggtgtgctgcgaatcatcaggccgacaatgacactctccttgacagaaacatcaagctccgctgcttgcccctacaattgttctgcccatggcttctccctctgccggagaagtcgtgcacaggcacttcggcaggtcatgcgtgcagatagaaaaccgacgacacgctgacggatgagtttctttttttttctcgacaagaatagcgaacgcccgcagggacaccctaatggtttgcccgaggtccgttcttccgatctttccccccgatctcttcttcgcattctttctcttattctttttttccgtcttcggaccggctgagaacgcaggagacgtccaccgtttgtttctcacctaataccacatggcggcccgccacgtgcctcgttccggacacaaaaacactccatgaaggagcttttttcccggttgattttcgttcttgacttctcgcttcctatttcttcgtctggtaacagttcgttacttcttgcggccttcaatctttgtcggtggtcgttaatcttggaaggaaagattggttttcaggtatacgctggtttctgcactttgcggatcgcgtagagcacaccgagatgcggagactagacagccgggaatatcgcacactgcgcgaaaaggttgtatctttcttctacacgggaagactttgagaaatcgatgtccttcctcctttctagaaacaagacacgcatcttctgccgctgggcccctttctgtcgtctgcttttccttcgaaggcgacttttcgcgcgggtgtcgtcgagcacacacacaccacgcaagcggcagaaactcctttctgcatcgattcccgtgaactctatcggctgaagggtctgaatttctttttgcgacgttcctcgttgacagtagtggcggcggaaaacaatgaacagttctgtcttgcatcaagcattcgcgtgtcttctgtctcgatgggtgtcaatgccgacagaggcacaccggaaacgtctccggtcttgcgtcagctgaaacttttcacacacaagagggactgaaactcgacaaagctctggacacggacgccttcttcttcccctttcctcgcttttccccctcccaaggatccttcttcttgaaggacaacatcaagcgacgaaattgccccagaaagagtgcctggttctacaaatgagaagaagttcctctgcgtaaatgcaactgcacaacttcttgtcaattgacccatatacagtgtccaacaaacaagcatatctcttcacacattcctttccctacggtacatatgtatatatgtatctgtctgtatctctgtgtatatgtatgcgtatctggatatatctacatgtaaatatgtacatgtagatgcctgtattcggtatgcaggcctgcgtctgtaggagtgtatgtaggtttgaggactctcgagcaagacaaggaggcgcaggtgaaacgcagcaggatggcagcatccgcgtgagcgaggggtgccgagacaactgagagaaacgaagtggcttttctgtggagtctcgccgacgcgttcgactggccgttcgcggctcgtcctgggtgcccggacgcaggaagccttctgtcatcatccccgcgaaagagagaccctgtaacaccctgaaccggcgatacgcaacggcggagagacgaacagagtgcagatgcgccgagccgcaactggggacagctgcaaggtcgcaggacgttgatcgcccagacttgccgctgtttccaccacgaggcgaggacggagggcaaaga

SEQ ID NO: 3376 - DNA, 4738 bp, Toxoplasma gondii
agacagttgacttcacgttgtcctcgcgaatgactccttcgctcctctctcgagcgcaggcggctctgtctcgtccatcgccctgtctctctggcgccgcgctaactgattccttccgccgagtccaccctgctgagcttctcacagaccctgcgtctccgtggagacagccagcgaccccacacgaagcagagcgagcttcagcagcggggggagattcaggagcagcaggagattcagaaacaactagagattcataagcagagagagacttagagactgaggacagacaagcgcctgcagagccaggtggcgacggacgctcagaagaagatacagaagacacagaggtggaggtcaaagtcgaggatgggccaggatgcgggagatgtgaattttgataacacaaaggagtgacagagttcgcgtacgagcaagtgcatgcaacgggcgtcgaggacgcagaaccagcggaagaagactccacagggaacacagacactggcgacacagagggagacgaggaggacgaacgaggagaagaaagagggcaagtgagagggtaagcgagaggcgcaacgagaggagaagagggaggagagtggactccagaggcagcagctgctgcaactagcgccatagtgacggcaggtggagccgaagtcgaggcggcacagagaggatgggcgaggccaaaggtagcgccgtcgcctcgagtcgtgaaacgcaatcgcattgaagtcgtgtacgcaaagtagacgcaaggaagcagtggaaacaacagagggaagaacggttcaacgacgagatgatgacagaagagatacacatgcgcatcgagagacgaaaggaaagggaattggaaagggcgacgctggagacacaggaaagagaagaacgagtcgggacatagaggggacaaggaattgaattgtgagctcgagactggaagacgcagtgggagacggccgggctggagtcgcaaagaggcgctaatccagcgaaagaggacagccacaagaatagaggatcgcagacagggtggaaaaagaaaacgtggaaaatcgaaaagggttaagaagggaaggagccacgaatgaagagagacaaaagagaaggaagggagcgagaggaaagcgagagacggccaaacagagacacagcgaacctagctgcttgcagcggagagcaggggatacagggagacgagaaggaaagtgggcaagagaaaacaggggattaaagaagaaaaaggcaaggaagaaagggtccagcaaaaaagggagaagtagaagcagaagagcctgtgagcgacacaggaatctcggcgggtcttttgcgcagcgctcgtgcaagcgcttcaacgaagaagaggggggatctgtgccgacctcgcaagacggagaaattgagacagactgagggcgaaaagattagaaaagcagaaaacacaaaatgaagagcatacgaagagtcacggggaaacgtcagcgaccgacttgccggacgaaagcgctcgacacgccggggttttgcagttgtcttttgcgtcacgacaagcacgaaaccaatccggcgaggaagccaggatcgtcaaaaacaagaaacaaaccgaggagacgttccgagtcaaatgcgagagacaaaaagctttttgccactggaaaccgctctgacctcgtagcttgcgcgtgtcggctcggcagcgacagctaatgcaacgtttctgcgcatgtatcaaaaagtggaacagagtggaggtaggaaatactacatttaaaacccgatcatagatcaaggaaatgctccttaagaggcaaaaagagacccactaccggctgcagtcgagaagagaagggcaaagaacacccagactcctcattcagctccgttcctgacatggtacattcaagagtaaaacgacgatctgccgtcggtggtgcaaaaacacggaattccggctccgccaagacggtacgtttcacggatgaagacccacgaatgcaagcacagagagaggtagcaagagagtaagaatctggagtggaaagaaagtcaaaagttgagggaggattcgcaaacccagcacacttccctcagagcagctgcaggaaacgaaacgggtcgcgctcacacaacgtcccagaagtttgccatctccagaaatattcaagcgcgaagagtggaaattcgccgacaaccttaaaggggacccccagatagcggaaacctctggcaaacaagtactcctttctggaaagcttatccgttctgcatggtatggtacttggaacgagcgccgcctgctgtctggtagtgaagcacggtgaggaccgttcagtttagaaatatttgactgctggcagacgccttcgcacgagtttatagaacgcagcgctttcttgtgctcgttggcaatgagaaagagtcttgccaagccataaacagtagtacctgtgaaacagatacacgcatccccctcgcggacgcgtgtactgctgaggcaaaaactccaacctaagttaaagtagtgctactcatttgacatgttgcctatacaaggtaaacgaggtcatgtgactaaaactaaatcctggggaactgtggattgcgtccatacgaatccgcattttgcctcgttccttctacggagttgtttgttgctaggctttgtcccctctttcgaagcaggagggttccagagagctgtttcatttgtgacctgaaacatccaactaatgacactgtctttgtacgtctacactaacaacaagggtgctcacgaagttggtgggctgcagagagctgtattccgcgtatcctacgctcataggcgctgaggtcgttctacctgtgtgtgcctcgcagactgcgcaggtcaagaacctgtataacatatcttttgcctacacatgtacggaacgcaaaaatacccaggcaaagaacttgatcttctgtctgaattctgcaaggtagacaccctcacggaaggcggaacaagcacttagatgctctgaagtagcgcacccgtcggtcggctcttttgctcatcgccactggaacagacacaagctttcgccgttagcacgtgtacggactttaaagaatgaagaatcatggcaaatattgggcaaagtgcaggaaagtatgtcagatgcagaacgcgttcagggacggctgctactgcgagtgaatcgcctcccactcagctgacttcttacggaacatagggtaactttcctgtaccgattgactggtaaagttttaaggtcgtttctacgcgatctcccaattcctagtaccataagcgaactatttacgtgtcatctgaagtacggagtgttctcctagaaaggtacacagaacttgacaagcagactgtgattaagcggcggaacacggagtgcagctgttgtaaaaaatcaacactgtatactggcaatatcacagtagatgtacggcttgtgtctaagcttatggcgcagctgaaaacggagaagtgcgaaatgcttcctgggcaaaagcggtggaacaacgttcccagccgaaaagtgacatgcagcgactgttacgaggcttccgactccaacgggaagttatgttttgttttgcagccattaccgcgagtccttggctgtccagtttcaattgaacatgcaatattgacaaccaccggaacggactctgtgttggttgttgaacagcagcagattcctgctgaaagcgctttgtgtcggcgtttttcggagacagcagagggggatggtccgcttctttgtgaaaacaccaagagctggacggtgtgaccgcctctacttgcacactccccggggcttcgcgagcgaagcttgcgcacctgcaactgcgcctgggggcggtccacctttgtttttttgttttcattccttgctcctgttgagggcgccggggtctctccagcgcccgttttaaaaactagaattcgtctgtacgccacgggaggtgcctctctcggcgccgtttcccgcggtttcccactgcagtagacgcgaagtagcgcaccggacgccttttcgtcgtgctcagtcactccccacaccgcggaccagaacgttcgccggtttcgtgcctctttgctgcgttttaagcattcttagactccttaccagtttcgtccttgcattgggagttcgaacttcgttgatcctgtctgtccgtgcttctctgagggagaaacgaacggatttgtcttcccccaacccccgccgccacagcgcggtccctgagttttcttgctgtctcttggttacattttccaagcaccgccaaaggaatctcagccagcgaattcgagggaatgccaccgaatccattgccatagtatgaatttactcctttgatcttccattcaccccccgccgtcgtcgtgcacggtccccgacttgcgcaaaagttcctttcccgcacaaagctgcttcaggtaagcaaacgttcgctctctattgttcggccgacactacacacctcgcgaaactgtgggcctgtctgggatggttccgctgttgctgcagtcactgtcacttccgtatttttcttggtttctcctcctgtttcctctggctactcctgtccgtgttcgccgcatggcgcccaagctttcctcgcttgctctgtttcgcatccaaccgggtgagacaatcatctgtcgtacttgtctgtgccattatttttgttttcaatggcagtgcgtcttccagga

SEQ ID NO: 3377 - DNA, 2726 bp, Toxoplasma gondii
gtttttgttttagcacgtgtatcagccttgcgtaagggagttacccagaaacagctggatcgtgttggcccaggtgttgtcgggataatgtaggcgtacttttttttaagccggctgtgcgtcagtggacacgcgtcagggtgttgcacaactgcacacttcagacctatgttttacagctctttcgatcgaacacaatgggaaattttgcagggctccactgttagcaccaacgcagccactgactccacgttcaaccgggcgatgtgtagcaactttttgcctactcatgcgctcaacgatcgctctcgcagtagacgtgccattgtgcgtttcggcatggcgtactcacagagcgcgtctaacgcaaggtattgataagatttaccccgaggtcttttggtctgggtacgatgggatctgtctgtcaagcgagaataatggacgaaatctagtagcatttctctgcgagcttggcaacgcctattgaggattagcgggcactatgcggtgcatcgccatcgccttcctcatgcagattttcccttgtgaccgcagctagttcgaggtggaagggtttcagttacacaggattggacgtgctggtaataacctaggtacatattcgctagagcggacaaatgtctacttgcatgtgtgtcgtataacaaagacaccacgaacgggcacccgccttcggcagcaagcgatgattgtcaggtgcactggaccgctttcatttcttcgggcatctcgttgaatctgaagcagtattggcaactgtcaagagccatcactgcgtggaacagagccagtcgaggggccggttggccataactggcggattcaacactgcctgcgcgtagggaaactgccctttcttccccaagaagacattcctgtctgctgcagagacattccgtcactcgctgaagagaaaactgtcaccaggctatgcactagagacgcggaacgcagcttcggaacgtgttcgtgccgcgaataccaccggtgataccagtaagtctgcttggcggcgtcttgcgtcctggtatgtgactccccactttggcacgctcttctcagtcaacgacgagtgcgttctaaccacatgtcgcgggctcaagctcatttggtagccgtgcagtgactttcgcggaggctcttgatctggcagcaatagtcattgtcctgagattgcaactctttggttgctttctcttctagttcggggtgaagagcaggagaggttgactgaccgcgaaggcgcacccgcacgcggttggctcttcagctgcgcgaagacgtcctggcgcattcctgggattgcaagcgtttgaaactggaatttgtcacgaagtggactcgtctctatgtttctcgagagcttcgttctgctacgcctgacggcgtttcaatgagctgcgaacgacgcttgaccgtggagtctgcgtttgtacattgccgtggtagggggcagaacactcggctctgcggagtttgcgggacctctcgactcactctcaaaaatgtgagtcatgctttgctttccttcttgtaccacgcattccgctttattgtgacttgccgtttagctaggaacggaggggagcctcaccgttttttcggttgcccctgtgcctgctgtgtgttcgccgttgccacacgaggccttttcgcatgcggcaccgttttgcaatgagactgctgcatggttgaggagagagccgcggcgagaatgaaccaagaaaggaacttgtgacaggggaggtttgccggcgtttgccgctgtgtctcggatttttttctcatccctgtagcaccctcctgttttacctctggaagcgtacgagaaacccccggccggcgtcgcaaccggatgtccgggcggcgccacacaaatccgcggttgtcggttccgtttaagcaggcttccctctaagtgaattcttttgccgtacattttcacagggccgctgtgcctgtgtttgtgtttcttgggtgtgccagacgtgttgttggcgcttgccacagaaaattaggattttatcgaaggtgttgaactcaacgttaagttgccatcaggctgtccggtgtcgaccattggtcccttttgtcgagtgtttgtgtcgctcctcgttttcgactgaccccgaaaaactgtctgacgcatttcaaaagcatgaccacgtacaccgtgaacctaagcttcgggtgcgacgctagctgatgtcgcacagctctttccctgtcagttttgtgctttgacatttcctctctgggttcgtttcaccatctgcgccatgaagacgctatcgcctcgttttcgagcctctctccagcctgtgcattctctgttctccgggtttccgttgtccgttgcggagttcccctttgtagacgcgagcacgcattttaaatcgcgcctttgtcgctgaaaatcacagctttagattttctggaagagagccatggggctccctgcctttgtccgtccactgtagcctcgcccacgcgcactcgaaccttccccgagggcaccgccgcgtggatttccttgctttcttccagttttcctctccggtcagctcatcgcgccttcttccgaagttgtttggtggcgttcgctccagagcgacgcggaaaattccatacgtcggcgctgtgtcggttccgtccaactgttctgcctgctccggaaccttcgccgctgtgcctggcgacga

SEQ ID NO: 3378 - DNA, 1991 bp, Toxoplasma gondii
gactcactggaagccagaagttcccgccctctccagtgtagagaccgcgcgcctgaactggccacgagccgccgtgagccagactcggagtgtccccgccagaccgagtagccggcatgtcgcaccggaggttccgcgccccttcctgagcacttgcagaacacgcaaaagccgtgtatcccggtgtagagacacctgggagagccccgcaggcgccatcggcgctggagagctgggcgggaacgaaggacccgtcgctcgacaccgcggcatgcgccccgtacggaaacgccgcttgcgccgtcggtctgccagccgcgtagggaacctgggcatgaggtgcagagcagaacgaccagaccagcggctcggcagaagtcgacggcagctgccgggaagaatgtccctctgcatgcattctgacgaggagaggcgcccggcggtcgccgaaggcgctgacacacgctgaggcgcccgcaagttgcttgaatcgcggagaagccaagtgctgcgcaggaagtgaaccgctggggacgcgaccaagagtgagaagcctcacacgcagtttgcggaaagggaagtcgagggatgttgtcttttggcgcctcccagagagagctggaaaatgcgcgactccgggacggactctgacagttgacaacagccccagttccgcagttctctgaagaagcggaacctcttttcctatatagacgggatgacagcggaacaggaacaagaaggcgtgcagatggctagaccaccatcggatttcggcgcaggtggcgggggggggggggttgggcggggggactaggcgtgtggcgttcacgtgacgagcgggctttacagcttcagacaacgcgcatgagctcgccgacagcaattaagtttgcggtaaacctgggaagcgaccacctggaagccgagctgtgagtcgcctgaggacgggctcacatcgagtcaaagaatcccgatatctcagcttgccagaaaccgtgcaaaagacagtgcgcgaggccatacggacacagtgtggaacatggacggttgagaacggacaagagcacgcagacgaaagaacggggatagaaatcagaaactgggacgagagttcgcctgttgtgcgcatgtgcagagtgcggcacagttggaattcgaacagccagtgtttcagaaaaacggacacacgcccagaaacacaactcgcgcggatgggataaatgattggtaccctgggcaaaggcccccctcggatgttggctgaggcaccccgtgatttgcaggatacaggtcgacgtttcgcgcacaaataagcacgataaggcgtgtgaagttcacgacgggggccggccgaaacaattcgatacggactacacagcaatggcagcctaagaagctctgcttttttgcgggaaaagagttgaagacagcgtagcttggggggacccgacaacaattacagctgtttgagcagcacaggcttcccaagggcgggagggaagctacaggactctaaggctggaaaacggaaaggcttccggaaattttccgggtggacagaaaagatcgcctctacaaacgcagtgcgcttgctaaggggttctccacagacttcataaacgaaagaaatcggaacgcgaccacggggagaggctgacagtagaatgttggcctctcagtcggcagctgacggttttctcgattaccccccttgcgttgtgtggcacttaaggcaggaagacgagcccttactttgtccaccgagaaacgaagacggaatatttgcgtttcgtatgccgcggaagtgggctgtggagacggggacacgaaaatacttctcagtgaaaacgagtcgtcgatattgcatgcaaatgcgcctctggcgacactcgcttggtcagcgtcaccggggtaacgtgagttttctttgttgcttgtaaagttcgctggagcgtgagaaccgtctgaccaaatttcaagcgcgccaa

SEQ ID NO: 3379 - DNA, 2622 bp, Toxoplasma gondii
gaccctgtcgagtgatgaaacacccgaaaacgccaccgaccatcatcgtcagcgaagcgaagggaagcgacggagaaaggaagacgcagcgacgaagagcgctgaagaacgggggaggaacagacagaacgaatcgccgaaacgcgaacgacggacgaagacgaggaggggaagaagaaacaatggaagaagcggaaggcgcggcgagtccgagaagcagcaaggagagcaggggagaaacggagacttgaacgagggactggaacttatcaacatgtacgaatccttcaatagtggaatgcctcctctccggcgagttgctctgcgcgtctctcgaaacggcgtcgcgagaggcgtcacggagacaaaaaatcctggacgttcttcagaagtccgcaagaagaaacggcaaaggcgtggggagatcacaaagagaaaagacaagctggagagaccgagcagaagaaatcttccccgagaaaaagagacccaaggccggttccgacctcgacatccgcacccgcttctcccgcgaatatccacctctcccacagttccagcaagatctccacaggctacaaagagcggagctcgaggaactacatgacttcagtcagactgttctcctttccctctcctttcaccgtgcacttgagacggcgcttgcggcggcgctcggccgacctgagcgcgagaggcgagcgcgagaaagccaggaggcgatcgaccgagaggaagttcgcgtctgcgaactgagaggacaaagaaaggcgcgtgtgttgcgcgcgacacccgtttagaaacgcgcctcttctcgcgtttcaccgcgacctctcgcgtttcaccgcggcctctcgcgttgggatttgtggctggccgtctggactacagcacgcgatctgagaggcagggattggaggggacggacaggcgtcggtggtgcttgaaaaagaagagacaacgcgagaagttcctgcgcgaaacagaaaaaacgcggaggtcggttgctggctgcgcgcgtgggtgtctagacagcgtacggcgcacagaccgggagagttgtgcgagagagcaaaagaacgaagtagagaaaggacagaaattcgccgaaaggcttttctacaccttggacaggtggcgttccacaacgcagttgagaaacgagaaaatcacagacaggcgcagcagatacgtcgtgatgtccccgcgagcgcgtagaatcctcgccacacacgtcgttctttaaatcgatttctcgaggaatgtctcaacaaagccgactctccactccgtgtttccagacagaaaaaacgttctgcaactacgcatgcagctggcacctgacacacgcagctgcctcccagccgcctagcggtgaggaggttgcggtctcagaggcgggtgcggcgccgggaggaaactttgacgaggagagggcgaccgaaaaatctctgaatttcgagctgaaagagcctcttagggacagaaaagagttttccggagagatttagggaacctgaggcgcggaacgagctcagacagtcgagagcacccttcggcattgcctgcgctagatcaccggctccagcgtgtggattcgggcgcttcacgactctttgaaaatcacgaggaaacttgagagatctctcgactttcttcgaaacagagacaattccttcgagaggaaacccaacgtcctttcggtcgctgaaactccggacagcaacacagaacatcacgcgcctggctagtcgccgccgccttctctcggccggtggacttaacatgcgacacacgacccctgcatgcacgcgagcgacaggaaacctgaaaactctcttctctcttcctcgcggcctgtctcttcctgtcgcagtctttctttctctgtgcttctctctgtctcttctgctcttgttctgccgctcctgctctgtctcttctgctcagtctgctatgctcagtctgctctgctctgtctcttctggtctgtctcttctggtctgtctcttcagcgctgtctcgtccgctctgtctcttctgctcagtctgctctgctcagtctgctctgctgagtctgctctgctctgtctcttctgctctttctcttctggtctgtctcttcagctcagtctgctctctctgactggcgctgtgtctcgtcgtctcgtcttgctcggtctccagtcctcgtttcagtatcctttttgcttcctcgtgagaaagaaaggacctggcgtttcctctccgcattgtttgtggctgagacagccgcgtacacacacccgtcgcggcgctcctgcaggacgtcgctcggacgcagtggcggctgtgctgcgtcgacgcgaggactgctcagccgtctgtcggtatcctctgacagcaggccgtcccctcaaaaagtctgattagtaatctgttcttccattgtttcgagctcgtctcttctctgtctcccattcttcactccttcttccttctcttctctccgcggctgtcttgtccctctcctctcctctgccctctctctcttctctttctccttcttgcttcttctctccatctttctcttcctgcctttctcggcgcgtctcccggagtgactcgtgacttttgtcaaga

SEQ ID NO: 3380 - DNA, 4475 bp, Toxoplasma gondii
tttcaggagcatcgaccgttcttctgcgttcctccagtgagccatgcagttcgcgaggcgacccactcgagcgacacaagccgtagaatctggcgcagctttcttgttctcccgctgtcggtgctgcacggactgaccttacctcatcgacgagcggctgcgcatgctgctcgaagaattgttcctgagacgtactgacaggacagacgccgtcgaagcggaatactttgctgctgttgctgcctgcggcgttcccttgcggcctagccgcgttggcgcttgctgccgccgaccctccgaggctttgattttttccagaagccccggcgccgccgcctccacgcaaacgaacgatcacttcgttccgctctgtacagacatcgactacgttagtgctttcgcgctgctcgacggccgtcatcggccgacatcggacgacaactttgacgttcgtccgacagtcgccgcccgcgctgggcatcttgcgtggcgccagacaggacgcaatgcttctgctgctgtgcgtcgagttcgaatcggcactcgagggtgacgcgattttcgtccgcgttgaagaacgggaaagcgacggaactgcggacgctgcgactcctgacggcttcgcatggccaccagcagctgtggcttgaggggctccactggcagcgtcgccgcgacgtttcgccatctttttcttggagttctggtcggtggcttgtcgccgcgccagtgaagctgccagaggtgtgtgcaggtggtgaacaagaaaagaaggcggagcagcggccaaagacgcgtcccgcgcttccacgaaccgcggcgaatgctgaaagtcttcgtcggtaaacacgctgtacagtgcagcgttcgggtcgctggcctccggttccggaggactcgaagcagccatgtgcacgaaggaaatgctaaaaatcacagaaatgtgcggacaagcaacggctcaaaactttaagagagcctcgaaacatccgcagctccacggcgaagcagcgtctctcgaccattgtctggccgcgcgtcgtccagcacgcctaactgcacataattgcagacttacttaacagttttcagacgggtgagggtaacaaagcgatttcatgcaaaatgcgtgcagctgtgctaaagaaatgtgaaccggcaggttccggctgctgaaaaatagctcttccctgaggaaccgagcctcgtgtgtctcgtagtagctgcgactctaagaaacgaagaaaggcagatgctaactgctttccacggtggctgacgcttccatgtcgtgttgtagaccgagaaaagagcaaacggatcgagtgtgtggggacgagtttcttgtcgaggaaacaggaatcgatgtcgcaatattctgaaaaaatgcatgcagtgacgcgtcgctgcttggcaggaaaagccgcagggagttgcggacatccgacaaagtctgcccaaatgtgcttggctggattcttatctcagcggcttcgtcgttcctcaaagaaacagaagaccactaccagtgagagaaggagccaaatggcgacatggcagcctgaccgcacaaacagcttttggactgtgaggaacgacaacgcaagtagtgacaagaagaacgcggacgaacaggttgcggaagtcgaaatgcagcagactgaccgcaacagcgaaatgccaacacactatagaagacaacatctagacggattcttacgcttcttcacatgcaacgaagaccagctcaaagacaagaccactagagccaagaacatccttggggggtgggggtgggggcagatagggggttgaacgccggtgttgaagggatatgaagaaacccgtcaatttctagtggtattggaagccaggtggtaacacgataaatgaaacaaacgggacacgaaaaaagtaacgacatgaatctgtcctaaagcagaaggagaatcacgcgtacgcctcagctctgcagtggactacaggcaacgaccacgcgtggcgttggtcagcacacgacgccagtttctctgctcacttaacgtcaaagattttgacgcagcggcacccactttcttttgtactcgctttgagcgcaaacagatagtagattactcccgtatagcttgttaagttacacaggaactacgtgctagaggagccccgaatttgatacagggtgttccccgggagacctgaagacgtggaactattgtgccttcatacgctggtgtcatgatgccagaaaatcctgcgttgaggaaatcagtgactttcctgtaacaaccaatcctccgtgtataacatgctattcaccatatcagcacctaggcgatcgcattgcaacaaccgagaacacgtctcgtaactcgagcacccagggtgaacagtgaaccggtgatttatgccgtcagcctgtcaatgcaatgtccataacgataacaccttttttgattaacagagtagtgtagaagtttaagttgcattgcatttatactggataagtttgagtattaactcaacacagaacatgggggccaaggggagcttcatgtgttgctctgtgcggcatgagtcccagaagttcgtgtgaaagcagctcctcaagctactcaatttatgaaagtacagcaaagataaccgtgggctcaagtcgttgattccaccggcgaactgtgttgcgcacgttaaaagggctgtctagaatggccgtgaactacggctgcccaaggtataagctaactaaagtgagatactttgcccgagaagacaatttttccctcgccagattattctcttcgatttttcgcagctctgaatagcaaaacgaatacggctcaaagtgtcgctggtgtccttagtcgagaggactgtgacgtcaaactcaaatgctttattgattttgacggttgttttgcagctggaatataaattcacgctttgcagtagacacgtcttagaagctttttctgaatcgttgtttgccctggtagcgcgcctctccattccctcgacgggaggacggtctaaagcctttcgcggctgcaggatttttctttccgacctgtaaataacacctgcggactacgacgaggggcgtcagtcccccaaaacaaaaggctcgacattcgagtgacagaaatgcagccgcttgccactgaagggcgttcctgttaatgagcaactaggacctccgccgtgtatgcctcttcacacacgctaataagctatctctgagaagacggcaccagggatagttacggtgtttgcaagtgtgtgatagagggaagtaactgcacatgcagttgcaaggaggcttctttctcaaagtgcggcatctatctgtgatctcgctgcataggctgctcttttacaatcaaaggagtacgccgtctaaccatatttagaaagtcgttctgggtaagtgcagcgcggcacaaccggcagtacgacccgagatgttatttatcatcaccgaccacaccacgagacagttacacataattgagtaaatctacttgcaacaacaccagatgacacctggtctatcagctctgaactgctgccagatgcttgttccgatggaaaacaaggtcccggtcaccgtgtgcctgggataacgttgtcccgcgatccctccttcattgtcttctgtactccgtgggtgtcaaacggatattctcgaggtcaaaaggcagtgcattacgtcttcagaccctcccatgcgaaagagcaatactctgtcctataaaacaccttttaccagtgggttgccaggtcgtcgttatttaggacactaattacaaacggttcttccccactgacttcgccggcggtcttgaggtttttgaactggtgggtgaaaccaatggaaaagaatgaggtacaaagttgttttgctcacttattctcaattatgtcgttcttcgcgtgatcccggtgctaccccgtgagcacagagagagacgaacccactcgtgactctgccgcctccccagcgcgtttttcgaagcaaactcgtttttctctgtgttggtcgctagaaaagggtcgaacagacagctgcaggtgactccctactgctggttgcagcagtttcctcttacgagcgtcctgtctcgtgccttttgatacacgtcgaacaaagtttaaccgctcgccaagagagagtcgcccgcctccagcgtgtcgagcaaccgctgcagtgtgagcctgtcttgtgcctgaagtagcatatagttggaggacaatgatgccgcgtcgcttgggatgttcctggaagtttgacatattaccttgttctcgacttttaaataggactgtagaatctttgacgtggcaacaacatcagcgcatgttctccactcgaggaggtcggcctggacttgtgcgctgtctttgtgtttagctggcaccccccctcaaccagacagcccttgcggtctcgtcgaatcctgagcccatttccgggcata

SEQ ID NO: 3381 - DNA, 3834 bp, Toxoplasma gondii
ctcttcagagagaccgacgagaagaggaaagaagccgacacgcatggacgacttcgcagatgtctccaacgggcgctgcgaatccactgggcgttcgtcgccgagtccttcctcgcgggagccggcgtcgtcgctcggcagcggcagcgaggcgatgtgcagaagcgagatgagagtctcgaggtcttctaccgattcctcgaagtcagggcgaagcaccgcatgcagctccttcgccagctgcctctgtggggtatctctgccctctggcgccgcctccgccccctcccctggaccgccaagcgtctccggagacgcccgagaggcagcgagggagaagagcgacagcagcgccttctgcgtcgcttgcgcggagcacaagtcggcagggtctgcggaggcggaaggcgacgccgttgccttgtgtctgaccaggagcgcagccgcgagaaggtccataaaaggaggcacgaagaagctgctctgcgcctgccttcggggagacttgccagagggcgaggcagagaggggacgacgcagatcggaggcgcaggaaccgacgtcggtcggccgtgcagggtcctcgcgtctcttggagaaaaacgcaggcagatcgaaaaccgcagcagcagacacaccctcggaacagccgatgagaagcggcttctccgcgcagacggtctctccaagtcttagcgggcgctcgcctacggcagccacattcaggaagtctccgcctgcaagaggaaagcagaagggcgaaccgaagagacagcgaagcagtgaggtgtgcagaaggctgaagaaaaaagaaaaagagacgcgcggagactcagagagaccgaagagggtgtgtgaccggaccccagtcactgcgaagaacgcgggggacagcgagaaactcagagcccagttcaactggcaaggcggctgacgcgcgattacacctgcagtggtacttgctggaaattgctgcgacgacaacgtttcgcctctctgcccggaaatcagagatgcgaaactcgacacgaactcgacgctgcgctccaggctctttcgcgccgcaagcctcacgaaccgtaagaactgtgagtggaggcatgccgcgtagtgcacatggagctgtgcagatcctcacaaatatacacagagatagagacagacagagatagacatgagagggttgatgcaattctgcaaagaaggaaaggtgaacgatttcgaggtgtcgtggctaccgaggagagcaacggagacagtggtacggcaagcgacgaagacaggcaaaaaaaaactgaagacggaggggaaacttcctctccgaccgtacctcggtcttcctgatcctttcttctggtgagttgcaaagaaatccgcggcctttcgggtgtctgtacacccgcgaagagcgcctgctccagcgccgcgtctccaccggttttctgtctcccccagttccagggaaaggaagcccatccccaaagataagaagagacaccccaagaagaggaagacgcagacgacgaagatgatgcaggaccagaggaagaagcagaggaaggacaagaagaagtcgcacatagagacacagagaaccgcgtgcgactctggccgttcttgacgagccggtgtgcccagagacgtcggtttttcctctcggtcttcagtccgagacagactgtagaggatcgacttcctctcgcagttttcacttgagtttctccctctctctcaccactcgcgagccaaggagtatatacaccccgcgtcggctgcgagcagcccccgacatctttcgccctgagtctgtctccaactgccctctgtctttcggcctctctgagtccccgtaaaagagcgcctgcagacggggatcgcaagcaggaaacgagagcacttcgacgcggcgtgtctccctcgcagagtctcgtcgctgctcccctctgttgctcctgccctttctgcctcgctgcggcttgcggtgtctggacaccgctgtccgcctccgctctgaagagaaaggaaggcgaccaggcagagagcagcctcagagaggctgaagcttgtgacattctctcagtgaaggagagggagacggctgcaggaaacgttgaaacgagctgtctgtgcagcaagtggaaggcggcgactctgttgaagacggagagagaatttggggacccagcgaccttgaaaaaaagagagtgggggtccaaggttcctccgaaaaatcaggataggagtcaagagaatgcttcagagaacgcgttttcgtccagctcttcgcaaaaattgacagggagacaacgcaggcaagtcgcttgcgagacacacacacagacacactgaagcaactgcatgcctctcaatatcattgaagatgcagattcacatacaaaccctgtgtatacatacacgtctctgcaagtatgcatacgtgtatatgcgtaagtgtagatcgtgttggacgtaaaatccagcacgcagaatacttggggacgtaacggcgtagacgcaggatgcataaaattaaatatacatacgtatatatgtatatatatatatgcataaatatatagatatagggatatatatatatatatgcgagcgcgtggagtgaagagcggagaggactgagtgcttcagcgttggctgagagaaagggatctggaacaatttcctgggtcgaccgccgccgggcgctgcgcgcagcggagcggagacgaactggtgccggaagtcgaggaaaaagaagtcggagaggacggttttcgtaaggaaaccaagcctttttctctgacttcttgctgagcccttttggagcccaacacgcccgaaaggagaacggggacaccccactggtgtgtcgaccggcccttccggcagagactaagaagctgttcttttgagacggcgcaagcgacaaggcgaggccaagcggcgagactcagaaaaaagatcttccttcgccgcagtttcgttgctctctctgagaagaaaacgcgtcaaccgaaagaactcgtttcaacaaagaacattctccgaccttgtctctcaaagctgtcgccgagatgtccaggaggcacaatctcccgaacggctgtgaacgcatgcaagggcagacgcgagagaagggagagagaagcagagaggaagacatcagcaactttcatacagtttcacgaaacgatctctttcgtttgttttttctttgaggcgggcgcggcgtctccagaatgcggagtttctcggagtcgactccggaggaaaacacgacgttaggctccgtcgtcttctgccttgcggtcaaaagtgtgaagatcaagactcgtcactttcttggttgtgaacggaaggaatttcgtaccgtaaaacggcctcctgagtagacatccgcctgaacgtctcttctctctgggggggagaaggcgacgaagctcttctcttctccccctcctttgtcagcgcggtgttctctcttctttcttcgttgttttccttttctcttctcttcttccctttcgcgcttccttcgtcctttattttctgcttgtcttgtctcctttcctctgcatcttctctctcaagagcgcaacaccccttcctgtttccttttgtccgtcgcccttgtgtctcctgcgtctgtacaccccgctctcgtctcttccgtcgcttgaatctctcctgaattcgctgggggtgccccaacaaagattcgacgtcagatctgccctcacgcctctgaaggattttctctcttccctgtcctctgctccatcctcttccctgtcctctccccatacccccctccttttttcgtcgtcgattccaaaa

SEQ ID NO: 3382 - DNA, 3176 bp, Toxoplasma gondii
tcggtcctcatttttgagatttgtaagggagctttaaagcatgacagacaagttctctgcctgcatgcttcgacttcggggcagacgagacgcagatgtcgaacgcagcctggcttcgctggagaacgccatcaggttctgtcagaaaactcgcgcgtgcctagcgacgacaccaagcgcgccgccaagcgcgccgttcttgtcaagttgaaggcgcctttcagtgcgcagtttgtctattttctcggccgcgcagaagatccgtgcctgaacggatctcttgcgggatccgtgtgcgagaaaggcgtgagttccacgttgtcagtgttgagaaaattcgccgacctcccgcaccagacttcagactgttgaggcggcttccgtcgcgcgcgttttcacctgtttgttgaccgtcctggaagaactgctttcgctcagtgatccatgcgcgctgcgcgtcgaaagttggtcagacgcctcaacactccctccatcgaatacgcggaaagcagctttttcttacctgctgctctcggagcagaggcagccgccgcaaacggacgagaggcgctcgacccctgcttttcaggcgttctctggaaggcagagtttttcctgttttcctccttcggttctccttcagagatgtcacagcacataaataccacatacacacacatatatatatatatatatatatattagagagagagagagagacatctaggtcgatgagaagataaacctgtgtaacagagagagaccgaggtgtgtcgtgtgaggttttcttcgtgctccatcgtcacagattctctgcagcggccaaaggctctgttagactctcgccaggccgttctctgaaggtcgagacttctttctttccttgcaagttctctgcagccggtgccactgaattcgagaaacaatctgcctttgaactccccaaacgtacatcctccgttcccttgacttttttgctccagagagattgcacgaggagcatgtggaggtgaccatttgcagagagagacgaacgacatccttcactttgctggaatgttgagttctttttcctctggggagaacggagactcagtgtccaacgatttagaagacatgccgcggatctccgccctttgtgtctgccagtgcgtcaagggtatcacggaggatcgcagacaccctcatgttttgtgttgtgttgcaataccgttattcatggttctccgtctacacgaattcttagcttaaatagatgctgcgttgaaacagccgatcttgaatcggtaaacgaagacctagaagatcgacatccgttgtccacctcgtcgtcctaacaccccgaaattgaaagcctttgtttagcggatccgaaaaatctcgttctctgtttgcatatggtatcgaggacactgagcacctttacaagtctcgcctgggtgcaccgtgtctttcatttcgttgtgcgcttcacacctcgccaaggacatccaagcgcgacgcacgcgcggcgagcgtcgtttgtagatgttcttctgcagcacctgcgcaaaagttcattcttcggccagaaaatgcacctcttccttgcgcgggaattggctgactggggtggttgccgcctgtgcacccatggtttccgtttgtctgcagagacgatcgttttgcatgagttgagaagtcgccactttcgtgtctccatgtgtgttggttctcgcgggactctcggagaatgtgtaaatggagttacagctattcaacggcagctcagtatccaaaacggtggtgtctgcatgtcggtcctcccggctaccttccttccccccgacgtgagacgagcgttggcccaaagaaagttactgcgcttgctccccctcgttgctcagtcgccaggaaacgaaccggtcaaggtgtctcgacctccgtgttgaaagttaagtttctgaactcccgcgctcgctgctttccttggaactaggaaggcttttatcatctctcacgcgtggttgacggccaagggtcgacagaagtggaagctcaaccgtgaaggactcttcttccaacacacaagctgctttctaaccggcacaaagtggacctctgcgttccccaaagcgcggctgtcgctgtctgtaagggagacacaacgaagatatctccggtgtgttcacttttcgttttgtgtcactgaaggggagttctccactaaccgcaccacgcgcttctctctgctgaagtttccacctttcaccaccctttcttttcagcctcgcccgcggtccatgcaacaagcaacgaagttctgtcgaacggcgtctcgcaggacagccggaaatacggcgtcttctgcttcatgaggaaacgcgccctgtggtgcctcaaaaacgacttcgttcttcgtgaggctttccacggagggcacggcggcttctctgtacgagccatccagggtgttgggaaggcttttctcaagtgcgaacgccatcacgtaaaagttctctgtacagcgagccattttggggagactcaatggtcggcaaggctatatagggaagcaaaagggtgaaacggtggcgggagacacgcggcgacttttcttcctgaatctccggatcgatcccccttttctctccattttttctcccgttctcctgccctctccttcttttttccacgtgctcgcgctaggtgccgcgggcagaagaggaaacgctgaggaagaaatgtcctctctgtcgtcgcttccggcctttcgcgagagagagcagctggcaggggcagcgcgaaggcggaggcgagcaagctctggggaggagcgcgtgtgagtgtgttgagtatctttcgcggatgatcgcctttttcagcgtctaaatttttgtcaacaaacttcccgcagctttcgcgcactactagtctgtcttggtttgtggcacactgctctccgcccccaccctccaacatcgaggtcgccgcgcgtaccccacaagcgccgaccgctttcttccctcgcgaaaagcaggcagctcgcgactttctcttttccccagaacttcctttcttcttcgggacttctcttcaacatttacgcctcccgttttgccgattctccggccaggaactccccacttgctcacaagctcgttttcgccgcgtccttcgcactctcttctccagaa

SEQ ID NO: 3383 - DNA, 2013 bp, Toxoplasma gondii
gtgagcatttatttcgagaagttggctgctgcggtatcggtaactcatcctgacagagagtttttgtgccagcgctctacaaagcgaagttttgcctgtaagaaacatgtgcttcccaccagcaagaaagatgcgttaagaaacttgcgcacctgtgccgggagggccatggagtagcagaagtctgttccagttaattagctgcaacggagtccctcagaccagtgcactgcacacagctcggcggcgattgattcaccttgtcattgattctgtggtcggagaagagcatggcggaagaggcgtactggagcagggtttttttcacgttggtgtcgaaatgaagactatcccacaagccatgaaaatcctcattcggcaatggccagtgctgacacgcaggaactgcttcctcctgtccgtcttcttgcatttctgcttctggcctctctgaagagaggtagtataggaccacttggactgtggcgtctatgagtggtacgatgattggtgactcctccatgcacgaccatttggcgcacacagacgtttcgggtagaggaccaacccctacacaggtgcccataggtgattccacatcttccggaagagcgtactccacgttaatttctctgcatgcccgggacaatatggcattttcgacgaggcgaggatcgtggcgtcccagtgcgatagtaaaacccgacgatgccagccacgcgtagccctgttgccgaatctcctctgcgtcgacaagacattcgtcttttatgcacagttcgcaacagagctgagcctttctgccgctttcaaaagggttgttactcctggcctgctcagtctttgaactagtcgtgccgcagctgtcatccacagaacacgagaggtccatatttgcttagtgtagtaaatcgcttactcacgctaaaactgacgtcttcataagcggtcctcggatcgtgcagaggagaaccactcagttcaggactcggagctggataggagtttttgtagtagctgcagatactacacggtgtacagacaccggattaacacagggttggttcacgttcggagtgtaagaggaagatacagaagactttaatgctgagcataaaactcattaatatcttactttgtgaacgcgagttgcaaaactatttccgttcttctcggcggggaatgaagacgcgccaactgattttagttgcctcggttccccattcttgccatgtgcagtcagagcctgtctacatggctacaactcgctaaagattctggagactttgttgctagaactatgctacctgaagcacttctaattcttacccaaaagcatgctaacagcagatggcacgactctctcagcaatcggtccttgcggctgccgcgaaatgcagtgaaggtattttcagcaattggcagcatgtgcagcagaatgttaacccaaatacatttgtctaagcagaagttctgcaaggaacaatcgcggtagacgagtcatcagttccatccgttagcagccaagcgcaagattatcatgctgagatgtcaaacaacacgtctaggcctggggaacatagagtgatctaccacatccagcttgtggggaggcgccacggcaaaaattccaccgtgaaatcaaatcagatacctcgggcaattgaaattcaagatcactttgcgtttttctctgattgggcttgtttgcttgagtgcacccgcgacatacccaactgagaataaaacgcatgcacctacaaatcgacactgccgcgtccgttgcatgctcgctggttgagaggtctttagcggcccactcgacactactgtttgccgctcatttttgaaaaatacgcgtggtcaaaatcttgtcatacgcgtattggattgtgtgaatacttctaccaagaagcagtgtgactgaggctgctgaggtcacacagcacggtacgtgcgtcaacttttccccgccccccgtcaggtatactctctctcatcataagggcaata

SEQ ID NO: 3384 - DNA, 4098 bp, Toxoplasma gondii
ttcattacttcgattctttgaagtgccgcaacacttttagagtgcatccgtctcattttcttctggggcgtgattgcactctttaaatttttccaaaacaaaacggataagcagagttgaatggcctgtcctcttcttcgctcagaaacttcctgtacggggaaggaaggtgcgatacattcgcgggatcctgtgcgtattcgatcacttttaccatgtggccttttccaacataaagcgcgtgtgaaggagcagcagtgcatgatcaaacgttgcttttgatatgtcgcgagtattttgacgcagacggaagagacgttggtgcccctcctctagtggagggcacgacagctcacccttaaaaattcgccttcctgactcacttgtcgagctagtgtactcaggtagcactatgcagaaaacccacatttttcgcaggtcactcagcatcatcatagtacgtgtacgagtaatacaacagcaagggaaccggtaaaggccacggagaggccacctgttccaccatatcattcaaggcgatgctcggacgtcccgcgctgtccgtgatgacgccccgagttgccatgcttgccagtgcatctgtggcctgcctggagaaacctttctgatggaactacagagatcccgataaggcatcgcttcaattgctttgccgctatgggtggctcttcccacgtcattgatgcgggagtccactgaaccagcggctttcctttgttcctcccttcgcaattgaatgacagcatcccgcatgggagcgagacttgagaagatcatcttttgaggaatacacgtcgtgaacgcaaacctagagtccaggggaaatggctcgaggtgagggacgatattgtttgtaccacgtcgcagtagaggcgccttcaggttcggcgattaccaacctagagcgcgagcatcaaactctcctgaccgtcggtggtcacggtggtttttcagggaaccatccgttcagtttatgtattcaacgtactttcaatgacgagcggatatatgtgtggtgacgtgatgcggtgtgtctaagcgacggcactaaaagcacacactagtggcacttctctaatgttcctttcagctcaacggcctcagcgtctccatcctgctgtgagatcatgtgaacgagactgcccgtcgtctctcgaaactctccaagtcgaactacctgattaaaggtcctttccatgcttcacaggagcactcgatgacaaaaaagaacctacctctttcggcttagaacatggaagaagcattggtgggcttcttcgacagatctgtctctatgtctcttctaggaagactccagtgacttcaacagcaaacatacaccctcgtttcgtccatcgaaattgtctctagcctcgccgctatttgatgggctggttccaaaagaagcctcccccctctgagcacacaggagtcatctgagaatgcggcagctacgataacgcagaagacccccattcgacagacaccaccagtcgtccttgtaacgcgagcagacttccgtatttctataggcttctcttagtctgcagcaaatgctgccgcgttcactggatatacctgagaagtgtctcggacgcgactcgataccgcattttgcgtcagtgtcaagtttactgtcaaccgacattgccaagtttgctcgaatgatgtcaagtcccgcatgtgcggaaccaatgcccagctatttcgtgggattgaagcagtgatcctactgaaaccggacgttgacctgatacatcggcttgaaacatgtcatctctgactaatagaaccatcgaaaccattactcggacagcaacttggcatgaccagcggagtagcacgatattctgcaggatggctccgccgaaccgtccgtagacggtcgtcttgaatttacaaccaaatctccaggccgctactcaaattgttgtgccgcatccgtcggctaccgttcaattgcctccagtaaacgtgcgagagcacagaacaagacactgtatctccaatgtaaaacaactacttctagttccctaattattcacggtcgaagcgtactgacgatgctgcagaaacgccgccgttcctagacacggtttatgagagtgcttaatacgaacgcttcactgcaatgtggattgagtactcagtggaagctgcagcgcgaaggatggcatcttctggttttaagaggcagattagtggcccttcaaacctggttccattgatggcaatcgcggcatatcgcctcaaacgtttcagtttcactggtggaggcaagcatgtcgctagcaagaagaaaaacccaaactttctgtgagaacatcgaccatccccatacgtcacgccccccgaaccacgcaggggtaactgcagaggttgtgacgaacttttgtttgcggcaattcatgctacaagcaatttagaacatcgtgtaggcgaagcgaggtagccgactgggtgttcgggctaataattggtgcaaatgaggaaaatttcgagtgctttccccttctgctcggcagcgcgtgccctctattgcaatcagtagatcgcgggagagagtaagtgggagctgtggtgcactgcgacacaaatacacctgtagacagagtcttaacgtaacgaaaaagatagctgattgtagcagcttcttatcgtagggcatcacgctcttcatagagtatgcgtacgtcttgacgccgctcggcgtttctatacagtacttacatagaatgctattcggagtcgtaacgtagacagcataatcgcttgctaaggatacgcaagaaaactcatttgtagtatggtgttaaacggcagcagtcgtggcatttggaggtgataataggaagctcgtctttgcagagttctgcgttgtttttcaatcactgttaccggtgccggcaagttgtgggtcaggaagagggctgacaaaatagtctcgagctttgtcggggctcactctctctgaaatccccgctgcatggtgggcagagtccactggagctgaagccgggaaacactgtaacaagagtgcttgcatggatcaccactgttgaagatgatagcccgcgtactggtttgtaaaataacacgtagcaaccgttaaaggctacgtagacacgggaaattcccatccttttacaccacagacactgtaaagtgtatgcagtggaccaaaggctcttacttacctcgcgctcctcatttatcaggaagtgcgcatggttcaccaagtttgcgtcacacgcggagactgcagaggttacctatgctggtcccctgagttgaaatattacaggaaaatccttgaaagttccacgaagcgcaacacattgtctttgccgtgacacagaacacgccggcgacacccaactgcatggtttccacgagcaatgctatatttttcttctgactcttggaatctctttcggacgcctcgccggtagtttgtgccgctcatcgcttgggagacggcctgaagacagcgtgaaaacaacatcaagggctgtgaccgactttgttcgcgtctctgtggcggccggtcgcatgcttgagcctcagtaaaaaccttggctgcgttgacgagtgggcggcggtccagaggacacgacagcgagctgatggctggcggaataatggtgaattcaaatcgactaaggttagggccccgttttagagtcacatttcctctggatacgctgaagaaagtggaggatttcgcttttctttgtgaggagcgagggaagcgtcatgtctttgttgtttctctaccctgcgagaatcgtttaaccgttcattgtctgcagcccataccgctaccttgtgtcttccaaagccgttggagagtcgtatgttttctctctgcgagttgaatcgttctcgagacacaaaccgctaccccattcccagacgccaaaagaggtggaaaaaacggcaaaatcttcttctgatctctcgttcggcgattgtttgttctgttgtctctacttgcgcttttcatgaggaggagcatcatttgggatctccccgccagtgccagaagacttttcctttgagtcttcagaggcgcca

SEQ ID NO: 3385 - DNA, 1222 bp, Toxoplasma gondii
gaaccaattgcacaccaatacaacgaagatgttgatggcactctggtcctttttgataggcttccatgcacagatacccggatacagtccaaagtcttctcgaaaggggtttcccggatcaaagagacgcatgcctcagctcaggtttcgcaaaactcggtccggtgaagtcgggaacgtgtcttgtcaaccgcaacacgcgtggagggttaggcgtttgattttttcgcagactcacccctcgggtctgtcttcgtctatcatgtcgatccacttttcccacaggtgcgcgatcacctttccgcaggtgaagcaccgaattgggatgatcattctggttagacaagagaggctgacgtacagctgacgcctccagaagtgactctcagtgaatgaatcactattctcagtggatggatcactgtagtcctgtgacaagtagaattttcatccggaaaacacaagtgcaagacaagaaaaagttcagctgtcgaaaagatcgaagtgccagctctgctgcattttccgcgacagcgtggtggacgaccgactgcggcattcaaatatttcacaccgaggatcgagagcgaataacgctacacttattgtggcccttactgttcctgtgttcctggggctttgtgaggccgccacaactcggcaaaacggaagttgagatatggtaaggtgactcgtaaaaacttctctcacgcccacgagtgccgttgactgttaatgtctccggaacaaggcgtgtttccaggggataatcgagactcgagcctgtcataatagccacattcgcgtgactaattggatctgcatgcgcgatttcaaatgaaaaaaacgagtctgagaaacgcgtacctgtggacttgtcggcgaaatgaagaagccgcatcagcaaccttgactcagaaactcgtcgttctgctacgagcactcgcataattataacagctatgcaagcagatactcctcttgatgagaggcgtgccacagccaatctaccttcttcgcggttctcacgaaagcctacgtggccgccttttctccgcatgcctcgtgtacgcatgcatggagacgcatcaaatggtatctcgcactcgtgcaaagccactgttgcctgtggttttttgagttgcatgcagaggcgggggtttgtgctgtttggcggggttgggtatttgccccttcgtttgataagccgacaagcggccca

SEQ ID NO: 3386 - DNA, 3121 bp, Toxoplasma gondii
aagagtgcatgcgctatcggcaatttcggcctacaagtcaccggatcgggcgtccgccgacgcggttgagtgcgggagggcggcccgggcgcgggcatgcgtcacatctgtctcggagccgggagaagaacggagacgctttggttttccccggagacgaaggcgaagaaggccgaagcgtgtgttgggagaacgaagaaggcgaggagcggcgcgaggggaggacagacggcatggctttcgacaccgcgaggaacgccgacggtcggggcggcagccataagtcgaggcgatgtacggggcgaaagcggggaaggcctcgtggcggccggggcagaagctcgacccggggcctggctccgacgcacctcacaggagactctggcacaggcgcaggattgggctccggcgaaagcgaccggggcggcgaggagcaagagctgcgacatgagggcgacgaaaacgagtcggggagagaggatgtgcgagagaaagaagaggaaaaggacggtgatgaacacggcaaactggttgcgtaggcggaggtcgagaatccttctttgtggccttcaaccgaggtgcaaaaggcgtagatagacatacctgcacatatttaactctagatggtctttctttttcagtccaaggcaaagacggagagacggaatacagagacagcgtcgccgcaagtgtgcggagcggacagctgtcgagagaaaagaaccattgtggagtttgatgtgataccaaaaaacagcgtgtctcccagttatcgagtcgtagagttctgtttttggaaacacattgtctgtgtgccatcgtgcaagccgtcagtttcggtgtcaatgaattcgttttcgaacaatgcaattgcttcgccacgcctgagcacagagaaatgtaccggtccagtgtgtgaggaaagccacgcaggtgccgaggggatcctcaaaatgggaactctggagtgtgggtccgcagttgtttgtttgggctgcaggccacaagtgaaatttcgttttacatgagagcaactcactctttgtctgttttcattctcttggcggttgctcttcgcttctcaatgtggtatgcaactgtttgttgcgaacccttgcaccacgcctctaaaaacacgctcgacagtggaatacgctcttaagtctgaaaaaacaatctgggcaactattgacgtccttccgcgtcgattgctctgcacaccgccgtagctgtgtctttttgcggcgtgtacatttcgccattcgttgacgatggatggctagaacgaagaaacgtcgaaccattgaaagacacgcgccctccagtgagaggcttgtacgagactattacgttccccttgtccgcacttcactgtctacaacacgaaagcgcgaaaccgaagccgttgacctcgaaaattgaatttaaatcaacacagcccatctatacaccctctaaacctttgctttactaaaaggcccaggcggacacaaacgttacaaattcagatccttcgggactcctgccacatagtgtaggccatctgttttcaatgcaagtgccctatgaagccgtgtctgagcatccttagtccttacgatcgtcacgaaaaacccagtcgaacgtaattctgccagccaaggacgtcaggatctataccagtgctccaactcgtataaacaggtatgaggagtggttgatcgaaaggaattgggaacaagcggcacaaaagggtgaaacgtggatgccgatgctgacgcgcgacgtccttcctgtccgccaaacaccgctctctggtgctgttcagtgcacgagacaactcccgacgaaaatatccagcacacctgctaaagaagatggctatccaaagagatgatacacaatctcttagaagtgttcagatagtgtgagcagagtcaccattgggcgcgtcgcgttcaccaaaataaaactctccgtttgtcgatcacggtgttcgagaatatcggatacgcagtggaagacaggcaagtaagggtatggagtggattttttaatgagggcagaagttgtgcgcgcaaagattatgaaattggattgagagtcctcgtgtgcatggtcgagagaatacaggctgggcagtggagacgacgcatcataaactgcaaaagcaaagtgaacactgtctgtctcaacaacgaaaactgtcggcttacatacatgagcgtgaagttgtgcggcggaccgaaaaaacacaagagcattcgctgtattcattcagccactgtcgggcaacagacgtcgaccctaaaacctattcccaaacacatactgactgatgcttatggtgctctagatggattcataagcgaatgttgtgaactccaaatcgtgacttggcaattgtgcttgactgtccggagatgcaaggagtctacaggcctcgttttcatgaataatgctaccgaggaactccctcgcctctacagcgtcgctttcaaaatatgccaccaccaaattttggtggctggaatgaatggctagccacttgatgctgcacgcgttgtgcatctgccaatgctttccaactcctcttcaagtaaatttgggggcgaaataagaagcatagtgtgtcttctgaaacaagtgttgaaagataacagggcttctttggcgttgttcttcacgcttggacgaatcggttctaatctctcgcccgcctcgtggtcacccggttttaaccgcgaatctgtgacagctgcttccgtgtcaggacaaactcacgggggctaattgcagcctggcacgagcgtttttttcttgcatccccaaaacgttcagaacgaggctccgcctctcctccttccgttgtatagtgtcttttcgtgtacggtttccgcgaaacagggaatcgcgagacgaattgatgtgcatagattaaggttcaccaccctcatgggacgcaagcggggagtataacttccgaatccattttgttgaaattgtagaaacgcactttcccttaatgccttggatgtcccgtttggccaccgactgtctctttttctgtgaaacgggaggcgcatcaagagacggtgggggcatgatgtactgacggaacagaaggaacgtctcggctcaa

SEQ ID NO: 3387 - DNA, 2692 bp, Toxoplasma gondii
cgagttgccgacggttcggtagaaggtggattttgaacaaccgttttgtgagtgtggggaagcctccggagtcgcgaagaaacgcgcagttggggaccttctgaaagctcatcccaaggccagccgtgtggatatacgactgaccagaatctgccgtgctcgtggccttggtgaccagcaggttgacggacagcatggctgtctaacagcgtgttccgggaaagggttcggctaacaccatgagccatatacgctgcaggtagacacgtagaagcagagtaagccactgaaaatgcaaccaatcgatctgatgtcgtggtttctgagctagtaagcacgacgaccccgatactaagagccctctcgaggtgcacagcgtgccgcccatgctgtgttttctgaacacattgcgtgaaaaaacgtgatttgatttatacaggagaacagtcatggattagtggaaaaggaagaagttgagactccaagtgtgcgataacgcctgtgcagtaaaccgcaagggcctccggcgctttaccatcatgcactgcgatacaagagacgtgactgaagagacagacgccattctcgaatgtttacagctctatctagtacgtccgccagtcatgaaacgatcacctgacgaaaagaacaaaggaggaaaggaaggaagttgcgggacggccacgtgattgcgtaggactagcacaagacaacgtacatgaatggtcaacccaaaatacatctgtacgagtcactccattgatgtgaaaactccaacaaactcacttggaagacatgaagcggagaagggggaagtggagacgaggaattcgatggtgacgagtagaagagtgaccgctgaaggcaggtctcttcgaaatttcgactctccggccattggcacatgatcagtcacaagcactgatgccacaggtagaccatttttgagcaaagccttccccacaatgcccatgtggcctgtgctagcacagttgaaaatgagaaactccgcacttgacgctaatacatcaaaggcaccgtaagttttcttcactacatgacgcccagcttcttcagcaaacacgcacagctgtcagggctcggcccttggttgccacaggagcgactctaaccatctttaacttccactggccgagtttcgccgcagttcaagtcaccacttcccccaaacgcgaagccgcttaattattttctaagcctcctcaaaatagtgccttcagccccagtatgtgtctggacaagacaccaaccctcaactcaatgtggcaaactagaatatgccgaatctgagaggcgagacaagcgtgccgacatgaatccggctcagttcacgaatttcctgggagcagcaacagacacggtacaattacgcttctcttcacgaaacgaccctgaaccctggcgagagaggcaatcgtccccgcgaacactaccttattagctggcagcgtaagctagagcggtactgaaagaggttcgcgtcgcatgcttctctacgttgggccggctggaaccagccaaggtgaccgccacacgcgcggacaagacatccgcctgaggcaaagagcgttgaccaatcccgtgtgtcgcaaggttgacgggtgtccgccgtcgatgctcgcttcctgtaagaaaatggcagcaaaaggaaaccaccattcgagtgccgcttctgttctacccctttgtttaactagctcctttctgcatgtattagctgtggtaacgcacagcacggggcgccgcattttccccaggaagaggcatttgcccggatgctgccaggattgcgtccggacgggtgcatgaccatccaggaccaagcagttcatactttcagtagaattctatttgtactgcaaattccacccaaaatatgaaacttgcgatcgaatttgcctaatggtgaagtgatagctccggtgtttctaagaccacgacccgtctatacagcgagcgctgtgcaatccttcgggcacgccatggtgccgtttcatttgaagttgcctccttttaaatgcagcatctcggacaagcactcacggtttgagattcggaaaaggattggactttctgcgacgtacggctacacaggtggcagaaaccgccctcgcttgcagtgtgttggtgtcttcatgtggcgatcgtggtggtcgctggcatatcttcaccccgatttcgcaaatgtgtcgccgaaggacacgaaggtaaggtctcttgcacctgttgaaggtagtttctctttccatgctccgacagatgcaaaggcacccacatggctgcatcaccggttgtccgcacactcccgtgttcgtgtccagcgtgcttccgatggacgaatcaactagcggatgccgttttgcccctctgatcaggaagaaaggcagaccgcaccttcaagtgaccaagagcctttcctggtatgcagtttcgcggctggctcttgctgttcgatacatgcctgttttcggctcttgtctggttttccgttagcaggacaacccctctggatcgcaagccaacgctgatgcttgttttgagacaacgagttgcagttaactagaccgctgatgtttttcccttgataactgcaaactcgaaaatcactttgtcgctctgaagaagcctgtagtcgtcgctgtccaggaagtccaaggcttaacatcatcga

SEQ ID NO: 3388 - DNA, 1831 bp, Toxoplasma gondii
ggcgctggatgtcgatgcacttacaagatacagatgtctgctttttcttctgtgaatgctgtacaccatcccgctcgaccctctgtctgcacacagctttgtgctcccatgttgccaggcaatgcacccgttgatgcaaacgcaagaagaaatgataacggagatatctaacctaagaagaaacggtgacggaggtatctgacctaagaagaaacgatggaggaggcatccattctgggttgagagtacagcgaatacacaacatggacagcatactccacagcagaacacactctttcttgtaatgctgcaaatgccctgaaagtgcttaggtgttaggaactccttacgtacaccaacaacagagccccgtgaactccattagcagtgggcgcgtggaactgtggtatataggaggccgcttgctgttttgctgaccttttcagctccgcggctctcaaaggaatgtgtctgagttacaagttcttacatgcaagtccactttcgcacgctgcatcaaacagtgtctgttctggatgtcttcctggtgactagaggatcgacggccaattgttaacatacgaatgaccgctccacgactgcaagcaaggggggtggtgtaacgaaagaaacgaaagctcagagaggaggctcaagcaccctatggaactcgaagataaacgacgaagcaacttgtttcgcacggcacacggacgggtgccagatgggaaaagtggcagctctctgcgtacgaacagcaacagagaattcgcaggacctgcttttctcaaccacgttgagggtcaacaccaggagagcccccatcgctttgcacgtctcccaatgcctgcccgtatgggtaaaaggctttcacagaaaagctgcgtccaacagactgaacctgcaaggactgcaacgaagactgagtgacgaaaacactatatatacacatatggatacatttagtaggatatgttcctcgcagctgagctaataagctatatttcttgagtgggtccccgattttgatttgcatctttacatcgcacctcatatagcatgcacaagaataatacgtaaacatgcaaactatatatgtatatatattatgcgtatccatggacacgtatacaggcttcactagttgggtcaacggcggcgtgcctgcaaatacatatatgcggccatctgtgtgctcacggatgtcaagatcttgctttccgtcaccagacatttgcatgtatagttattaccattatatgcgttgtaggttggagttccctttccttcttcaggtggactgaatccaacgcgggaaaccagtgcatgcatgcatggagctcgtgacgtcccgtctcgtgcttcgttttgaaggtttcccgcagaaactcgaacagtcgatatcacatttttttgctttcacatgttgaagcgaagaatgtgaatccaggtccattttttgcgcttgaagctgatgtattaacccgaagtttcgggctcgaccttcccgttgtcgcctaggttgctgttcccctcgcggggcgttcccgtttgttttttgtcttgtcgctgtgtctttgtctctttggcacaccgttttctcttctccatcttgtctccttcatccccaaacctcgtgttttcgccggagtcctgcctagctttctccgcaagtcgcggcaagaccctgcgttctttgagtcgagtgttcagccggtgtccagtcgcgaagttgttttttaagattcccgttccatctttgcccctttctctttgtcgcgcctgtcgctccggtcttttctttccgtgcgagaaattcggcggagccaaa

SEQ ID NO: 3389 - DNA, 1887 bp, Toxoplasma gondii
atcgtgcaagtgtgtgtaaacacctaagcggcgaataaagctgttggatttgggcgcgagcgtcgaccatgacgaagcagaattgtcacagaatggggaatcagtctgcatcttacacgaaggattgtcgctcttatcgttgacaagatatgctgtttttttgtctgaggaactgaaacacaggcgactcagacgagggcgctcgttatgcgtgttcctcgtacgtagagcagtcaagctttgtcgtcatggcagtggcttactgctgagataaaagaagactgtatgcagatattattgacagacaccggctgtaggcgaacatgtttaccaaaggctgccctggtgcaggcccccttccatctttttcctcgagtgaagttatgctgcgtagtcacagtatgcgctgacgtcttcaattgctgcagagggatgattgtacaaacggcggcttcctccgctgaaaagtgcatagcatgcgctgtcgacaaactattgtgaagtgcccgtaagcgttcgttatgccaatcgattctttccgcgctctgtagagctaatgacgaatgtgtggtataatgcgtcagccggacagaggtcgcactgtgcaaacaaacatctccggccggattgaactgtgctacaacactctaacgggttcagctgtggcatcgagtcgcccaatggcttcctgttggcaatgctcatcgctttaaaagacgtgtgatggcgtgaaccaacatcaacaaatcagttcgaatccagcaattgtacagttgcatttacagttgttgccaccaactggttctaacgcttttttgaagctatgaaagaggcgcagctttccccttagaagacaacggctgtatgcaaaagctcaacttgaaacctggagtacgagttggaaggaccacagacatgtagcgtctgctcaccccagctgtttccacgaaggcatagctacagtggtctggcaccgaacaaaacacatgacacgagcacaacagaaatagggaaattaagactgtccttcaagccgaaggtcaaagcagcgtcacctgcggtgaaactacagcgaccttaggagtgtaagactaccccacagaactctgttgcttgactgacagttacacatggatatgtgcagcaataataaatgcactattacacgccagatatggtgcgcacagaaagcgtccaacacgcagagttaaaacagcaccggcataccacgttccggttccatcttggtactcgtccgcgtgtgcccttgatacgactgaatgagaattgcagcgcaaggcctctttaccggtgaatgtgctgttcccctgtgcctagaaaatggatagtaaatcatttgatcaactacactgcctattgcgttcggccgatggccagccggctggaacgacaagtgaagtgcttgtgacggcttaccggtttctacagtgaccgtgacttcagctatcagaggcgctcagctacctttgatcgcaggctgtaacccacaaaataaactggttcatgcgtgtagtacggccttatgttcatttgtcgtgaacgcgaattccgatttgctgcatttcaagcgtgtgttgtcaaccaaaagggcagggaccccgcaacgtacatcgcggtagcctcgcgtcatgccacgggatgaccctcccccaagaattttcttttgcagtcccgctactaacgttccgtctccgagatttgttttggagcagagatcgaggaggaactaaagaaccgagtgatcatgacgatgagttgctcaaccaagctgagtgccgtttgataaaaggcggacgcctgcatttgctggacacgtactccggtcagttcgcgcgtttccggtagacagtgacttccgtttctgta

SEQ ID NO: 3390 - DNA, 3446 bp, Toxoplasma gondii
ggccaagggaatgcgggacttggattcgttgccatgctcagaagctggaggaggcgcgagagaggctccggaagctgaagatgtctctgtgggtgcgagagtgcgagaggccgtggatgctgaggtcgctgttggagtgcctgagggaggtgaaaaagctgaggaagaaacgctaaagcgaaaggaagtcgaagcgggaagacaacagactcaaagcaaagcaaacggaggagacacacagcaaggcggaaatcaagaaatgatgagttacgaagactacctcgcaatgattcaaggcgtcgatgagagacaactaactccgcagcagttagcggagtggagaaactaccgaactcagtgtgaggcgttcttcgcctaccagcggcagtacgctcagtggcagccacaggcgtaggcgacggacgagaagagaaaaagtgaagcggaaaccgagaggagaacgggagtagggaggagagcaagcaggaaagcgaggcttgaagaaagaacttgacaagggagaagacggaacgccgatgatagggggaaggagagatcgtgggggggggggaccgcaggtgcgaagcatgcggggagaaacgacgacgagagaggcaagattgaagagagagaaatgtgcagcgggacagagaaaacgagtaccgcgagggtggactgatcgaacagctgaggaagaaaaattggtaaatttgttgaacactttgctgtcccgagggaaatccaccgtggaaaaggtgggcaagggcgagaggtcagaagcagagcatgagcagtcggaagcggtgaaaagaagaggcagacgagaaaggagaagaaactcatctttgtgacgaaacgaacacacggggaaggggaccggggatttaaaaagtatcgttgtggtaacaacgttttccgcaaattctggccttcaactccctttagctctttgctgtgtgagcgttactgcctcgatctggaagtggaacagtagagtagggtgggcattgggttagagcaaggcaaaaacgcgaagcaatataacgtggacaagagacgccttgctgacctcagacacaaacgctcgaatttgccaacgggcaaggacccacgcttgcctcgatacattgcgtgcagaaaataatgaagtttactttttccatctggttcgcgtcttgttgaagtcgccttttcgcccgcttccgtcttcgtcaaccacgccggacagcgacctagcaaacagaaatcgccatgaaatacacaactgacaaattctgccttgcgcatcggatctgttccaccagccaaccacaacactcactgttttgttgcatgttcccgcattggattggttcttcgaggaatccagagcgacagagtgtgacgcaccctagaccgaacgatgcagccggaaagcacgagacacttgagagagactgagcgaggaacggaggagccgaataggtgcagttttttttatgcagatccagcagagcttaattttcttgtactactctttggacacgagaatttgtcttgtctcagcaaatgaatgtgtgtgtgtgtgcggactgacgagggactgaggagactcttttctggtagcctcaactgagaaaaccgtccccttttgtgtcgcttcttccccccgctttagtgaagtgatccagcgttatcgaaagattggcacacacatgtgcagcgaagcgacagagtagaacaacgaaagacgcatgccattctcgaggaaactggacgcaaaatgtgggagcggagttctacactgtccttatcgtctttaggctctgaagtaacaaacgtgaggtgccgtttggaacatttgtttttcactcgtaatctccctctacgcggcttcatcacgctaatgtctgaccctttttcctcatgattgctattgtttgctggatgcgtttcagtcacaacatagacgcgtgcttcttggcagaaccccatggaatatcgcaatctgcgattcgcctgtgagtcgttcgagtcactggaagagacggactgcactcgttagaatatctgagaagtcgaacgctcaacgggacactcagacactgcgagcggaaggaggctacaaatgcggatatcatcgtgtttacacagcttctatacgaacgttcggttttcgaccgctggatattgatacacttaatgcactcaacgtgatggtgtgttccatctcgaacaatctttccctaatgtatggaatggtacgtagctgtgcaaggctaacacatatggatcagcttgggagagcatgatttcaccgaagcgtgactttcatgtaaggatccaggtagctctggcgctacaattcgatgtgcctttactgttttgggccaaaacctgcccccacccccgcgtaaaaagaaagaatgtgaggcatcatttcgaaaaactctgtatagaggggaacctgtctcaacagtgcactccgttttaaaaatccgagtgcgctgcacgggatccagcgtctgttgtcgttcacatgcaaaaggaatttctcacagcctttggtgtaacagcagatcagcagccacttcacagcagctgcagccgccaaaagaagagagcgaacatgtttgtggcgtgtctgtcttccttctgcggtagatcggcacagtaccagtgagaaaaaagtcgggtgaagtgcgaaggtaaactagaaacgagaactcgatgtcggctcggctctgggctgcagcgcccctaatttttgatggatagagggaacgggttgccagtacggaggtgaagaatggtcggccgaactatgaggggcagttcttgatacccgcagactcaggatagctatgagccccccgaccttgctacgttttaggcccagtgctgcctcaatccgccttgctgccatccttggtgcggcggcaagacacgttcgtccgcttcccggcagcgagggtacaatttcctttctgttcgcgcagcatctatccacagaagtcatacacaccccgagtttgacaggaatttcgctgcttttctggacaaacaggaaaccggtgactccgagccgccaaaggctgttcatattttcctctcttggaggttggtggcgcccgaatcgcagaaagaccgagccacagtgaagggtgttgtctggcaagccttaaagatccttggcgttgaggtccattgcccttctgaaagcgtccaaaaagcaactcttgctattcctttgagttgcacaagtgtaaaacgttgcctggattgccgtcgcgtcgaagaacaaacccgtagtctatagttccgtgtctcgctgtctccgccagtgcgtgtggccgccgcggcttacagtctttccgcgagttccgtcgttccccaggctcgagtcacttttcctccagtgaacaacgccgttttttgccaaaccgacacaacaacgctgacagcta

SEQ ID NO: 3391 - DNA, 1305 bp, Toxoplasma gondii
gaaaaagcgttcaacgggctcgagcctcagtcttggcaagttgcactcaagagcttttccggtgtgtaaccatagactcttcctctcactgtggcgttgcgttgaattcgaaagcgacaaagagtgcaggacggcttcagaaagtgaaccgccgacttgcgggaagaactccgctgcctacagaatcgctgcgatgttctccatctaccgcatgctggccacacaagtggagaagcaacagcagatgtgcattcacatatacaccggtgacatcatatctgtatacagtattacacacgtattatatttatacatatatgtatatatatatatatatatatgagaaagagacagcgagacagcaaagcatacatatatatacacatatatgcatgtatacgtttttatgttggtagaggaggaacctgtgcgatccgtgactcttttcattgcagtgaactcgagtcttctttcagactccattgaaactcggagagggtgggtcgcatatatatgtttgggagatcgattgatctgatttaattgttcgaaacgcttgagttcgatgaggagacttcaccctctttcagcatttcaatctccagagtgaaaaactgagttcagcagtagctctgacttctcgcagaagtccctctcagggcaagacccccctcgatcggccggagtgtgcggaactcgctgaagtctgcgagttcttcgtccaggacttcacgcgcaggcaggaagtcaaaagctttgaaaagctcgagtcgaccaaggaaagacaaagaaatcgaaggaaattaaaagaaatcaaaaggacttcgaggagttctctgtgcggaccagacaccaagttcaagctagcgagtgtcggagacatcgacttcgcagtggtcgtgcatgcacaacgagaaaagcagcactgcagcgactttctctctcccgaaaggttctttttttttaaaaaaaaagcagcaaaacagtcctttctgcgtcttttaaaggtgcacgaaaaacgagctcgggagtctcatgcttcgcctgttttctggagtcccggttccggggcgtcagggtgtttatttgaggaggcaagagactctgtcgaagacctcgcagagagtccaaccgttccaatcttcacgtcgcttgctgagtttctctcccaggtttcctcgctttcagaaggcttcctgaaatccttcaaatccacgcggaggaaaacacgcaaaccaacggccgtcgaacactgcggtgtacagacaccggcttcttcgcgtctaccacacttcttcggcaaaa

SEQ ID NO: 3392 - DNA, 1830 bp, Toxoplasma gondii
cggaaagatgctttgtctgcgttactggagctagatgatttgttgttcactctattggctggactgcgtcaaaatgacctcctgattctggtttctccttgcggcaacgcagcccgctatcttagcctcgcggcgctgcgatcagcattgtcgtccggcttgggagggacacagaggtcgaatcctgcagaagcagaagtgcgtcacgggtcatctgtgagcgacggaaccaacagtgacgggagcccttcacatccgtacggcaagatgtgtactggcgcatgtgaggccacgcagacgacgcttcttcagtcccaggcgattgatcaagagtttttgactgagcagcgggcacccgtaaaaacttcgacagcgctagagtctgtatatcagctggacaacgccttccctgatatcaactcaagtggtaatggcactttccctgagcttacgtggacctcttcaatggaaagagaactcgaaaaagcacgtggtgagtttcagggccctggtgggggcccttggataggcttttacatacggccaggtgtgggtgtatgagagtagttgttttcagtgagcgccgtgtaggcgcacactgtagaatgtgctgtgaaggttgccacaatttcttgtgaaagcgaagagccggaggtagagtctggaagccccttcttcgataattcccattcgttccattttcgcaagtcggttactatgcctaccagtcaactgagtgtccgaacactcatgcagttaccgtcactgtgcactgtacactcgagtggcaacagcaaaaaaactcgtgcagctgttaaattgcacactaacattatactctgtcatactgagagtcctatgtcataggcactcttgttaccgtgtggtcaacgttgtggacggtctccttcgagacgcagtcgtacccaacctcttcgtactgtcgccgtatcttttgctggcaaaatatatcggcagacgccggccccattcgagtgcatctacagcatggtcccctttgctaatacgagcacacaagtagttgccatgtgtctatacatgaaattgacctgtacacaggaacagccactgctttgtcaacggacacgtaaattaaatggtgccgctgcgtttttatgaacgtctgcccaatagctgtaggctcagaaacaaagtgcttccatgaaatctaccctcgtcgcgtgaaggcaagtatgcgaagaagttacttacgacaggtatcaccaggcgtctctcgtgtgatagtttgcttcacgccgaccaggcaccggaggcaacaccacatttccagtcaaaagaacgtcgagtaagcgactgcggttaatcggtccttccacaaatggattcttcgatgcagagcgtgactgtacaaccgcccatgttgaatcaaggcggaacaaccagcagcagggagacgcgtcgctttccccaaacgtaccagcgtacggtttagtgtcacttcgcgacatcgtagcggccacttgaaggtaagtacgtcttagaagtgcaacgcaaataatttgatgtgattcgaagtcacttaaaaattcgtctctctgcggaacatttctggaataatctggctttcaaccaaaaacctcgtagtaaaggcgtgtggcatcccacggctgggacactaaagggaacccatgttcgcctgtggaggccattttggaggtttgtggggagaaacgtttttcgtgttgcctgtttcaagctggcgattgtagtcgccttttgaacttcgggcgtattcaattatgtcatgcggtgaaccgcgttagcgctaacgttttgcaacgggcccaa

SEQ ID NO: 3393 - DNA, 4419 bp, Toxoplasma gondii
agcgtgaaagctctttcaatttccataaattgtgtaagcagtccagttgagtggtagtattcagcagtcacaacgaacgtccttgtctgtatctcttcactggagctatttgcagaatgacccagatagtgtattgtctctgtttattagaattgagcagtagagttctgtatcgaacatcatttgtacaggaactgtacctgcttttaatgacccctcccacgcatcgcatggtacgaatagcgtagtacctgattattaacttctcatgcacgggacaacggttggccaaaaaaggatgcgcaccagccggaaacaaccttatccagcatctcaaagcgtgttttaacggtttctctagacggacacagcgccacatattttaccgctctggaggagtcagcacgaattgcatcggccgtcgtcaagcgtgccctaggtcttttcaggaaggcattacacatgatgaaagtacgaggacgccgagaaatcggacgtactgaagacgagcggaatgaatctagtggtgtttttgactaaacgggccctatggtggcgatgttctttgcacaaccggacaaacgagagtacacgtcactccccccggactgtgtacctggagtagtatccgtcccttttccgttagcgatctcgcctgagcacgagaagcccaaacactgcgtaagaaaacacacaatttttgaaaaaaaccggtaagcagactgagcacggacaatcaattcgtgccatgcaccggcggagccggtacgtctagcatagacgcaccacgccttgtcgacacaaaggcacggtgtctggagaaacatacagcccgcctgttaccgaagaaacgtacatgccaccgagcggaacagctgacgggcactccctgaaaaaactgcaaacacgtgcaatctacgctgacctgtcaaaatcgcttctgtcggctcgattcagcggggtaagaaggagccacgagttcatctaaagtgcacgtataaccgtagtgggaataaatcggccggcatttccagtctgctatcttgtaagggtagagtactacattttggctgcccgttcctgcaccgtgaacctgccctgactcagacataagcagtgatagcaccacaacaaaagagtggtaggggcaaagaagccgacaattggaaatcagtattagttcgaagacaatactgcaacagcggatagagtgcacccaaagaagggattcagtgtccccctgttgtacaaaggggtccactgttacacgcgtgcgaagaggacattcatagcagcaggtcttgagtttgcggccttaagcatagatgacgcgccgaatgctggagggttttctctctgcagtctgctatcctgctaattatgtttccccatctcaatcggccagccagctcatcgatagaaactgtccacaaaaggcagtcgcattaagcctcagctatgacgctcctgcgtgcaactaatgcgttcgggattgacaaatgaaggaccaggaacttacagaaagaagaagaaaaagatagatcctcgctgcgaaagtaaaccggccccccggcgcgtgcagcctggcaccctgtttccaatggggcattgttgaaaacaccgacgcaaccggagaaatcatccttgccccgatgctaaaaggtgatccttcctatgctcgccacacacaaacatgtgacggccaataccttcagtgcaatgtaccaccgagcaagaggaaaagctggacgcaacaggctagagaccagtgggttcttcgtggcgacaagatgactggccagtgcgaccacttgacacttcgattgtagatggtacaggcagatgcccgggtacaaataaacggtcaagcatggaacagtgttttcagatgttaattgagaatcaaatgaaattccgaaggcaactacgcggcgccgaaaattctgggaaaactggcatcgtgtgacgcaggcgcgcttgactcacgcttgattagcccgatcccttgtgaaactcccgaacggcggacccctggataaatgaaaaatggtaaggatttccataacctcgggtgaattgcaacaatgcgcaaaaacacgagtgaaacactgtggatattgcaccgtgatatccatactgggtacattgcaggttcactagcgttagtaaccgtccgcagcacaccgcagcgctgggttcctccgatcgtagtgtgcggtgcctccggattagttgacgtggattagacagaaaacgtaagcaaacaggaactgcttgtgaactgaaagtagctatcaggaacagctggcgacccactaaacgcacctgctctgggtgggacgccaaacacacgacgacggcggcgtgtagtatgtgccgtgtccgttcctccgcctgatgcgcaacaccgtcagccaattacggagatgagcaatagtccttttcttacgatttctgtcaccatagcttagaccgaagtcctaaaccatcgttgggagtgtgtgtgtctcccggagcatttgtttcaaacgagcgcggggggacatgtacggtattctgagaagagttcggggttttacactgggcgctaaacacgggtacagatgcgcctcgccctcgggttcgaagacaccatcggccgttaaaaaaccgtcaccacgcagaaacgttccagtattttgactgtgccagaagagtatctgacgtcgattttgcggtcgtaggttcgcttccgccgacattccatgcagttataaaagcgtcgcgcaccctgcgtcccccctctgtatgccattggactgtcctccattatcgatttactcttacgaggcaaagatcataagtggacacttgatggccaacactttccatgcccactggaacgaaaaaactggcttcttcgagtatctgggcagacgattatgactagcttcatcgatacaccgtcactgtatgcgagcggctgtttgccggaatcgccggagtttcttcctgaggtcgcctataaggaacctgaagcgagtttccaccaacagttagtggagtaccatttcacgtaacaatagtttctatcgtcgatgctggctgtggaaagagactgtatgtaccaacacgttagcggcggcaaatacgacgtggcggttccacattgctgaatttctttgtggacatttgctgaacgcagctgtggtaagactagataatccttggtatctcatgaagatccccgatttcatgctaccccacaatcgctagatttgagcgaagccatcggctgtcaggctcctcaaaatgtgtcttacgcacgcgtctcacttcatcggtccgggggaaggcgatacagtcgtggcgcgaactattgaactattcgtcactacgcacctacctacacaacgacgcctcaaccgcttctgcacggcatgtcacagtgaactggtacatggaaagtccaccgttaaggaatacattctggcacccttgaacttttctgaagtttaaggcgacgacctagtggcgttgtagctcgatttcagggctagtacgtggaaggggaccgagggcgtcgagagacacacggtgttagcacacattgcttctgtgggttttcctccatatctttttggttgcacagtttttaatgttgcgcacaaaaccaatggaaccttcagtttcgtattttcctggtacgtgtgtgaggaagtgacctgcatgagactttacggggtgccagcaaagcgggcgtggatcgctggcggcgctacccacagtcgtcgaggcactttcagcgttaatcgaagtgtgtggtcggtcgtgaaaaagagacgaacagcagcaagaggttcagcgtggcggtatcgtgcaaaatcgttctccctcacctgttgttccccggctttcagcgctagtgagcaggtcacttctgcgggaagagaagtggtccgaaagacttttgttgtgtggtacgtgtgcagagtgctttggctctgtcttagaagagcgctgctcctgtcgaggattccccgttccgtgtctctggaatcttccgcacacacatgcttccgactgtggtaagcgcttttttgggaggttgctcacttttggcgtagcacttgcgagttctccgaccagactgcttgcaagcaacacttccatcctctgtgcgcccgtctattctcttcgcgtttactgtataaagggatatgcaaaccgtgtttgtgagagttttctaggtaggggtagtttacgtgtcttcattggacagcgtttttttgaacgctgcgctcgagggacgaacgggacttcagtcgcaggcgtcagtctttcaacgcggtcctttattgtgcaagcacgtttcaagcactttcgattctgggattcccccgtttcgcattgccgccttccgtcttccaccacacacca

SEQ ID NO: 3394 - DNA, 1960 bp, Toxoplasma gondii
agatgctccgacgaaacaaggagactccgcatctcttgatatgacggaggaggagactcaatcacacagagagtgaggactgggcaaagggagcagctcccactgtccagacaccgacgcgagcaagggaagacgaccggccttcccctcacaaaaacacacgagcaccagccggtgttaactccgaagaaaactggttcgtttatggccgctacttcgacatgacatttcgccatcgcagaggcgccttgcctctcgatccgccgacgcagagaaaatgtgaaggagaagaagaaggaagccgataaggcgacgaaggagaacacgaaggagaacaagacgaaggatgcggggaacgcgagtgatagcagggacgggaggaaggaagagaacagtttggcgtaccctcgatcagctgcgcgcgcagcttggccagtttcgccttcaagagccccaagtgaaagtttgtcgccttgtttttctgcgttctggcgatctccgcctccacctccgcgatcctctgcagcaccgacatcttgtctaccgcagcgagggagaccacttggaaacaattggaagactgcggaacgaagagagagaaaatggtgggggggactaaaaaggaaacgagggacgaagagaaaagagagaacgagggaagaggagagaaaagagagaacgagggaagagcagagaaaagagagaacgagggaagaggagagaaaagagaaaacgagaggggaagcaacgagagacacggaggaggacggcagattgaggggagggcacactagggagaaaggcgaggccgttgaccggcgacgatcgtgaagaagattccgggggagacgcagagagaaaggaaatccccaaactcccgcgaagagacaagaaaagcagcctttcccgcgcctcctctcccctggtctccgtcgcagatgcgcagcctgcggttgctctcagtgaagaaggcgacgcagcgaaaggcgcggtgcctctgcttgtttttgaagaagagtccgcagaaggaaggaaaacaaagagatgcaggagacagagaggcgaaaaacaacagccagaaggaaggcgcaacgacgccgcgcgcaggcgcatgcagttcgcaaacactgccgcatgtgcttccccaaaatgagagcgtagaggcccagagacagaacgaaggcgaagacgacggtcgctgcggtgtctccggggtaggagacagcgagagcgcgtacacgagaggagagaagacgaggaactggagaaggagaagtcagcaacaatgcttgtgttctttttctgtttcaggaaacgagaaacctgcgttttggccaacagagaggcggagcctccacgtcgaggaaggcggagagaagaagagcaggagggagggtgaagacgccccggacagaagggaagaagcagacgcgaggaaacgcgctgttgttcgactgtctcaggagagagtgtgtctcctgctttttcgtgtctcttcgctaggcggacgaagaaagtaatgaagaatccgaacagagaagagacagagagagagaacgatcggggagactgtgcgctgacttttgggtggaagtgtcttgtcagatagcgaaacagcagtccctcgggcgaccgttcttcgtctccttcgcgttctcgcgtttcttcttgttctttgtttcgctgtctgcttgtttattctcctcacttcttctccacgtttcttctctctcgctctcttgcctgcgatttctctctctccctcccttcaccgttggtggagaggaggacctcgacgcgtcggatctctgttctctctccgcagcgagacatgaccttttgtcgccgaagcctccaaggtttttatagaggcacacaagcgggagcggaaatgcatttggatcggttgtccagagtagtcgttcagctggattcggcgcgttctctgctgtcgaaacca

SEQ ID NO: 3395 - DNA, 2165 bp, Toxoplasma gondii
agttgaaagcgttcaaagcttcccaagtatcataggcaaaacgtcgcctttcccggtctttctgctgcggcttgtgagacaggcattcgcgagcaactttttggggactcgagagtttcagctggctggcgagacactggatgcttataaagctggcgaccccgaagcgttgcaggctgcgctcgaaaaccaaatgtggaatttccttccgactgaaatcgttaaaatggcccgcgatctgaaatctgtttgccgtggagcccagttccaaggcagagcctcttcgagttgtgggagcgtttcgggtccggtttctcaagtgcgtgcgtcgtccagtgtggttcctgtctcctctagactggacctgacacgcgacgtgcgtcccgtcttgggatgcttctcgtcctcgggggtaaaattgtccgactgtccaaacgtagaaggtgggcgtcagagcgtcttgaagccaccagcagtccagacaagcaccgatagtacctctcaggtgcggccgaatgcggaggccgcagacgtttctataaatgagcttctttgctgaaaaaggaaacttcaagaacacacgttactcgaagaagagttttgatggcggaaactacgattcctgaatgtcgtgctgttcaaaccacggcctagctcgtcaagtttgcgatgagagtgccaaacgcgtcgacgggagatgaaaaaaccgtttctctctgtctcccccatgctccgagacgaaattaggtagctgaatataatttgggaggttaaaactgcgttgttttgccattcaagttcattttgttttaagtagaatcgccttgtcttcttaagtgttccgaaatgatgcactgccaagggatcgcacgaaaggcgtatgcacgaacacaaagagaatgatcgatctggacctataaatacaggagtagaatgtttgcgcatacgaggagcacactaaaaacaatttcaaatggagagacgaagagaaggaaaaaaaagttttcgaacggggagcaagcccgtagtggagtgttgtcgcgttgagacaggagcacgtaaatacgtagttgttcgtgcggtgtacgttgcttacgaaaagtcctttttctcttatacgaaccgtaatgtctttcctatccactcaataaaacgcgttagacgagaaacgaatttgaggaatgggtcctcatcaccgcaagagaagttgaaactcagagtcagtagttaatcagcgtatgcgatgtgtttccaggttcttcgtgcagcatcacgtgtattgaccgtatacagacgctttagtgaggttggaatggtgtttctctttaaggaacttgaaataactgggaaatacgtcatgcgcagagattgcctatcttgcgtgaagaacggcgccctcgagaaagacgctggtacctaccgttgcaggtcgagagccagtcagatgcctttctgctacttcctgaagttattcatgtaatagggccaacttctcgatatactttgtagagtgtgtgtgcgaactctagtgcggccattagagtacaacagacaactttagtccaccaagaagagtaaaacaaccagggagaactcagttcggatctttcagaatttgtggcatagttcaccttagttgacccggaggagaactcatttaaatggaattccattttgccaagaggcgcagttattggttgctggctgtttgaatctggatacgtgcgagtggatgctagacttgttggtctgtttgcgttgctgcatgtccgcctgtgtgcatgcattgtccacgttacgcggattaatcgtttattcatgtttattcatgcgcaaacggacatccagattctctcattccacacactacgctcaacacgtgcgagaagttgctctttcctaacgggaaagtggagtccaactgaggtggtcccgtacaattttagcggcacgtggtctttgacacgacggacctccgccacggaacagatgccgcggtagaggcatgcggtccgtgtcggcgtggcatttcctctcgtccgtttgtgttgtctgtccaaactgtgtgacgtcgctgtaaagtttcttcacttcgtaggaatctgaattccttggactgtttgtgtacgttacggttccccttttgctgtgccttcgggatcgca

SEQ ID NO: 3396 - DNA, 2593 bp, Toxoplasma gondii
catcttttcaagcagagatatacgcacgttgacacccatttctacttacatggtagcaggtggtaattggaagggtactgctgcatatgagttgctgccgcttgaggacgcacccttcgctgcggacgcgttttaactgtccagggacggagagtcggtcttcgtcacggagctgcgcgactgcttgtcttttggtggaagaatctcgggagcctgaatcctccccgcggcgtcgcttctgctcgtcctctcggccgctctctgcagaggcactttccaagactcgctcaggctccggcgcctcgcgcttctccagcgaaacgtgcgagtcttcgtccccatcttgggggagatccagaggcctccgttccatcgcgcgaacgacctcttcagcggtggggaagaagacggagaggcggggagaaaaacgactcaacaccgcggacgcaactagagtcggagcagcgagagacaatcacgtggagcagagcacagatcctaacagagcggggaggctgtctcgagacgagcgggatacctgcgcttgagagggagacggcggcaatgaaatcaagatctcaccgtcgacaaagcctctgtttgatcctctctacagaaacgtacttcgtccaggaatttcaccacgatgtgggcactctgcgttcgcggcatcattctaccacttgaatcgaaaacgccttccacttgctctacacatcctgagctgcactccaacgtccactggggacttcgcgaggcacggtttcatggatctgctagggcgtcagttaggcaaccagtcctttctatacgcaaggcggccatgtaaatactgccgggtatacggaacaacaacagacacggataactctgttccagccgcgggtgtttctgttccacgacaacccgttcacggcgcgccggacggtctagtggaccgacagtctcttaagagtcacttctgcggacggagctttcttcttgaatctgcacatgaacgaagcaaaagagctttccatccttgcttcgggaaaacggagaaaagggcgattccgcggagccgagcggcacccgcgcggtgggtgttcgtgatctccgcgggaacgcgagacggagaggagagacgggtcgccacaaacgcaagaatggacgcgagacacgcaacaacctgccgaaaggcacggaggcacatgctgcgccgtgtttaccgcgaaaaatccacgcagacacactgataactgggaggatctcatcccctcgcacggcggttccactcacacgtatcggaaaggacgcacacaacgctgtcaagcatagatccaagtctgtaccagcgccgagcgcgtgtgaagtcggtacagaagcgagaccccgatgtgccgatttcttcggggtcttgacggggaagtggagggacaagcagcgtctcgaccggcgcaaggcccggcgaaaacgaaaatcggcggatgcacgaaaagacttttcctgccgacctggaagaatgatcgaggcgggccagcggcactggaaggtgtacaagtccgctttctgcgtatggtttgtcttggtaccacagtaagtcccttgaaacgtggaactgtgcccgccgaagaatcggaggagtcgagggcagcgaaaacgagccgagacagatgcaggcgagtgcagcatttgaagaggcatccgcttcctccagaagattgacacctgcagtgacctatcccgttcccggtgctcttgagccttgacgttccgtttccatccgtcaaaaacgcttcatcagggaaagcgccgcggaaatgggttcgcgacgcccgcagaacattcgaaaactgggagaacagctcgcggcggccgtctccgcacccacctgacgttcggcgtccgcgcgttctctggtcgcgtaagccgcgtcccagctttatcctgccgtttttattatacaaattggcagaccattcccagcgctgaacttcccgtccgtactgagaaccggccaccgcgcaaactcaaaccgggctactcgcgcataaacatatggctgtgagcgagctggcgtcgcgcgtttagagagcgagagggcatgcacagctggttttctcgcatgcggcccgccgtctcatcttgtctacgcagatgctgacacacgacgattttctctggggccgacagcgccttctagtggaacagaaatggtgggttcctcgcttcttcccctgtagatcttgtcgttcttccctgcggctggttcttctgctgtccgtcgtcatacgacctgcctccccaggggaccctcttcttccgcgggaacgcccgtcgtcgccaccgtgtctcttcgtcggggtgaaggcctggaccgttcagcgtcctcgccccacggcaaatctgcgaatctcttgacaaatcgctgtggcataaactcgttttccaccattccttctcttctgtcctgcgtccccgcgtccgccataaagcctctcccctcttccctctgggtgtccgccgcggattgtatgctttcttcaccctgacgcttccttgtcttgggttctcggtgctctgcatgttcctcagtgtctcgctttcacctgaa

SEQ ID NO: 3397 - DNA, 5026 bp, Toxoplasma gondii
agatctgaagcgaacaacacgcacatcattttccagagatgtgtgaacatctatgaaactcatcaaaaaacataaaccaaatgacttcacaatctggtgcatttgccacagtctacgaatctggctccaccgctgccattaaatcgctcactgcgcatcgccagcttaccgaatattcagtcacgacggccagaatctcccgacccaaacatatgtttttcactgcttgacgtgcccggacctctcctatgaacaaccgtttttgatcgtcccagagtttgacttttttggggtctgcttgactaactagagcgaatacgttagttctgaagagcatgcctgccacctcataacatccttcaccccacgccggcacctcgcggcgcataaactcggacagaggagcgcacgtgaagacgcgaaagcccacagacgtggcgcacacaaaacatgtattgtcttggttgaatgaatacgattgcaagtacacagggtccagtctgcggctctgtattagctctgagacaggtgcctccgcctcctggagatggcaggaactgtgaggaaggcaatgcggatcaaacgacgtcacgcggctgctttgtggtacaatgttctgcgaggtaatgggtggttgtggagaatcatcgttgtcgatcacgcctgtccgtggatctgaactttcaacttctcctgtgttgctcggtgagagccacgtgtcactcgcatctaccgttgccggttccttcttctctcctcgattctgctgttggaagtcagtttccgctgttgaggggcagacgcctgagtcgaacccatattcctctccagttttggctaatggaaccgtgcaaatgtattcagtggcagccgcctggacgttgtcgtcaagcgcgagatcgagagtggactgagctttcgctctaggatcctgaatttcaatgttcgtggctactgcagtgctggtgtcgggagagtccacacagcattccgggggtccaagaatctcacaagaatgcgtttcacgaatccgttgacgactcatgtttgctctggttcaaagaaccacctcagaccgtcctctacactcaactgaaaaaagacgaaaaacaagagaacagttgcacccgccaggaaaatccggatgattgacttgttcttttacttgctccgcaacatgaccagtgtaaggagaacaacgcggaaaaacaattggaactggacgacacggcaacgtaaatggaaagctgtaggagacaaacgccaaggcaggccaggaaaagcagccgccagtgagtggatggcagttcagcaagccaaaactcacgctgacgctagtacaatggaacgagtgacatgcattgaagactgagacgggtcacgcgcatgcgtctcggttgcatgtctcgcctgtgtttcttcagtcaagaccactgggcagaaagttttcaaatagtcatcgcagcatacgctgctaggcttcctcgtaatgaattagtcagaaaaagctaacagcagcggttgctatgggcacttctttgtcgctggtgagggcgtgaagcgtggcttcctactccgagctttgggcttttttccggaaatgctacacgatcgtagcactacctgaatggtcctgagaccgggccatggcgggtgcggcgtcatcactggactcagtacaacaaaaactatacaccccttcatgtctactattctgaccttccatcctcgtactctgagggcgactgcctcatgagataacggtcgccgcaaggggttctatgagatcacgtaacacagacagcatccttcctcatgctgcttgatatgacgaacgaaaagtgacgtttctcagtcatactgtcatgccctcctcgtgctttgacttgttccaatttgcaaagacagcggcagcacgtacagtgtgattgacaacgacagtggcagcacttacagtgtgcacggcatctgcgtgatgtattgtggtggaacgcaacacggtaggacgaggtggtcaaggcgcactgaatttgttctcgctttccaaattgccgttgttttggtcacgatacagtcgtaatggtaaaacaatatttgtgtgacatttcgctgtgctgcaggccagcgaattctggtgtcgtatcaggcttgaggtaagcttgataatcaactggtccatagcgtcgaactcgcacggcctccgcttagtcgcgttttaaacgtgggaagtaccgggggagacccctggatgtttctctcaccatgccggtgaagtggacaaacacaccggtagtgaccgacggaatatcgtcgttccttcatcatttgttttagtgtgcaaattgtacgtaatgtacttcctcctccacaaacgctcgttccagcacccgccatgagtcagccaaagccagcaccatcgcccagataatatttttgttcctgtgtgccataacaaagactttcttctctagtacgctctgttgcttatctgtggataacttgcacggtgcaggatggggtaaggaatcgcaagcgctgactgcaccacaacttaatcatttgtttcgcggtgctttcttccgaatgagacaggatcaccacgattattagactaattgcgctgcgtgccggtacactgacaatcaaatgcgctgcgcgccggtacactgacaatcaaatgtcttgagttctgacgcaacatgttttatagtccacgttcctcggtcgaactgtcacgcgcccatatggaggtattgatctacacacaagcagccacagcttagctagtgaacatttcctcaagcatgcagtccattttttgaaaggagccttaaacttctttctttatgaggtggtcaactgcgacgcggcagcagccgcaaacgccactggcttcgaaaaaccctccgggtgttcaaggaaagacacgatcttcttcaggtgacgttagcgactagactgttcctctctactttttccagtctgttggctgtccgcctaccgcgtggcgcgatcagacaactattataatccctaatgtctgtcatggtcttcagccaggtggcatgcacgtttattcggtgtcaccgaaaacaagcctacacgccatcccgagacttttggtttctcctccgaagacgctgtatcacagcagccccgttccctgccgaccacagccatattgtctacattctttaaaataaagtcgccttctttgcaggattaactgcgacccagaaacgtagacgcaaatggctgattccaggtgaggaagagtccactcaactttctggcacagctttcgcggtccgtctcttcaggtaaaacagaaaagcagcgcttgtgtttaccattcacttcgttcgtcgtattgtttctaaagacaatgaccaccaccaggtgcataccactgagcactatccgaaaaataaagctgccgaatcaacataaagaaatgtgaattaagtgtaggatagagctaagcagcgtgtgcgctccgaactcatagactgctacttccaccgagacgtctctggtttgcgtggcgttagcgaacagggaaacgttgaatctgtggtcagaagtgagacgtcggacagaatgacagaacacacggatgccacaaccggccaacctctttgatatccccagattccagaggcacgctttcttttgagttaccggacccaacagatcagatattttgatatctggaggcatcatctgcctacatatctacaggcaagacattttcacgctcttcacgcatttgcttctaaaaaaacgatgagacacctgtgcgaatattatcaccgaagacaccaacagcccttgctgcgcttgttggtggagaaggcaaacatgcggaggggttggttctctatttaacagagaacaggcatttcaggatttgggagcaaaaaatagaggcagcaattcgggaatgggaacgacgagacacgccaatttcgtgctacatcagcttcagcgaataggaggcatgtgcgagatgtgtccgactccgatgagcacacagaggatgacggtgtcgcacagccagcactagcataaaacaactgaagacagaatgttcagggagcagcaagaaggaaaccgaagagacatgacgacgaattgtcactgcgaaaagccatgctatgtcgagactgtggagacaaaacaacagctctgccgacttttcgacacagccgcatgaagtgtaaacgggatttgggttatgcgcttttcgttcgcaactctatccatttccgcgacattctgttccacgaagaatcccttttccttttcagatctagcaacgatactcgcagcacggaaagagagcacttactccctcctgccctcctgtcttccccttggagtgtcaatttctattgactttcctgtcgattctggactcttatcgcgtcaaagactcgcctagatagccttgccaggaaaacggcacagacatgtcatacacccccgcaactggaagtttctgtgccagacatatggagtctgttttggggggtgcgatgggagacagctcgactgtcaacggtacaatctaggtgatccgtccctccccaagaagacaatgagtgagggacagcgattacccgtctccttctcaggggtttgaagacagatctgcaacacgaactccgtgcttttcttgtcttccgtcgccgtgccgctttctaatcacctttcacttcttgaaggtttccgaatgtcaccgtgcagtcgtttcgttctttctttcatcccagggcctgtgctgtccaacacggccatagcgttgcacgagatagatcttgcttctgcactggcttcttcctttcccctgctctactctggtgaaggaaacgaacgtgttttttctcccttctcctggtggccttctgtggttcgtgcgaagccaagaagacgggatgaaatgaccagcttctggaagggagaacaagagaaattgtcggtctgggtaataccccccctcgaacgtctgtcccttaccccgcca

SEQ ID NO: 3398 - DNA, 4702 bp, Toxoplasma gondii
tcttgtgtgtaagacagcgggtacaaccgcaaaagaattgatgccggaaatttaatacgctcgtcactgtgcgtattggctgcccatccatcctgaagaagacctcgccagtcaaaaaagtttttcagttgtcacaactcgtgagtgctacgcagatgcagtgtgttgtgcggcggataccttcgcgtaataaagtccatgtctcgagagcgggcgagggcaacgtgtcgaagacgggtcacagacccactgaagcatcaacaagagtagcatccagtaaagtgtaggattaaccataatgcaatctaaatatcaaactgttcatgaatatcgtttaggtcttatttttgtctgcggtgtcacacggattggtgccggcagcatactgattccacaaggctgttcggggcatatatgcccttgtgttgaagctaagactgcgccgttaataattacgctcatttatctttcacgtagttttcgctctcagacggagttgtgtattgactaggaaagccaacattccagctagaactccacttctgattcttcctcttcggtctcctcttcgacagcctttttctcttccgactcttcgtttttgtgatgcgcctctggggaaaccaggctatgtactttctcctaacccaaacaatgctgcaccagatcttgggctcggaaagaaacagcactctcttacttgtagtttatctgcagcatctgatagtccggagatcacactgtcacttttggtgccttcttcagccttcttcacgtactcggccgcgttgatcgttacgtgcttccctacagaaatcaattcttacttcctctgaacacagtaacactcaatgtggaaggcttacccactggctgttccttgccgttgacctgggtttgattgaaaaaattgtcttatttttgagttcagtctgtactcggcttacctcgactcgcattactctgttttcatccatgctaactttgacattaactcttgctggtttcggcttcttcgtcggcggctgtggtccagtggtgtaacagatgccccatttcgagatgttaagcgttatggtaccggcgggggcggaggaataatcttctcctttttagcttctgcatacgcaatcacggtttgttatatttcgttagtaataactgctgaggactcaccagtgacagcggttttaatgcttggtaacgttcctgtggtcacgtgactgaggcagtctcctttttgaatcataggctggtactctaacctttgattcccatatttcggcagaaccaggcctccgtcatggctgccacaagcatgacgaacgtggtcaagacgttcaacagaaacttttcaccgtcaatccagctgtcacgtcctagtcttgaagatgcgcagagaacttgctcatttccccgatacttgaacgagaaacctattgcctggtcagtgtaccctggatgacgtctcacacaacgagtttcttacaattgggtgaatcggcaactgctccaattggcaaatccacgccttcccaaaaaaatgtcctacaaagttgacaatgtgccgcagggctcctaaggagaaaactcagtgcaacgtaccctttcactgtcttcctgtagtgaaccgtaaaggcagttcccgttattcgacccattgtctcactgcggcccatgcgaatgagaggaacatgatggaaatgaaaaagggtccaagtaaaacctactctccactgtgcttcagaagctcagaagactgcatggataatgagacattcctgcacgaaccaccgttgctctaccagttacctgtggtacaaacttgacaggcccgattttcaaaatatcgcactctattgaggaaccaggcagagattcttaaaggtaccggtggctttgcagttgaatcaaattcaggcacctgctgttggggcttctaaaggcctctcagcctctacctttacagcttctactagacgtttgacttggcttgcttcagctgcaaggtacgtgcaatggcgttggcttaagaccagggccactgaggtatgtttaccgtccagcaaatccgcttgtcgctccattatattcgcctgagttcggtcgaaactgtacagcagtcttgacagtggtagggcggttatcaattctttctaaacccgacgcttacacagcctcagcagagctttcctctgtctccctctgcctctcatgatctgtagacggtacgactgctgcttgtgctcctgatacgggtcagcaagcactgctactcgcgtcacagtgaatgaggctcactgtcagctgctgctcgaagctgctcggctaattttctcttcttgtgcgctgtcagcagcagatgatcatatctatctgtgttcaagatctgcgggtggtgatgagaggggaagggggtggatgtgggatcaatctttgctgagaggtttttgttccgtcgagataaagcacatacctcaaactgggctcgcaggtcatcatcgttatcaactgcagcatcaggaactgcattgctaggtactgcatcttctgtctgaaggaactgtccgaaaatccctttcccattctgacggccgggcacaatgtttgacatcacttagttcacctacgcaagcggtagcgactcacgcttgtggcaacggcgtctggttgcgaacctagcccgaagaggcgtgcaattgccgcggccagctgaatgtcgccgagggcgtcaacaggctttgataaggcgaacgccgacgccactgcaacaaatgctaaagagcccttcattgcacttgaaagcattgagttgggtgaaagaagcccgtctaaataaaggtactgttacctacaaggtgcgcaggtgacgcgcctgcttccaagtgtatatacgcgtgggataagcggatcgaaagcagccccttttactaataacatttcatctgcactcagagaaattcccgaaacataatccctttacaagggcgaatactctcaattgcgcttctctctatcggttatatgtgataccaaccacagcatctgtgcagtctggtttcgtagacctattcactcgtgcgctactaaggggataggcgagagatgtgcgtgagaccgcccacgaaagtagaaatgcattgtgcgccacatttgaagttggtcttgtgcattcctgtcgatgtggtgaaggaagcatgattatataggttgcaaacaattatagtgcccagctgctaaatggagctctggtgcatcgtgtctcggaatggagtcattttgctctgcgcctgagcagctgaaacaaagctgttcggttcgtatatgagtttgatcggtccagaatgtgctgccctggaggttgcttatataaacctagaaatccctgcttatagtgcgttatagggtatccagcttcagccccgtcggggggcatcaatactttctcctcgtaaacgctggtatcccctcgggatcgttggaacagggattttgacgacaccagctgagtctgcaataattcgtgtggccgccgcgtttttgtagagattcacactgtgagcccaaaagtgtttactcatgcctcaagaccgtttcgtgagactgaattaaaaacgcccgctcttggaacttgctattagatcatcatgacggccctgacggaacatcgggtttctaccccgtccattatgtagtgtggattgcacgctagtagaaatagaacaagacaaccgaatgctagttttgtggcaccgatttacatagtacaagaactacacacgacaaacgctcggggatctgtaaccaaggctggcaacatcccttgagagaatcaaaggtgactttgtgaacagcatcctcccccttcccggtatcatgcaagtcttgacgcatgtgcacactagtgtcgattgagcaccgttttcttaggagactcaccaccgccttaggagtcacaaaacagcttaacgaagcttctgcgaaaacgaccttctcactggtcggtgaaagcaaagcgttgctcggagttgatggaatagacgaacaaaaccagtagctagatgcaggtcagctggctcagcacggatgcctctttgcgtgacctccactcacgacgaaaatagcacgaacatcgttatgacaaaatatccttctaaataccacaggagtcagagctgttcgcatcctttgtttatggccaatgctttacctgacctcctactcagcggctagattcaacggctcctccggacgacgctgtggagccccagaagcttttgtgtgcgtccggtagaccggcaggccatccatccaagggaatgatgcttctctatgctccagtaaaattcacattggcttttatcgagtaatcaagaagtcattgccaatcatgaaaacgtgggtcgaacatgccaggtagagctctctcgacggtgtggcgccgcaaatcgatttctcttgtccaagaaacaagaggccaatggaccgccccaacaggcacggacaagcgccattgctcgtacacatgctgaacattttgcgtgaagtccgatggaatttacacacgagacgcgattttagtgtctcacatcttttaacttctcttttctttggtggccctgtaatttgttgctgcaaggctgcctagtacgtttcttgcgttccgtgaggactcccccccccccttttcagacgcgccaga

SEQ ID NO: 3399 - DNA, 3179 bp, Toxoplasma gondii
ctttacttctcttccttctgagcgtgtcgtcagccaaattttggctcgtcttcaagctccagtacagggcaaacctgtcgagttcttcgtctatcttttcatattcttctaatgcatctccaagagatctgtccaaggttccacggtgctgctcagcgaacgctatagctctctcctcaagtctgtccagaactgcgtcatcagcggtatttcgctcgtcttctcgcagccgaggaaagtgttcctcgagattccatcgtggtgcatttctggagcaggttgtgcctgcacgtaaggcgttttaattgtcagagctgaaatgcatatgcttccccatgtcggtttcaagagtgtccggatatagttttctcgcttacccgtcacaaatgaagacgtgatttcagtctcagcctgtagaggacccggaaacaacggagccaatcgcttgggataaaagtgttaccagggttccctgcaggtctcttcagcggaagtcagccagatatgcacctctcaatttttaggagcaataccgcagccgacacaaggcttgttagcgtcattgttattttgccggaatccggtgttctaaataacgaatccatactatcctcaaccgcacatttgagcttacctgaaaatctttatcagacgtcccggaaacaacgtagattccacagtatagaaacggcaccagacgcacacatttgctcttcatggtggtcaaatacggccaatgacagagttcaaatgcacttccttaaaagacgtctgcttcgacagctagtgggagtggtgccacaggtgaaactttgtcagggaaaatgcagtattcgccgtgaggcataatcacttgatcaatatagtgcctccgctcttcacagtcacaccagttcagaggtaaatggaaacttcctttcacttctaaaggcgttaaggctgaaacgcgtgagcagatgcacgtacatagcttagtcaagagagttggaacaattattctggggacccgatcagctgtatggatttggaattgctaacgcccagttgtcgtggaaataagaaggggacgtgtaagatgaagaactcttacgaagtgacgaagcaaatatagaaagtgaggcgatcaggagtttataagggcacaatgagtaatcatccaagagttgattttctcgttttacagttggctcaaaagtcgcaatggtcatacgaccctttgttagtccgatgtcagtgtccgcaagtttcagtggagtccacagtccacaagcggggcatgtcatatccgacaaagacaatttcaccgaacaaaccataggctgccgctctctctctctcgtgtctcacttctgtctcgtgcattcgtttctcttggcgagttgcgcaagatgcccgcctctgtctcatcttcctcgtggagcttctctgcagtttttccgcgaacgcctccaaaggaagacggtcggcagatcgtaactggtttacctggactctgaactacgtcacatacgtgaaggatacagtgtgaatatagacaaccactgtactcacgcatccttcctggggcgtagcatatgagaccagaaaattcattatgaaataaacacgcgaaaacggaaaccaccagttttgagagtctacagcatgcgctggcgaacactgcatttaacaagttttcttacacagttttacttcaaagcactaaagtggtgtgcttgtggctgatgaagtggttttccttgactgacgtcgggaacaccttgcagcaaacagcccgctgagaaagagtcttttcttcgatcatccatctgattttgcaaaaaatggagaggcctcaggtgtatgaagcgcgctcccgttcaactgcatatgaacctaggcacttctttgccataatgcaagatgggacaatacaaatttccgtgtcagcccgctatcctagatgcggcaatgaagtccttcttaagcacacacatgagtggctgtccgttgtgcaacgcttgggtgaacgagatatcaacctggttcagacaagggaaaaaatattcattagttccggaaacacggacctgtgtggtgcgtcaaaaatgaagaccatgagtaaaactgtcaccttgttggagcgagtgtactgtctgacgttacggatcagggccaccactgacacagttgctgaggaatacctttttataaagaccgggcacgaaccacatccctaagatgaaactcattggttaatcttacgctggcgtgaagccctcagcgcttcgttgttatcatgttcagctctctgacagcctggcgattcttcatcagtccccatcggaagacgcacaaagtttgtcaatacaaacaactgatgcatgagcaacaaatccggccgatactgttgcggccattaagcgaacccgacgtgatcctatgtttgagaaatgtgaaccagatacacaggacttcgtcggctttcggtaacccgttctgcgcagcgcttcttcggttcaaagtaaagttgggtgcccattggaagccctgaaaactcaccgagactgcatctcgcttctgttttttaattgggcgactcaccgttgtagcagtgcatctgattgccacctacctggacagctggtgccgtcatctttcgtggacacagttgacagagcacgccgtgcactatctcactttttctccgactttgatggtatgtcgcttggacggtcggaaggctgacactggagtctacaccattcgaattgcctctttacatatccgctagtgagcgacaatgtacgctgtagcgtagggttgcagctgcaacgaagcatcaatattgtgactcaggcagcaccagctctcccgttcgcaatctgtcatttgaaaacaaaggctggcgccatttcacggccaacgcgacgccgatgctcgcaggcgctgccccggcggtgctaccgagagggtggatctgtccatggttctttcatttctgtttcaatcgtttatatcgctcctcgtatgtattgatcttcttgtagatatcctctcatcgcgacttctgctagtgtcacgagccgctcgcacagctgtgttacccgatcagagcttcgagtcccatgccagtgtatttaccgttgcgatttgcttattcgtaagtgtgttcgtccgttgagttgagaatttcgcga

SEQ ID NO: 3400 - DNA, 4831 bp, Toxoplasma gondii
gtgagcaaagtaggtgtcccaccagttgtttcgctgctccacctctgcatgcagagccgcctgctctgcctgcatgcgaacctctgcctctgacccagaggcatgggcgaggacagaagagtacgcctgtgacgcggcttgcgccaccaggatctgtgcagctggaagaacgacacatcgaacggcgtggaaaagtgccgcgggagtcaaataaagtgcatgcagagacgccgtcgtgtttgcgttcgcgctgataaaatacactcgaagagccgccaactcggcgctaacggcttcacttgaagaagaagcgtcttcagagcaacaggctgttgtggatcgtgaggtggttgtcgaagaagaggcgactgtgtatgaagcgactccctgcttcgttcgaatcggttgggtcttctgagctctgtgtgtggaggctgcttcaagagctgcgatgcgggtcaccttttcgatgtgctggcggcgcgcagaggcggggaggagaagcgcaggaaggcgtggagagacgaatgcatgcacgtagaaccagaaaagcgtgaggaagaagaagagaggcagagagggagagagaggacagaacacgccccacagcttgtccgtcagccgcgtctcctcgcaagagaaggagaagaaacgcgaaagagccgcaaggccgtccacaacgaaagccgccatcctggaactgataaagagatcgacaaagggaggtgaaagggagaaggaaaagaagggaataaaacggtcgctgtggagacaccgacgaaggatgtagaagtgaaaacaagtgggcaatagcttagaagaaagcgatttgggaaaaggactcacgatcgtgtttgacaggagtcgagttcttcaagattgaagggaaacgttctcgggatacgggaagaaatgccagagcggaggacgttttgaaaaaccggttgggaaaagctaaaaaaacaaaagtcagcagcaaagggtctctaacaacacagcttctaaagccgcgaatgcgcacaagaacccgacatgcacgggcatactgtttcgtggatgtgtgcgctctacacgtggacaagaacacgcattttggactttgaactttcttcaaaagcgtcaaagacaaagaaaaaggacttctgggaaaaacaaacttcttgaagggtgtgtttgtccatgcaaaggccaagagtgaaaaaacgcaccgaacttgtcgagagacattgggagagtccgtacgtttcacttctgacaacctgcagtcgattaggggatttctgattttgcgagacaaagccttcagacggaattcgttagcctcattttgaatttctcatctgttgttcaattgcaaggcgcttccgagaacctcgagccgcgcaaaaaaaaacagggctttttgcgaagtagagacaaggtgattcgcacggacgaagcttccccgtcccctccgactgccggaaaagccaaagtcgcatcggttactgcacaccccgtttttcaccaagacttaactagactttccgtggaaagcgaatacctgacagcttcctcgtggtacgcgaaaaacggctgaagaaaatagttggtgcatgcacagctaccagaccggtttccaagctacagcgtgttcgcctcgctcggaacaatatgtgcgaagccaactcacatctctaatttcacgttcaaacaaaaattccaagtttatgtctacattggaacctttttagctcaagatgtagagttctggacctgtcatgcaaattgtaaaggggaacgatgcaaggatgtgcccgtgcatgtgtggagatacaaataatataatatatgtatgtatatagatatgtatatatgtatcgaaattctgctgagcaatcagtgacagtcccgggttcgatgaagacacattgttcaaccttaaaagatctccgttgggaagcggccatgcctcgttcgaacaaaacgggagaaaccctctgaacttgagatacgcgggctgcgttcttgcaagccatttggtagattcataggcagtgtttaatttcttcactccagtttttgtcttctaatcggccaactcagtggtggattgcctggagctttgctgtctacactgacatcgagccttctgcggagtaataagaatttcacgggtatgttctaccggtactggtggctatttgtgaagttcgctgctctaacaaagtggtagcggcgtataaatagtagaaagaaactctatctgcctgagtatctcagactagtttctgtggctcgcacctgtcgcatgatacgccgtttgaataactgaccagaaaaatacagcacctggcgtcgaaatcagcgtgctccgatgcagtccttccatatgtgtgtgtgtatgctgcttcctcccaataaatatgccgccttggctcagttgcgtatagtgcggctgacgtggaatgcgcagacacagaagagagaatgaggaaatcgagaggaaaacagcgagaatgggtggtcgtgtagttttgagatcacgacagggaaagtgaggcagccagcagaaggatctccgcacttcccgacccgaagtatcgcatcaaaactccgttccctgaggtgaagagcaactcctgccagtacaacttcataggataatcaaggctacttcgattctcgttggtgtttccggtttttcaagagttgaagtcatgctggcagcagcgtgctgtttctcagaaacttacacgtctttttcacgagcagcaacttgcttcacaaaacagaactggagtacgactctgcaagcgtagagcttgttgtttcccacatttatagtgcatgcggcacacaagcgcagagtttctgtagtgcggctgacgggaaagaagccccttttcaaatggattattctcaaaccgtggagaggcatcactctctgagtagactctacgacatgcatggccccactgcgcagagcgaccatgccaaaacgctgggcgtttctctgcctcagactcgaaacgattttcgtctatcatccgtttctcccatattcacctgaacgcgagtttgttctttctaccttccctgcctctgttcgtgcacaagtcttcccgtctaacgtcccttccagttcattttggacatgaagtccgactggagcgtgtcgctcgaggccgctgctcaaggaattcgaacgaaagtaaaacttcgcggattccccgcgcaagcggcctctcttgttttctgtacacgccgcgtatattgtgttctgccgcacaaccctgttttcataaaactgttagtagagcggtcgatagtcgcttctgtttcagtgacctcagcgagcttcagttgaaaaccctttgccgtcccctacatacgctggaggcccgtcaattactttagaaagtacctccgaattcgatgcgcagttcgcaactaacttcctctcttctgatgacttcgcaggattaattagatcgaacttcgccccattcagttccctcctctgtttttctccacattctacacgccattcgactgtaaacttcgagtgtttatcaaaccgtgttcatacggagagcaccctgcccccttcaaacgaggtcgcgtggcgggtgcgcgccgaaacacggaggcttttcgggacgttttctcgttgctgtgatgtgccccttgctaaagcttgcatccacaggcacatgcaaaccgtaaatcccctgccggtcgcaaatttaagcgtcgagactcaaacccctagccgtgtgtagacttttgaggcggctgggaagcgagggaagatgggtgcagtacgctggttcatgtacagtaaacacaaaagcacggctgccgcaccgttcacctcaaagtgttattagttcgtagtcccaggtaacgtagtggaacgaaactgagactctaaaggtgacagatgagttaaagcggcgtcaagagacggcagccattcccttggttcccacatgcacatcgacgctgttaccttatattcgggtagggggcggaccatcctgaagcggtatagagaggagcagccagggaagatatcgctcgtcggaagagacaattgggcggtggtgaaagtgaaatctctccatctgctactttttttcgcataaactgatccaccactgcagaggaaaggctcgatatttcaaggagttgcggaaacggcgcgaacgtgtgcaggcagcgtgcgagtcttgatgggcaagcacacctagcgaaaggtctcagcttgtcgcagctcttgacgcggtatcgagttgacgatttgcatgtttttcgccggaacctgtgtcccggacgccagcagaaggcgctgtcgttcaccatttttttgcgaccaaccactcgtggacatttctcttgcgcatctccgtcattgtaggacgatgttcgatgtgctatgtaggtgtctagacacccaacgttgttttgctctagacatctgagcatgtcagctgccgtgccgccctcggtggaccgagtgaacgctttctcttgtcaaagcaactcgatatcacacggaattatgaggacgcccggcggtggctgttggcgcgctccctgctggtgatgtgagaggctgtgaggacgactcttgtacagtgtttgagccgcgtattcccgagcatccgatgtgtcagagtggcaccgcgagtgcggttgtacgctgtttcgtcagacgcctgtgatcagggtttctcgtcgcgacagtcgggtcccgggcctccggaggttcttttccagtcggctccacaagagcttacctttaccacccttacccctgctgtttcttcctcctatgcctctaata

SEQ ID NO: 3401 - DNA, 2290 bp, Toxoplasma gondii
aaagacggaatcgtgaaacatagtcgtacgcgcttactagtacaagaagctcatatgtaggcatgtagtgattcagacgggaaagcgatacaagcggcatcattgacataatcaacagtggattgatggagagcacaagctcaaacggtgcgttcggtccgttcacttaagtggcgatatggcttatcggctagaagtagatatatgtacgaggctttacctcttgtgaatgttttcgggaatgtacttccgaagtgtctgttcaagagccagaaatatacaagcaaggctccagcttgtatggctccgaagtatccgcttaccgcagacatgtgccgactcctataacgatcatcacaattcagcaaatgattgcccaataaaacattgctttcgatctacctgtgcagattagaagcgaaatgcccacaaacttccagaagttcggtgatttgcacacgcctttgataatctgcaataaagaaaatcgcgtgtgtgtcggagggcggcgcacatcatcgaaagcaatcacctctgcagggtgagaagcctcaatgcagaaatccctgacgtcgtgggtaccctcacgaacaacgatttccctgaggcagcacgccaggataaactggatgaggcaacaggaaaacgccagcagtaggtagagcctatagtaagggccgtactgcgaggcacatgcccgcgttcctgtcaggagaacagcagagctcaaggctgcacagttgatggtgaagtacctgcagttccatgcgttcacatctgtttgtttttgccttgcaattgtgcggactcacgagcaatcgaaggcgggggaacgattggcttttgtggtgtacctccttatcccaagtttgagaacattactggtcattgcaacacccataggcaacactgtccagagcactaccagaagaagggctgcttcagacacgaataccatcgagagccggcctactgtcgcaaagatcgaacctacgaccagtgcccatttcactccaatgttgtcaataagcgggccgaggacaaccccatacactagaaccataagtccatacataccatagagccatccagccaactggtcgctgaaactgaatatgctactaagaaacaacacgaacacatagtccagagcgaaagtgctaaaggagtcggcaaactcgcacgcaagaataatcgagagctcacgaggcgccttcaaaagggcgctggcagtgcctgtcatgcttgtaaggtggacagggtttccaactgaagctagtgtccttcgtcctgaaaagggaaaatagatctcgcctactgtggctcgtcagtaggtgcggtcctcatccgttgcctggatgtacaccgtaacaagttcaatgtttcgtcctcaaatcggtcagtctcttccgctcgcatgactaagtacacctgaattctaagagggacaagcactggagggaaaaattcaccttacggaataagggtcgttgtgctttctaaactgtggttgtgaccgcccgtccaacgtggcggccgcgcttttttacgcaagcgaactgcgactagcttaccggcgaagcgagttcccgaccccgttgaacccaggaagaaacaccgtctttttgttgttttcaccttccagaccagtttcaaatgatgcttaaggtggactcacttctcatatgcttcgactctgctttcgctgtgccgattcactgttgaccagcgatagtcgcccggccgccgctggtccggctgcaccaagaactgagtttgaagcaatttttcattattaatgggaccttgcgtccacctcaaggatattgcagaaaccaagagctagcagcgttggcggcttggttgtgtttgttgtggcgtttcaatggtaccatagccacagggtgttgtttgcatgctgcttctgtggttttttatatcgttcaccgcagagcggtcgaccatcataatggtttttgactcgctttaccggcacaccgtgataacagttgaggagtgggtgtgcagttcagtttgatgttgttcctatgtcttctccatcacgcttcacctctattaagaactaccagtctttcttttgtgtcctaggctctgcaggtctctctcgttagcaactgctgcgattattatccatcagcttagcaattcctgaggagacttgttcaccaatagtttagaagaagggctctttggccctattttaaagctgcgagtcaagtgattttataactgataatcgagggccggtaccccgaacgactgcaaggca

SEQ ID NO: 3402 - DNA, 3632 bp, Toxoplasma gondii
ccttgtacagtttagagctttgcctctccaatcttatgctcttctctctcttcttccaaattcattcgctctctcctttctgcagagaaagctgctgtaaactgagctgtgcgtaggcctgttggattctttagaacaacagaaaggaaactccgttgcatgcatgtgccgcgtaaaagcttttagggcagcccggatccgagggcctttacgcaggtgtgacgcaacagaattcaacaagcattctctgcctcgacttatcggctcgcttgtccactgatcaccctctcttctgttcctttatgggacttctctcaccttgtctcatccttacacacatcatacatacacccacttcctactcacacatgacccgtaaacaatgtgtatgcatgcatgagaagagttattcgaactagctaagaaacacttgacttccctcaaagctcgagtaacattttcctctttgtgcgtaccgtggtcgcggaggtacttggccatgacggcaaggttccaccgatccagaggtccccggaagaacttgaaccagacgggcatcagcgccgagctgagagcgcgtctcactttgccctttgtcggcggagaagggacatactggacggggctgttggcggtgattttattcgagtaggaggcaaacagcttgccgatttctctgtggaactgcgccatcttggtcgacttcgaaagcggttcctggaggaatagatgcgctagaaccgaagcgcagcggtgacgcggctaaacacgcaggtgaaaaaccggaaacaaaacgcgagaggaagccggcaccgttttttgtgcggctctccacaacacatgcacgatatgcatgtaccacaggtccacgcagtctctccaaattgcgcagcgaaaaaagtagtggcagaaacacagccaacgcagaccacaagagttgaaggaagacgtgaaacggtcagctccgccttctcacaaaaaggaggtttctgtttcgggaagtggccgagaaggggctgccgaaaaaggggagaggcacgcgaccgatctccagggtggcggcagacggggagaggcaaaagcgaggaaacggcgccgaaaagtggacgttgactggaagccgagtttcccgtccctggccgaactttgtgtgtttttgcttgacgcaagtttggggtgtggcgaacctaagagctccaccgatagtcggcagcggctgcgcgccttcgcaactgagtttcgtccaaagggtgaaaattacagggacgcgacaaggaaagtcaaagaaacaggaacaagggcagtagaggaaaacgcgccttccctcgcttttctctccaaggaagctctcacgctggacacatgtccgtaatgagaaaaaaccctaccactcgcgccgcccttcatcctcgccacgagcttcttatatacgccgaagcgcgtttccagtctggctcacactttcagtgtcatcgtgatgcgaatgaatctttccctgcgtccactaacacaaacaagataatgtggaagattacccgtgacttgctctcaattatgcctcttcaccgtatgatacacgaaatcaagggccgtttactcgcatgtccgcaggatttccacatctgatagcagcactccgaatataagccgtctcgtgtctgaacgagcatcgggacacagacattgtggttcttagtcagtctgaagaacacgtttatcgggatttccatacgcagacgactgattgttactctatttgaactggatatgtgcatgcggctaggcagccattatggatgatcgtgcactgtactgcaactatacatttgtggtgcgatctcgatgtctagtgtgtatcagtaggaactgccgaatgttttccctttcttcactcgacactctctgggaagtgatatgacttcgttaggcaggcaaaataagaacgcaggagcctgtgtctgtcctcgcgtgatggcagtgttcgcaagtcccgaagggggggggcgtggggtcgccgcagtcagtaccacacggggaagggagagaaagagctagacagagaatctgttcgcgacggtgcaagaggagaaaaatggaagcccttttcgggaaacgaaaactacctgtgaaacggctgccgataatcgcttggacccgccatgtcgctacgccggcagatgctggcacagaacgcgagtcatgcacagatcctctaaaatcctttataattggatgctgacgagagaatactaccaatgcagaaaacacaaatgtccgtcactgacaagctacaacggggattcgctcgcgcgatactcgtttgtgaaagctgcggaatacacactggtgcatgtagccgctagcaaatctgcatctgtggagatacaggatctacggtgcaagcgacgatatgtctcgaatcgttttgtttgtcgaattacgcgcgagggtcagtgagtgagaagcctagcgcgaaggtgtgtgtgctgcttgagtccaatggtgctcgttcctggcgccatgtcccagaagatcaccgccagccatgcttctgttcagaagcatcgtcggtgtctgtctcgtgagcacagagtgtagaacgaggattttttcagttaaagagaaatacgactctcggatggcacagaaaaggcaggagagaagaactctgttgaggtggaagggccgttcatcgctccttcggcactggcatatacaacatgtctgcgtacctccatccccgttaatctgcccgacgactccgggccccgctgcagcggcgcgttgtcgtcacctgccttaagaaacagaaaacaacaccgacagacaagttaccatccgcttactgtaattcattttcccattcctctaggtctttctcttcgaaacattccattcatccagacaagcgacgctgagacagaggaaacgaggcgagacaaccagtgttgtgcgcaagcaagcgcaagtgcgtacatgcgcgcagcattatagattttggttctttcccgggagggtaactgcagcagtgtctatttgccatcgcgagggtggcgagcccatctgtgacctcccgaaacgcagaaaactgggttttttctcggtcatttcctcccggccgccttgactgctgtcctgctggcgccgggattgggatcccggacagctggtgcttgctcgagacaacaaacagcttctgtcgtctcgtggcgaagcgacgatttttttgtcaccacttcccaaagttttcctgctggacaggcgaggcgcaaaacgggaatgtgctggttttttcaaagactcgcgccactccctttcgtaggcgttccagaggcattttgccggcttgggtgcacggtgtccccgccttgaagagaccctgattctttgtagccccgtttccgtgaaatctacaagagcagacccgtttttcgttctaagtcctctcgctccctgcatctggcgtttagtgaccgttcatcgctcccgttttgtccatcctcctcgctcttctcagcatcgttcggtcttgtttcccttgcgtttcttgccgcctccaccccctgtgacactccgttcctctctcttttgcttcattcgactgcccccttgcttttttgcaggttccacga

SEQ ID NO: 3403 - DNA, 2047 bp, Toxoplasma gondii
ttctctgaaccgttctaaatgatgttttcttgtcactggacgtaaccgcgtggcaaccggaggctgccgagcaccactgcaactgctgcagctgcgatcctcttgggggcgttacggctcgctttctgagaccctcgagaagaaagtgtatcttccagtccagtggggtggtggtgtaataggcaacttggtagactgtatctcataaagggagtcatagtcaataacctaggctatcttcagaaacggcatccaagtattttctgttcattgtaccttggaagtgcttttttgtcggatcgcagtcgtaattctcatatacgtgatgccggttttgtacggtagttacagtcacttctttgcaccagtccgattggatgttcagaagtcgcttttctgagaaccaacgcgagaacctgtttcctagcaccattagtgaagtgttttggtctgacgccattagggtgtttttttcgaactcattcaccactgctgttcaccagtacgagtctagggaaaatgaatgtacagggttgcgcgcggtcctaatcttctcactgcgaactgccgtgtagaatggcacatggttcctacagcttaagtggaacacgtccgacatctaaggtccctgcgcatgcaccatctcccagcgaggaatctgtgtccagcttgagatactttgaagcaaacaaaaaagtgatggcacgtttttgtccctgtgaagggaggtaggcgtttagcaaggcagtgtgacctgatggagggggctggttttccttcagaaaacaacacgaagaagaaaatagcgacacgtgtatgatacaacaaaggaccgtttcttttgtgtttatttagacgtatcgattccttgcttttgccgctgtctgtttattgccaaacggattccgaggactctcctgtgaatggaaatgtactgtacagaacgacttcttgggtgctaatatggtgtctaccatggtagggaacttgagtgttgctgagatacaggattaagcgtggagatgctgcatagatgaaacccgaagtacagtagcatcagacaaaccgagtgttttgttttcacagacaacatcccatacaagcatttcagatactcgtggaagggtaccgacccctcccgaccgacaaaattaggagtttcagtagtcctgttgtgaacatatacgcccgaagcttggccaactggagttcggaacttgagcccgcgttctggtagtatcttggaaatttctcagagaccgtcgccagttgccgtgcagacaccccttcgaagagcttctaagatgaaacaaaacgacaggagaaccaaattcgtctctttcatcagtgggggtggcagattattgcagtaatggctgaattgccaaacagacacgcttacgaacgccaattcaattgcacatccattgtgcagaaagggctgcagacaactgtcgaaacgctgtaatttacgctggccgtaaagttgtgcgcgcatgcagttgtttttcccggcctcgattcgtgttgtttcgtctctcaagcacgtcaaaaagtggctatttgccatattttggatctcctgatgcgtcaaatgtctcagtatcatgtggaagttcctaactttctagaaaaagctggttttatctgggtgtcgaatcgtcgtgtcggcgggggctcagccaggtgagttcttgaaggtaccgtttcgcggcagtcgatgcaaactggtgtttcttccttttcttcggcggacaacatggaaagcaacccgaacgtcgatgcaaacgaggagggacggggttttgctcaatctagttaactcggatggtactagggcaagaacgcgtcgtccgagttacattcaaacaccaagaagaaacggcgtgtcttggaaaggtctatcacgtggcactaacagacactgtgtagatgactcccaaatgagagacttggtttctcactgcacgacggaaggagcggcgccggacaccgtacgccaccaagaactgcacgaagcaagttttcgtttcgactgaatcgcgga

SEQ ID NO: 3404 - DNA, 4714 bp, Toxoplasma gondii
cgtttcctgcctttccgtgtacataacggttcgcctcagagaggagggccgcgcgggggtcggctgcccacgaagagtggcgggaggaacgtggagaggagagggcggagagggagcagaagagcgaggacgagaacggagaaaagagaaaagaagaggagggaacggacccatgggtgcatacggaagaagtcgcacgcgcgaaaggggaccattcctgtcccctgcgtttcaacgcgagccgaaaggaggccggccgcctggcattcaagagaacgcgacaggcgagtttgtgagtggagacagaagaggagactttgcagaaagaggggatgctgcgcggggtgcgtgtgaagagggagcgactgaaaatgtgtgggagactttctgcgagaggaagagacgccagactgagggacgcgcggtcactctcagcgaccgcgtagcaaattgcgagtaccacgctgatcaagaggaagaccacaaagaggctaaaccggctctgagatagaacctttcgacgcggacggtgaacatgtctctgaggcgtcggcggagtcgaggacgctcgggaggaagcggagaacgagccgccgatttcggcactcttattagacgttgtctggggagaaggcccaggtaaacgccttcgcgggagatgaaggcactcgcaaaacttgatgcgcctcgacaggggtctcgacgcagacacagagagaacggaagactgtgaggcagcacgaagcgcagagaaaacgctcaagaagggagcagccagcggggacgcggaggcaaagagcttggaacatgcgtgcactcgcagccatcgaccgcctcgtttgtcgccgcaaacagggcgtctttgttggagacgaaggctggcgctgtatctcagacatcccaccctctttcgccttttcttcgatgtctccttcctcgctcgtctgcccggctcctggactctcttctggaaactaaaccggtgcaaaaaaccgcggcgcttctcccggtgcccacttcgaccaagtatacatgcacccgggagaacggtgagcggatgtgcagaagagtcgcaaaccggggagccgacgcagggtccgctggggttattccctgcgtgtttccgcatgccttctccggttgtttcgtcctccatgcttgtcgctgaagagttcatacaactgaagagacgcgcgcgagtatgcagcgaagagcgctgcgaatagacctagaaaaaacactccctgccgcgacgcatcgtcactcctaccagcgccgcttcccgaccggaagggtcacatctcctgcgcaagtgggcgttgtggaagaaacatcaggaaaacggaaatgcagtagaaaatgtaacgaaaggaaaggtgggatggcagcggctgcgtatccgagacaagagaaaatcgtatccaagttgataaccgccgcgaccagcaaagagtgccaaaagatgccgccgggctggaggggaaaacagttgtaggagttggctacagatcgaaaaatgttccgcagtttttcgcgctgaaaacagccgtcatagatacgaacgtacaacacaaaaaaaggcaaaatgcattcagacaaactcgcagttctctaaaatcggaccttgcatctgcccagtctctccgaggctccccgtccgcatcgggagaaggcaggcgtctcgtcctggcggagacacgagaactctccttactgcattcctcagtgtcgtttctttccgagatcaaactgagaaaaagcctcttctttccccaccttcgagaacaacaaaaatctgccgaatgcgtacgtgcgcccagtaaggcggcgtaaagatgctccggttagcggctgtcttgcccggggtagagaccctagatggtatactttctcacgacggggcgacgcctactccctgcggatcaatcccccttcacactgttcctgtgccatcggtgtgccgtctagaagttttctcatccttttaacggtcagatctctgcaaccaccgaaagggcaaacagagttatgtacctcctgtcgttacgtgactgtcagtgcatcccccctcccccacccccccttcttgcagcctgtcctttcgaagcgcattggaaatacaaagaatacgtgattggagttgtcacgcgtctatggcatgtataacggcaactcttcgtgcagcttagaaacagcctcttcctggtcgtcttcatataaagaagctacgggactccctgtgtctcgacgcctggcaggccctgccagctcgggtcattcttggggcttggggcttccagaacaatcgagaaagctacattagcaccgtgtcatcaccaacaccccgaaaaagaaggtcacctaaagggtctgtttccctcgttttctgaacgcatgtttcctcctgtcggcgacagaaagggatcactggttgagttacgtggcctgtcgcaaggcgctcttaggggcttccgcaacacaaccccccgtcagattgaactctcgcacatcgatggccagtaaaaatcgacagcggaagtcacacaactttaaaaatgtgcgaaagggaaagtacgaaacagcaagagcgatactaaagcgagggggatgtttcagcggtttcgtggacggggcgtaaatcagcggcgacgccgtagtgaaaagacagaaaagcattgtctatgttcacatgccgcatttcatctggtgaaatatgctctgttccggactcatgacagtatgacatccaaacaaaggaaacaattgcggcgcgacgtcccggaaagttactttggggcgattacgagtaatggagaagcatgaactctggcggccgcagcacgatattctctggacgctgtcgacaagatctccaacaagcaaactatctcaagagaaccttgccgtttctcaatcgagacagtcttaatagagttgcggccaaagcagtttctaaagtgggaacatgccgcttcgaataaaagattactgtggtcggtgtgagcttgtagtgaggccttttcagagggcgtggccagtctgacagagcagctttagaacgcgtatggtaacgcctctttttcctctgtgaagcctatatgcgtgtcttgtcaagcaagctgatgagccggcgaatcttcagggttatgtagctaacacaatacagcctcgatctggtaaacaacggtcttcaggatttcggccagtagcccaactcgtcgtttgaaactccccagaaaaagctctctcaccaagtattactcccactacgaccgtaatgattatactagcacctgagtagttgtttctttcgctgttactatgattggtaacggtaaacaatttgttacccttggagcgtacctaacgctcggtcctaagccttgtcaagcagtgccccaaatctttgtgaaagggcaagtctgccgcgcaagacattgcggcgcgctcttgcttgctcgggaaatcgaaaaacggggcgtcaggaaatctctgacattgcccagtcttttccacccttcttgctgcggtgtcttcccaccgtcttaggagaccgctacgatggcgtcgttgagtggcgtttcggtgtggttgacctcacagcactgaaacgagaacgtttacttgcctgagccccaaggccggcttcgtacacgtcagttcatcgccgaaaccgttaaggcaaaaagaagcacacgatcagtgagttcattgtgctaaagtgaacagtatctctcgatccgaataaacgaaatcaacggctactgggcggctgtcattctgcgtttggcttttcttatcagcagaccaaaaacgtcgactgaacacaaggttgttttctctcgcttgttcgtagttacgctagatggtttctactttcaaaaaacacatgattcctcgtgcgcccctccacgctacagtctcgcccccataattcccctataccctcttgttcttgattttaacaagttcggcagctgtgctgatttgcaacgtggagtgcatggtttgctaagggggaaggccaacagcggcagggctgcttgcatttgcgtcagccgcatgcattgtgcggacgagagaggcatcgacaacagcggttgccaaagaatatactcgttttccacccgtcgagtatccctagccaaaatcactgcattgtcagcaaagaaaaaccgaaactgtactggcctttccagttctaccatctgccacgttccatattcttgcatggcagtacatggggcatcctgtggcctacgtaacgagaggtttcggtgtttggccgttggtgtgatctcgtttcaggcggcttaattttgatttcaagccctttccttctaattagatatatcttctaattttcccccctttgtagacatgtctcggcgtgcagaaaagactggcagctagggtttgtcttcttgtaacctcttgcgcatgcaagctgcggtccctccaagcccctaggaaagggaggtttcgatcgaacctggtcttgttctgcattctgtctaatccgttcgttttcgacatttaccgtttctttcgttttccgtgtcgaccacgccctggagacaattttctaggcactcaagggcctcgagcataagcagcacgactctacactctacccaagtagtgcagagccatcgtgtccccctcaacgttttcttcgaatccctattttatttctcttcattctccatctcca

SEQ ID NO: 3405 - DNA, 1898 bp, Toxoplasma gondii
actttctgaagatcttgaagcagcgtcagaagacccagactcggatccaccgccgctcgcgtcagcgcttgggctccaacagccttcgccgcgaccgcggtcgcgccctgtctccgtgcttcagtctctgcgcgccgggccgccgcgaccgccgtcgcccgcagcgatggaacttccgagaagaagaaacgagccacaggcgtctttccggacgcagcgtcttccgctctttgttctccttgttcttcatggccttcctcgtcttcgccttcgccggcgacggagacctcgtctcggggtctcgcagcatgcatgcgcgtggatttttctctgaggtttccttcgctgttcgcggcgtctttgagtgcgttttcaggcgaacggtccgcgacgttcgagtctccaagcaaggccgcttcctccgacgttaagtcgagaggaagagcagcgaacaagcctttgaccggttcgacgcgctcgagacaagacggagaaatgaagtccgtcaagacactccacatgcggacgtactgctgcggatacaccccaagcttcctgtccagttcgaggcgacggacggcgcgaacgaagcgatcttcttcgtctctgtccttcagctgctcgagccgagcaagcctcggattccacctccgcacagccactgcgttcggctgcaggaagaggaactcgctctgcacagatccaatgccctctttgcagccgccaatcgcctcctccactcgcatcgaggtgtacatacactcgaacgccgaacctccggctcgcgtctcacccgtcgagtcgtccaaagacgcagcggcaagcgaagaggcgtcagctagtgtgtacaggagatggcacccaggctggatgcacttgactcctgcgaactgaggtccgactctccagagcgcgtagtcgaggccaacgtgaacagaggaacctgaagccccgacaggcaagccgagaagcagaagagaacaactcccgagctgagaagctgcgtcttctggcgagaggaaaggcggcagcgacggaggctccgcctgcgcgtccgacgacgcccgagctcccgagacaccacagaaagaagaagagaaagaagaagagaaagaagaagagaaagaagaagaggaagaagaagaggaagaagaagagaaagaagaagaggaagaagtgaaggtgttcatggctgcaagaagacaagggagaggggggccagacaggcagccttgtgctaggtgaaagaaagaaaagtcagcaagcgaaggaaccggagcgagcaaaaggaagaagggggagaagagagagaaagggagagagagaagacgaggaaactttcatttgacaagatcgagaggcggggcgaaacagcgaaatggtcgccagtggaaagcagcgaaattcgccatgagggccgttggtaacaccgactttatctcgtctcttctctgcggtacccacatgcacaacaggagagacaagaaagaagttcgcgccttcttcttgcatctccagcttggggacgcactccccgaaaaaggaactttttcttgcttttcttctcttcgtcaagaactctctgcatcgggacttgtgcgatgccttttcactgtcgcacccgcctctcccacccagctcgcattcatgcactgcttcacaaaggggaaggaaaaaagagaaagaaagaaaaaaacaagaaaaaaaggaaaaaaagacaaacaaggaggaaaggaaaaacagtcaagcacgcgcatgtgccgggtctctgttgcttgctgcgtttttttccagcggagcgacgcatgcagctcaacactgcatgtgcgacagttcctgtttttcttcagtgaagaactcacgacaatgacgataccacaagtccttttttctcccta

SEQ ID NO: 3406 - DNA, 4775 bp, Toxoplasma gondii
actccggacaaccaagtcttagagaagcagcaaatgctgtggaaagtgcgtcaacacttcctctacgacttgtcccttgtttccagcaccgggaatcatcaaaggaaagccctttctccgtcgaaggctttctggagagatgcgctcaactcttccgtggttgatgccgggagactcgcactgcttgagacacttatgcgatcacccctcttcgaagaccaggcgaacaaagttcctggagaaagatggggaggcagatgaagacgaaaatgtggaacgacattcgtcgccgactgggttgctttatatcaagtgaaatggtggtgactgtcggagccttacagacgtgatgtggcataaaccaagcagcaaaacgcacctcaaggatgtagcgtgtgggacgaaaaacttcatacttccccctcttgtgtataaggcgcctttagatggtgcaggcactgaaaatgaatttgacaatctggctcgtgggggaatagctgctgttctgggataggcctcagcagtgtcgtgcttgtgctgttgcaagcatgtcacttgtcagtgcgtgaagtgacacacctgcttctagctaatcttgtgaacttaacgaaaccattggggtccgagtggatgccagtcactgtaatctacgcacgacccgacagacggcagcagtagttgacgtaaaggatacgcacgactgttttaaaaaacagttgccacacattccgatggcttcctagatttgtccatcagcgcggcgtttgagtgtgcttggtcgttacagaaacgcccaaatatgacccgtaaagcccttcagagactgtagaaagaggagagatgattgtgtagcactcagacctttttccttgtcaagcgatccaaaccgcaacgtcgcagacatgaaaatagaaaataggtttaactctctgatctgcagtgactccagagagagagccacatcaacaagggctgatgacacaccacatgaaacctattgagaccttagacacggtgcctttctccgttgcagttttacaatcctccaaacttacgatctaccgcaggtgtaacccctttgacttctgcttcggtggatgacagactgctgactccatttcactctaagaaacctgcgtgagtcgctctttcgacatttgagcctttaagacaacgcatggctccgtctccgtcaacgagtgtgagacattctgtacagttgattgacaaggtacatccaacatacatacttagcgaaactcctatccacttgtgccactgcctatgtgttccattctcctctagctcctggctgccttctgttccctcttcctgatcttgaaatttttggggaacgttccttgtctcctcaccagaaaacgccacttccctatacaacacggctgaagatgtcccgatcagcaacgaggaacttctcagatttgctttgaagaattcgtgccacttgaagagcaatgctctgccatagttacagttacacgactatgcataagataacgtgtcgacttccccgtggcgtacactctcgctgccagctcgctcgttttctattctggttaaccgcatggggaagcgattccagtactatgcattacgaaagtgaagatccttcgtgcgaaaaggtcgtttgcatggttgtgtacacgcgactcagctggctcaaaagatgtgaaaactaaacaagggatttcccttcgagcctggttatattgtttctctggctgactaccgaccattgagaggcgttgactaagctcgttcgctaccccagaattgtctagccaacgcattatccatgaacccccaaagcagagtgttgttttgaaaagagcacaacgatgaatcaaactcacggcttgtgctataaggtgcgcgcccattgaaatatctgccagatgccggtggttgtttgtgattgcaaagcatggttagaaatacaaccaggacagcgtatcggcaacgcaagcgtaacgaccacggtactggtcgattccaacatcttcgccattagctacgctatgctggggcgtccgaaacgctggtacgcttgcgacaaagatggttcaccgagcgctgcacgaaatccgtctttttgtacattattcacccgcgcaactatggcgacatggatccttacatctctgtcagcaaaccaagtgatatccctactctgcttctgtctagcagcaaatattgtacttgtcgtatttctgttcctacagaaggctggtgttttgggcgaggccaccgcggagggtctccccccaccgaggaagtattcccacccggcctcacaatatttcaaagaggatccgcatttgccccgaagcacttttctgtgggaccgagaggatgctgccgctgagtggctggcaagcgctgaagaacttgcgaggacctacgatgacaggagtggcgaccaaaggcaaactgcagtgacttgcctgaaaaaccacgacacgggtacctgcgtcatgttttcttttggtgggtccgacatcgactggatatttcctccgtggttgtccggatccttcccccctcccttccctccattatccccaatttgttccttggttgagcttccaatggcatcgccgttgagttgcatttctggtggctcaccgctggtctcaacttccactgatcagcaggcgaatcggaaacagatgtggaaccctggtaaaggagagagggaactgcgtcccgaaggctgcgtcactgttggagggatatgtgtcggaccgttgccgtgctgcaaaggagcagtctgtatgtcacagcctggatgggccagcacagtccctacgtgctactccgcaggatccacagatcggtacgaaaacacctcattcgcccaagacgaaccaattcaggacgtcgcctacctttccgattcgctttggttcaagaggcgttggccccagacgtcacgttcataactatagaaacgcggtttcattcgtcatagcgtcgaccacacacgtctcactacttgttcttcggagggagcctgtcaaactgtttttgagtttgcgtgtgaagagtggacatgcgctgtgtggtaaatcagccaactctagatgcaaaattgtcgcttcagagagcgagatggaaacaaatctacttgtctccggacccaaaaccgtataattttccttccagttgcctctccgatttcgcttcttccgatcgcgatgcgactgcagcaggcgcttcaaagttaatctagtaataccgaccatccaccatactctacaggtcccttttgctaattagcaccaggcctgagctggttcgtgccatgtttagagaaattcgcgacttttgcagtgaactgtgtgagtacagtggcagggcagaaacggttgctcactaactaccaaaccagattcacatgtgcagaagcgaaaggcacaacttccaccagcggcgcacgcgtgacagtcgaaatgtaatcagccccacctgcttttctaactctgcgacgttaccgtgacatcgtctaggtcaaccatgagaagggtttccaatgtattttaaccaaggtgccacaattgatcacatcccgattgatcaagtctgccttcccccgaagctcaatgagcatgcctccacaagtccccgaccgacgcggcatcaacacgaagatacttgcagttgaacgacggtcttagccacatccctttccatgctcacgaggaatttcaaaacaccgatacacgcagtgcgagcaactgttccttcgcgtagaggcaacagtacatgtctctaaaaaattcacactctccggggacttcaacgccgttatccgatcgacgatggattagcactgtgacagcaacttaagcgtcggcgcgacacctggagaggagcctctccgtaagatacactaaaattccgtcgagaggagccaaaatccaaaactgtatcttctgtccgcattgatttacaccacgaggagagggcacacatctcgactcaagagaaccttgcggaacacacacacgacgcgcgttcgcaggattctcttcgggaccggtgcgtactagcggcgcgtcgctgttgtttgcatgcgcacaaagtttgacggattgccgctgtgcgcgtcagaaacctcaattcttgtctccggtgcttttgtaagcccatcgctgaagattctgcaagactgtcgtcagatccgattcgactacagtacgtgtttctctcttctatgacgtctccgtagttaccggcgaggattggctaaaccctgtgtcacccgtgccacggcgaccttcgatttgtgtgctggtggcgtcgatgaacgttttctgttttggctttctctaggctcacgacattgtttcgaaaaccccttcttggaaatgaactgggagactctccgtcgctgtttgtttaccgtttctctccctgcacttcggatactaccaccacccttatagagtacgacttcccccgcaagacccattaccacagtcgggggtcactgctcgtttttaagtgatgccgaagaactagtctttcgcacaagttggaagtctaagaacggaggcaatggcagaaaacggactgtcttctagggcgtttatcttcatttgatacgcctgcactagtagggacggagacgctcggccgttggcagctgtccctcggtcagttggcgcatggtttgttctctccctactgtctgtgttccatgactttcattgcctgactgttgtgcctgtaaagcttcccctgtgaaagaa

SEQ ID NO: 3407 - DNA, 1875 bp, Toxoplasma gondii
gaggcaattgctcttaaagcaaatttccgcattcccatccataaatatatgtacacatacacacatgtatctatatatccatgtatataaatatatatgcataccttccaagtatacatatttaagcattcagtgtatatatatatatatgtagatatctatttgtttgtacgtttatttgaagagcagttgtgactttacttcggcttgtgtggagtaatggaacgaagactctgaggcaacctgtgaggacgtgctttggttcacagcagcctcttctgcgacagaggtctgggcaccgtcgaaagggtctctgcgtttcttttttcacttcgcagagaggatctgcgtctgttgttttcaagttttgctcatttcgcgtgcgtctctgactgctctcgtccccttcgtttcaatccattggatttctcgaggccagagtgctgctgtgtcgagagttttacatgcacgaattgtcttgcagcaaagagaggcgcagtcatctgagctccttggctcaacgcgacgtctgaggagacgcagaggtcagctgggaggtgtcaactcagtgctcgggagggtactttagaatcagcaggcacgaccagcttcacgcagtgaggcgagcggaacgtcactcccaacagacggcggtgaggcgcagagcgacgaggtttctctcttcacggaaagagagaacttgtttttttcagccattattcaaggcccaaccgaggcgcttcatcccatctttctggagacgtacacatccgtgcttggcaggtcttcacacctcccccagtggcactttccacgtatacggaaacttaaagaagaaaggttgtttcgtctagacgactacagaagcttgacaagaaactcctggaagagaacagcaaagttgaacaaaacgctcgagtccgcggtgcgagacactcgtaaacgatgaacgcctagagtctgctggttgcagaaggtcttagcatctgagatctgcctcgtaacgctccgccagctcagaagagagactgtgtttagcggagacatgcggctctgagaacagagattctgccactgctctttatgccgtcgctgtctcctgcttgagagagagaggaacgcctgaaacctaccgtctgagacagtcactccaactgaggttattcccctggagatacaggacagcgcccgtgggggaccgagagcgactgcagcgagacgttctccacggactccgcggagtgccagtatgttccggcgtttgtgttctcctgctgtgctcgtcaaaatcgaagagagaaaatcgaaatgtgagaaaagaaacgcgcctcgctgctgccgacggattccccgtcccgctctctcgggtgtacgcgtccgcctccgggcctccagagcgcgccgggaaagccggaataaaataacgcatgcaagccttcaagtgctcagagtatctcgggcgagtccgccttttctcgtatctgctttctctctcgcgaatcacctttctccttttctccctcgcctttccaaaagcgccgctttctctcttcccggcactgtcgacgccggagactgtctcgcctacctcccgccgcagacccctttgccgcttttgcttctctcttcttgcctgtctgttttttcttcttctcgtgcttccttctttcttctcatcttcctgctctgcgttttctcgtgtgcgcttcttccttcttgtcttcttttccctcaagtgtcttctcctctcctctcttccgtttccttcgtatgccgggcttgcatgcatcgccagcctgccttcttcctgagttcattttatgtagaaaaaaaggtctcgaaagctaagggtctctgcgtcttcattcgcatgca

SEQ ID NO: 3408 - DNA, 1319 bp, Toxoplasma gondii
ctttttccttgtgacgccatgtgggagtagggacaagggacaacgacaaatggaagagaagtgggacagggtgaaacgaatagttgtaagaaggggtacgcaggacaaagcaggacgaatgaagtggagagcactcacgaggggattcgagagacaaatatgaaaattagagacaacgacggatgggaacgcgtagagtatggtagaggatggaataatgggaagataaggaggaacacgcagggtaaattctacgatgcgcagaacaagcattcctcccgttaagcaggcgagaatttcggaagcaaaagatgagactagtatgagaaaaaggggtgcactgcagtacccgctaccatcattatttttttaggatgttagtgccggtgctttcataagaaactagaagcagcaggctggattatgtcaggcagggccgtgaccatgtacgacattgcccagaagatgtgttcgaactggtcacctacctgagtttgaatgttggtgccggtacagcggggctctacagctgttgtaaatgtaattctgcatttgcattgaagccttggcttgtggtcaattgcgattgcccatcgcacccacgggtgaagccgaaggcgcgtatgacgggcggccccatctccgtacgacggcctcttaactaccagcccgttcacgccgattcgcgaatttcacccgttgttatctttttgcaacagcacagtccacgtgggagttggcattctttctgttgtagtttgctacaggtgcgcccgcaaaacagtgttgagtcgttgaacggaggaaccaattccaggtttagttgcaaggtggtgctgacggatcttcaggttggtttttatcgtgtaagcctgaggtgtagagtgagtcgcagttacttttactacgttgacaaaatccttgaattacacactttcacaacacacgttgcgtttgctctcactatttgaaaatctcattctgggacgccgtacttctttcgagggtcagttgcaacctggaatcgcagtcgcccgcaaggacgatgccagattcagccccgagtcatggcgcacgcgtgccaacggcgccatagagcatcgaatagttcgggtggctgccctgtttaccctagtgtcactacttgactgcttatcagtgcagtttttgggtaggtttttggctgcgagtgtctcacgttacttctcattggagtcacggtagttggtgaacgacgcgggtcggagcagttggatgtgcgtcctgggaaaaagtgtcattctgcagttcttggacagtctcttgcgaaattggaaaaa

SEQ ID NO: 3409 - DNA, 3367 bp, Toxoplasma gondii
tgaaaacgaaaactatcacaccacagatcttgcgttttccaccatttgacgcaccagagagtatgcctgtaagaagggcgcgacaactgcccacgcgacctccaggaaggggagaagcagatggaatccggagctagcgatgaggtggagtccagcgccagtttcctgttggtttcttcggtaaactggcgaggacgacgtgtgagagaagtcggtgagaatgtcctcgaagcgcaggttaatggctttcaggacggcagccaagagacatacgaagatcactcgcagggcggtgtcgatgcgggttttccccttcgtcgcgacttctcctgcctctctctcggcctcttcaacagctcgaatgacgcccctgtagcgtgagaccgcttctgcgcgctctccgagttccgcgtacgacgacacagcactggatatccctgaaacgtcttctctttgtcgtccttcctcgagagcagcccccgccacaggggtcttctcccgcggcgcagccagctggcgacctccctcgctgtcgaagtccaccacatgggagaacgcgtctggggcagggtgcaccgtagaggcggtccggcgccggactcgaaggacggagagaatcacaacgagagagcgacacaggtggagaagcgcgacgtcgagaagagaatgagaaacagagtacgaccaggagcgccactcctgcgccagaacgaggaccatcagcaaggtgtccaccgacactgacgcccacaacatgcgcatgcgccgccgacgctccttcacgtagccgtcataggcgaaactccaagaaggataaacagaagaagaagcgtgagaggaggagtgagaataagggagaaaagggggagaagaaggagatgcagaaggcgaagaaggctccagaagaaggggagcagtggctgaggaggctgtgtcgagtgtgaggtttccagcattcgcttgagcgtcgtagtctcggaaaggaggtcttggcggtccttcacgatctgacgcaccggcgaatggaggaagggaggaacgcgtctcctctccgttttccgacgaagaggatgctccacactcgccgacgagtggctgccgcagagaggaagaagtcgcgcaatgcgtcatcctcgaacagagttgaggtcgacacaagaaggcggaatcagaacggaacacggaggattcgcgagttgcgcgttaatgcgagaaagaaaggcaacgaaagcccaggccggcgtggacggcaacggggaacagttgaaggaaatgcaggggaagtgaaggagcagagagggcaaaagatgaaacaaaagcatgcggtggctgttgaggcacgactcaggcggggatctcctacgcctgctcgaacttgagtgttggtcgaattgacgctccgtctcctttgagtccccagtcaagtgggcatctccccttgaatgtttcttttctcttcctgcggaaacccagaacaggtcgttgtgtaactgggacagttgccttcgatagaactcgtttgttgtgaggaaatgacggagggtgctcgtctcgctggacgaggtgcctcgatctagattatgacgcaacacgcacccatttcccccctgttcaccgtcatctttgcgttccttcgcgtctgtagcctgtctgctctccgaagaaacacgatcactttttctccttgaccttgacgccttctctggctgtgggctcggtacatggtgggcatgaaaaggctgcggaggcggacaacgatacgcgtagcggacgcgggtttcccggcaaaaaccacgagacaagaaaagcagcaacaccaaagcctggtcctcagtctttcacgaagaagaaaagtgagaatgttgcggaattccttgagcagaacggtcaacgaaaaacgcttttgtctacgttgcgttttgagcgagacgtctgctcgagcaagtctcttctcgatctgtcgttgcaaggcgtcctttggggtatctagaaaagaagtaacctttccatacggatgaagccactagatcttctcctcgcttgagaggaaaatcataacgcatgggttcaaagggatttagctgcatctaggtagtaaaactcctgcgctcctcgacatttttcgccttcagctatgtgtgcagaagatgacgcgcttgctgcgtgcgctcgcggctggggacaaaacaccggaaaagtggaggactagagagagacgcgttctgcgtgttttcttaacggaggcgcagtcccgtttcaaagactcgacctatctacttgcagacaccatagaagggaaggaccagctgcaggagtgccgccatgccattgtccaggcggcacttaagagccgttctccgaaaagacgtttgcagacgcggttctttcgaaattcggaaccacgcgttaggtgatgctttcgccagaagtttgtgacgagattcttgcttgtgtgtggtgaaggagcgataggttcctgtaaagactccccatcctacagaagagaggcggcatcgaccgtgtggcgatgtctggggggccactagcgcactggtggaagtgagtttttgtaacgcgttttcgtcaggagttgagttagtctttccaagttttgccttcatcttgtttagacactctctattcttgtgttcgaaggaggttttcgtcctgttgtcgtgaatagagtctacgaacgctatctcttgtgaccgaggatcattttccccggcaaaaaagttgtgacgagagaagattccttcttaacgtggctcgtctccaatggaaagagacagggacaacagggaacgaggactcctgtttcatggtggtacccaagtgaatgttttccatgtgttagatttcttagtgaatatcgattcctgctagcgggccgcgtttaccgtgaccttgtctcagtttccggggctgacactcttcccctgcgtgccacacttgttcagcgttccttcaccatctcttcgagggcacagaacagacgattcatagattcttttccgtcctccatcgctcctcgacttgccatgtgccacctgcatcgtgatttggtccaccttccccgtgtgttttgtcttggaacggaaaaacgaaaaaacggtcgaagctggagggacccagatttcaccagcgtacctttgcgacatcggtattttgtcagtttaggaggttaggtaggtgaggtattgccctgttttgaatgtaccgcaggtggcgaggtgtactgtcttttattccggtgttgtcgtgctgacacctttacagggagaaacgcagaaaacggatggctgagcaggcaacagcgaacggctgggttaggctgtcctacacaagaattgaacagaagacggta

SEQ ID NO: 3410 - DNA, 1881 bp, Toxoplasma gondii
tacattttgatgagcaccacccagaacgatggtgcgtgttgtatctcttcgctatccctgagcacggcctcgggaataagtatgtcggtgatgcgaatagggtagggcgattctttttctgaagaacgaaacaccgaaatgagtctttcatcgtctcctgttacgtcgttctgaagtgggtgaatacacaggtgtggtttttctgagcttgggaaaagacaaagccctcaagagacacgaagggaaacgaatcgacgcgcgagcaacacgcaaattcacaactgagtgaaacagaagaaaggtgaaaatggagaagtcttcgcatttcatggggtcacggtgatgattccacgggaagagcccggcgtgtgatcccccgcagccatcgacgggacggtagagtcacctggtggctcagtgttcatgcgttgttttaatcgtaacatggaacatttgtgaagaactgaaacccgggggaagcaggggagacgcttgacggggttagaaagacaaaaatgcctcagctcgttttgccggaatgaagcagagggatgagaggacagacgcgtcgtattatgtgtctcatgaagttacctgtctttttcgaagaagcttcccatgtacaaaaactttttgtcgcacctcgaaacgattacgaggatcggtataatattttgtacactgtctctcggtatccgtaagtgcatatgcaggcattgatttttttgtgtacgacggcgtcactgcagtcaaaacatttaaagcatgacaattgaatccacatacatgttcatacaaaaacttttgtactgtatatgtttctgcttgctttcgtcgttttgctcggcggtgaatatgtcctcaattcaaccggcagatccgcctgttatcgtaggccaaatgacggaactcaacaggcgactaacgattgcctgttgacactaaatagttcgaggtaccgcacaggagagaacctcaacatcacgtttctgtttacacgaagcttccttccgttacagctccctgtaaagaagcctgcgtcgaccttggcgtttctctgaggcagacgaaaaaccgttcagaatgctacacgtatttgccccgatcgatgataagagagggtctgtactgttgctgtattcggttgttctcattggtttcgagactatcgctggcgtcatccatttcctttctcgtacaacccttctcgaaaggcggcggagatgtcccaaaactctggccgaaactcatgtttctccctgtcgggtgaggacgaacataactttgtttttcgcagagagaacgccaaatctgaagcgttctcgcgaccccgcgcacgcaaggttggcgaacaagacagtggcgtttttgtggctatttcggtttttgcagtgactgaggacgaacaacgctgaaatgtgtcttctttgttgtgttttacttgtcacccttctcccttggcattctccttcgtgtatctgtgtcggatttgttttggtgccttctgacacgcgtgtattgcgtacaaaacgagactgatgagcactgtcgcgtcgcgagggccagaaaacgccaaagcgaaaaaagcgggttccttatttgatctgtcttttcgtccttctgtctgttcttcgttttgctcatgttaaagcttgtgtctaaaactcgatgccacctctgtcagattcatttttgactggtgtgtgcaggaaccacgcggggtaaaagcacgagttcttccgggaaggcacgacggatgaagtcgtggtttatcgttttccctttcgagggtaccgtcactgattgcgttcgtacattcgagacactttttcacccagaactatagtgggtgtgtctgtagtgcgtatctgagttacacaa

SEQ ID NO: 3411 - DNA, 1906 bp, Toxoplasma gondii
tgtgaatatgtacgggtatttggtggataagagaggagagcgtctaacgttgtgcacctaggagggcgttggtcatcattttaatctgtaagccgtgcacttacgttgtcgcttcttttgatgccgttctttgcaccgtgaaaggctgtacctcgtttgcatgcggttcgaggtactgtcgcattcgcgtctggaaggtgttttcacttcgctttgtttcatgctttgttggttggatgcctcgtgtccgcgatgcgttggtttgctgtctttgcaactttgttggcgcgtagattgagtcggtcaagcgtgtggaggactttgacgccgcaacccaggcccatattcggaaaatgatgttcgaccaacagcagaagttgcggggagagaaaacctcagacgaactggagaaggaggaacttctgaggaaggcttgggatgccgagggctctccgtttgcaggcacccctttcaacccatccctcgttaattttcagagcagtctaccatcggggttcatgggtggtgggccttgaaatggaccacagggatttgcgaatccaatttctagaagcatctacagaaacgatgccttaatttttcgttttccctgagctcggtgctgtgtcaatctctctattctctcgcgtagccatgtctttgccagccagcagcctcatcgaggcaaacacaaatattgtgccgctgattcagcgttacgccgctcaaggagaaaccgcacacttcaagagagctccgcactcgggtgtttccactgcgtcaggtgccagtatatatctatgaaattcactgggtgcgcatctcgtgcgtgagtttggtttgccacctgtttgcttttccgagttcctctgtaggtgaatgctacttctggaatttacattctatgtgtcatcattttctaacacaaggcctcaatgaaattggggaatcgaatctcgaagacaaagatcggcccggatgacttgtccatttgccgggcggactgacgcatctgcatctttatggtatttgcacccgttcccacctcacgcagaggaaacattggactgatattcaccgacacttttagctctccagaacgcagtgagcggttgaacacgatgggaagctgattccgtggaaaagggttactgcgggttggcttcgagccactgaatgacgcaggtttgtgttattcgtgacccgatttcctcatgtgagcagcgtaaacactttatgaaacggacagacacgtcgttttaatactaatcagtaaaaaacaaagcgttgttttcccgtgtgtctgaccgcacgcgaatcactgctatgcgaaccgcatcttgattcggggcgcgtgcccgctgtccgcgataagccgtcgtattgcatggtacattgccatgtattgtaacactttgttgaaaactgaaccaaacagagcttgcgtatcatcataatttatgtggggggtgtgcagagttaacacaggaatttgtggcacgcgttttgttccagtggttatgatcgtaacagccgctacaacaaccgccctgcgagctgtttccggtggaaagcgagtcacgtgagtgcttgttcacaccaaaaacctttctagaggagctgtttaaaatgccgtgcacagaaaacttccaccgaagagtcagtcttttacaaggctgcgaactccagttagtacgggttcatttggagtcccgctcccaggttctgcagctggtgaaacttgtggcaatcaaatgagttctgtgatttttagtgaggtgacggagggttgaatacaaccacaacaagtccagcacagtatagtgccttcctttaacgagtcaccggggccccacgtgatgcctcctcgggctgctgctggccgtgtgagatttgacagttcgca

SEQ ID NO: 3412 - DNA, 2287 bp, Toxoplasma gondii
gtggctgtagtgacagacagtacatgcacaacagaattcattcacaacctaacgcagtgtaatttaaatattcatgccagttcctcggcgagtgtggggtgtcaccaaacctgcactcgacatgaggttaatacatgcataaatacatgcaatatatatatatatatatatgtatatgtatgtgcaggtatttgcatcaccggagattctcgagtatcaaagaatgcgtttgcgatacgagaaaaaatgaggagaaagagacgggagaggaatattcttgaatcgactgggaatgtcgtgcggcgtaccttgaacgcgagacgaacagtttttttttctgaatcgagttcgacgagcttcacatttcctccatggcctctgaggtaaggccgtacactctctagcacttgctccaccatcgtcgagttcaggcccacctccgaagaggcagagggcgacgacatcgggtgtctgtacacctcgaatgggttgtctgccacaggcgcgaccggccctgcggaagaaagcggagccggcggagacgaagcaaacacacgagagacactgcccccccgaagatctcccgacaacgctcgacatcgagaaggaaggaccggtggtccgcgacgaggaaacaaagaagaaagaggagaagaagaaagaggagaagaagaaagaggagaagaagaaagaggagaagaaggaagagaagaagacgaaacactgagagagctcgagttttcgttttgcgcgtggaaggcagggaatgatgtctggacgaggaaggctacggactttccttgcggacggcagcagaggctcccgctgcttctgttctcggtctccacagtttctcggcttcgtcctcttcgttctctcccggcgtctctccccgtctcccaggtgtcggctcctcgtctccaaaccgcgcctgttggtgcctgtgctcgacaggcctttgcatgcagaggcgaacaggcgacgggagaaagcggaagaagagacagcctggaggtggagaagaagaggggagcttcggcgagatgcagagcattcgggaggcgagatgggtgcgcgaggagacacatgaaggagaagaaaagactgaggaaagagaaaaagtcgccacgaaagggaggagacgcagacactcggcgcagagagcaaggcccaactcggggctgaggcccacaaccctccatggggagacctcagaaaaacatcgaaagggacagagacagacgggggaaaaggaagaggagaaagacgggaaaaagcgaaaaaaaacgatttcggggagagactggaacaaagggagacaggagaagaccgacagtgagggagaacgtgacaaaaaccggagaggccgagagacagagggaggaagagcgacagagaacgagatggagaagagtcagagaaaattgatgcaaagcgcgacagaaaaaagaaaacgcgcgaaagcagccagatgtcgttctgtgtgctcgcttttgcggaggcggggggtgtctccgtttcgctgagaaagctggggaccgaggggagaaagacaggtcttggagtcttgtgaggtaaaccgcagtcaagttctctcttggcaagcaggtgaactggctcggaagatctcaaccacgggaaggatcgaggaggcagcggcggccggatccctcgagctgtctgcgtcttggagacaccgcggagaaaagaagccggaaaccagccagctgcatcgatacactgcagaaagcgagacgtctttgagtctctctctcccgtctctctctgagtcgaagaaacgcagcgattcgctttcgtaagttgccgttgtccgcactcgaaaaggcgaagaaaagaagaagaaacatcttctgctttcctctctcgccgtcgccgtggggagtctccaactgtgccttttccgctttgcctggggggaagatgagcatctgcctcgccttctgccattcttcttgatctggttcgctctcctttctgtctgtcgtttctgcacctttctttctccggcgctctcgcctgcctcttcacggggcatgcatcgtcttttgcgtcttctccctcttcttctgcgtgtctctcagtcgattcttccccttctctggacttttgcgcatctctcgcgtttctttcttctcccgtcttccctactttcttcttctcctttttcttctcttttcttcttctcctttttcttctcgcttctcccctcttgtcctctcttctctctcttgcttctgccattttgaattcagagtgttcaggaaaa

SEQ ID NO: 3413 - DNA, 1886 bp, Toxoplasma gondii
gctaaataaccgcctcagttgccttaggcgcgaaatcacatagacatgcgagaagcgtatgtgcttctatggcagttcggagaacggttacggccaagttaaactgtgattagtatgtgacgtcgacgtttcagtgaagcatgactgaaaatgagattcagttgttagtagtgaagaggtaatatacaggagcgtgggcctctataataaatgactagaaacgtggaatattgcgaattgacgttcaaaagagtaggtttcaatcgcacattttgactgattctacgttgagatgagacttcactgcgattctgagatatgaatccgtttaggataaaatgagggcgttgctgatgatggtttatcggatttcgattcgtacgcttgaagccgcctgttagcaaagtgaaccggtaaggccaaacaacgagtaatcgtgcacttcactcgtcacatgctggaaaatggtgggaactgtttggtaccgtgcggatcctgtttctggcagcctgaaggcgtatcgcagtcaggaagatgtgtactcgcgctggcgattgtttagtctctcatgggaatggaggcgaacgcagcatgcgtacaaacgtggtccaagcatcatgcttaagcagaggggcttgcactttcgaaatcgacggggctgtctgcccccggaaaccgtttttcctctctgaaaaatgaaaccccgaaacgaaatactgttctggcgtcaggatgattgattcagtaatgtatccatagatacacactcttagaggctgaaaagacgccgcattgtctcagctgcatgcttcgactgcctcagtctatgacaccgcaaagtgaaaacgccctgtcagctgcaggcagttcccctcttccactacaacatagagcattttgactcttttctttactggtggcccaccacgttgtgtagctgaaaaagccccacggagtcataagcagaagcgtagcgccgactatcgacgagtttggcctggctcacgagaatgacactcaggaacagtccactgaatggctgtcgctttttctgttgcgcttcccgctacgggatacgcagaaatcacacagactgcgtaaaagacagcagatggtcaggcactgtttttttcgtcactttccaagccgcaagttctggtggggtcacacgtgtggttccaggttaccttcgtcgtgctagtttacttgaaatacagagggagatgtttggttacgaggaacaactgtgctttaaatttcagatctagtaaattcgcgttgctggagtgcgccatcgtaattgcttttgggtagaaacgaaacctttggcgggacaggccctcccgtctccggtgcgcgagacacacatccacttgggaaacagccgtccttttttggcttgcctttggtgcaaccgttgtctgccaattcctaacgccccaacggagaaaaaatcccgtgtgacgagttcggtgcatctaaaatctccccttcaaaggtgtgaggccttaccgtttgataccagcctcgcaaccggccggagtttccttctccattacactatacgtgggctttcctgagtatgcatacagtcttttatgaagttcggcagagcatttatctcggtaggcagttgtcccacccctatgtgtcattttggggttcacagcacagcgaacaacaggaacccaggcccgcatcactggagaccagatctggaaaggccgtcgttttgtcaaagagtcggtggctaccagcttctgtcacaaccgtggactttgcatgagtgatgctctcggaatctgtgatgtttccagtgtgactccgagaggggcagagagcgctttaggattgaacagaaacttcctctctcctatttgccacga

SEQ ID NO: 3414 - DNA, 4340 bp, Toxoplasma gondii
tgtctcgctgggagtcttgttaacgtactgattggccttgcttcttcgctcaatcatttgctttctgcgctcgtagaagtccttgagttcttcctgtgcaagttctcgctgttcacgcttgagcgcttcctcctctcgcctccggccttcgacctcctgcctcagttgctcctgcatcgcctctgccgcttggcgtgcttgctcgtcgatctctgcctcgacgcttccactggccatccttggcgcctgctggccgggcgcgctctttggaggctcttcgtgagtggcttcccccagagggctgtcctgcggcaggccgtacacaccgttggcctgagcgttggggccgacgcggtcgtcgaagctcgtgtctctcttctgcgtcgcatcgctccctgtctgcagagacggcggcgaatacccgtcgcttacttctctgttctcccggcccatggcaaacacgtcgttctcctcgaggaacgagtcgttgacaggtggttcctccgcgaaaaaggcgtcgtcgtcttgcggcgagctgcgcacaccattcaggcagccgtagtcgttctgcgaatacaccgaggagctgacatcctcatacccgccgctcccgctacttagctgcggttgtctttgctcatggcgcggtgaacgcgagaaaggcgacgaggcgtcagcagacaacactggagcgttcagcgaaaggcccggggaagacgtgaagtcggccatgtcgccgaagccgccgccggttgcgccgaagtcaccgtccattttgctggaaagggcagaaagtcaaagaaaatcgaggaggaccaacggtgaagagacgaaattgacgaacggcgtaccggagccaacaggtaggtgaaacgcggagtgtgccaacgtgggaagcgaagaatgcaagacaactggttcttcgccgagagggaaaaaacgggattcgctactgcggaaaacggaggaacgggcaagcggacgtgcctacggttccgaattagagataatgctgcatctgaggtgggaaatatccgttcgaagagaagtcagagtgaaacgtaaaggatactcgaacggagaaaaacagcaacactggaggaggtagacacggggactcagcaagacggcggtttaggtcgacgcaagcctttttggcttatgcggatacgcacagaaacacgttttcgaagaccctgaggaaacgtggtgagaacaagagaactgacagaacgatgacacagtttgcggtggcggagcacggaaacaagaaaaggcctgctcccggaagtggctcggcgatgtcacccgcgaaattttcgtccagagccgaagggacgagaccaaaaactggacggctcgttcgttatgtagaaagcttattatacggtgtacgtacacccgaaaagtttgcggatgtgcagcggatcatacattcacgagacagatggatttccccgacacacgctccggcgaaggtaaaacagtggagactcgggagaacgctccaagacacgaccctctctccttttcttttctccacccaggaaatcaggccttcattgcggccgcttttctgacggccgtgtgtgtgagtagtctgctgtcagtgcgtgcgcaaaaccaagcagaaaaagaaccagctttctctcggtcatggcttaaaacccgtcgcgcgcgcggcccagacgcctttccctgttctctttcgcaaaaggatacatacacttcttccgttctcacttactccgctttgggggttttgtcggcttaaaatcgaagagagcacgagcgcgcgcaaagcctctgtcccttgtggtctgctgctcagctaggactttcccgccagcctttgtcatcgcagtccgcagtcggtgttgcggtactggtttcgaaaatgattccctctcacgttcgtcgacatgactaggtccgaatgcttcagttataacacggaggcgagcacacagaatgctcctgtagtttaaggaactcgaaacaactagagcaagtaccgactcacagatgctacccccctcaaaccgtatcgctccgcgaggttcaactcttggcggttttgaatccccgtgtgcgggtagtcacggaagcacggagggaactagcagtctaagagaggtgatagctattggaaattcgtgactttataggatattcagaatgtctcgactcgtaggcttgccagtgcgtacgagattcctgccatcgcagccgcctcagacgggttaggcgcgtctcggttttctacacattcagggaaatccggcgccttccatggttaggtgtgcgttgcaccactttccagcgtttctgtctaacgttttttctgatcgccgaaaacactggctttctgtgagcagttatcccgtggggaggcgcccgctcatctcaacatccgcggtgtggcgccgcagtctcgcgacctcaggaaaaccacgttttccgcagctcgagaggagacctgaagacaggcagttccctacatttgttcacctcaccacttcagcaagctctaaaatctgtcttggtagcagatacactgcattagctggtattcggtggatccggggcgctccggaactctgtaaaactagcgcgactcaccagtcgagatcccggtgttacggggcgctgcggaagtggctgcagcttttgcttttaccgaccctcgtagtgaggctatttcttctcttcgttgctgcaacagagagagctctagcgttcagtttcaacattccgcgaactgcggtctgttgtggcattttcgtgtcgctcctaaaaaggggggtttcggggtgtgcccgcagcgcgcaaggtgtcggccgcggtgttcgtgggtacgtcgggcctgcaactcttttcgctttacacgcctgattcttcgccgtaccaaattgataaatgagaatcacatctctcaaacggatttctttccagtttgtgggcgcacgctctgtactgcttccctgtaaagctagaaacaagggacaggacgcatttgcccccactcaactggtgtcgcacccagtccaagtctgctgcgcgcggagactggacgatgctttttccccttctgcgttttctgttgaacgcagtgtttttgtgtcgtgtcttcaagcaagctctcgttagaaaagtcctgttcccggggtgaggggtttttcttgctcggaaggcgctggagggaagccggaagccgcgattcgccacatcagcagccggcgcggaactggcgggacactcttgtgtcaactctctatcccttcgcattttctcctcccacgacgatgtttgcgtgtccagtgtcgttccgtgcggtcattgcgtgagaagaaacgaaagaaattcccgtgaacgtaaacacgcgttttccatagaagttgaacatcggggtttgccgtgcgcttcgcaggcattgcgtccaggtcgatggaggaaacgcgtttttgggtatcgaaaggaaagctgcgttccggtggattccccggtgattcttgttgtcctttcgagtaggccgtgtcaaggctatcgctttcgcctttgtcggccgagacacccggtgcgttgcgttccacagcggctcgagtccgcgcgcgcttcctcgctcctttttcccgtcgttgcgggtatttccgcacgcgttttttgtctctacagagcttcgcttctcccacttgactttcggcgccttttcgagaggccgaaattcttcttctctgcattccacgctactgaaaccttttttcttcgccagtctctctggccaatctcccgcgttgtctcccgcccgcctcgcgtgtgtctccgtcgcgcttcacgccttccttccttcactttcccgatttctggctaattcgcgcgccagacgtttgtcgcctctgtgagcaacccccgctgcgtctccgcttgcgggcaacgcgtacatgctttacgaggttctcgaccctttatctccttccaacccggagactgtggcctttctcggcttttccattgcattttgcctccagaaacgtctgtctttgcttctacaagcctcttctcgcccccttcgtgctggggattgcctctttggggctactcactttgtcatcgacctcctcgtcacctgtttcgtgccatcggtgtcgcgtcaaagcctctctctctccgtcgcgccacaaacgcgtcaaaaatgtctttcgcttgaacaggcggagtgtcgccgggctgctgccaacacagtttgctaccgcattgcttctgaagccgtccgtcaacgtctccgttctcgccgtctccagcgctcccgcgtccggccgtctcttcgtcgcccaccacga

SEQ ID NO: 3415 - DNA, 3197 bp, Toxoplasma gondii
ttaatgaggagaaatgacggacgtgaaggaagccgtaatgactcagatggggttgacagtgccgggggggacggagttcgagacagcaactctccctgattcccctatagagtagcgacgacgagagctgagctccacgcatgaggctccagtcggagaagcgacagggcgcagaatgtttggtgtcaagcggtgcaaccacgacgcgggattatacctgcagcgtttacatacgtgagaacatatattcaatgaaacccgaaaagtagcctacgacatggaggatacagcaggacactcagagagcgaaaaccgtaagacaagcacgacaaggcttgcgggaggggattcatttggagcaggttccataacgctacaggagagtacgtgagggtccgggaactgaagggtagagttgtttcccctcttcggtggcaccgaagcaccgtcgggcactaataaacttcgaacaggagacagattatgcgattcttcacgtctcggaaagaaaaggctaaaggagggtgctactcttgtacgaacggttgaaatggaatgagtgttttctgcgtcgcgcttcccgcttgagaggtcctgtaacgcgccggggccagcgaaagataacgcccctctctgcgtttggacacacagggatacgcgagcactcctagatgacaggaagccagccaacaacggggaaaacaccaagtacagatggacccgagcgttcgaaagtccagcgtccgcgctggggtaccccgtgatgcaacagagctactgatcgttcaagagctctctctgcatacgttgcggggaggacacagcctgtcaaaatgctggcaatgccaggattcgtccacaggtggtttgttgcgctcaagctgcgatgctaacatatataaccgagtatcatcttatacgcacaaatggacataattaatccttgtacggttttgccgagatacggcagcgggggccagcccttccgagcttctttgcgacacccctattcacaagtcctgtccagtgagactaaattcgcgcacatatggagctcgcaaacaccaaatgagatggagaggcgtgtatggcaaggtgaaaactgaaaacgtggccaaagcaaagaagtcgaaagcagatgcatccctgacgtctgcgcggtcttgtcgctcctccccacgcactggacaggttattggaacgtcactggtgaccacactccctggtgtagttccgtagcaagagctcatccgagtagtccaggcacgcgaaaagtggtacagtggcaagaaaaaactgggttaccttgaatttcaagtgccgcgatatcgatttcacagttgagcactcgcgtcatgtgcgttgagtgttggtcggcgtgcatggaccacagagccacgcgcagccgatttttaagcggaaacaagggagggtacatgctggctcgacgcaaaataaagtaagtcaactggtgagccaaacagacagagggactaaagggtatgccagatcttgggagacttttcgcaggattcgagacttcgagcccacttggtctcatgcatctgttgcgccatcaaacaaccatgtgcgcattacctccgggctcgcgcttgtgcgctagtcaagctgcacgacccgctggtctcgagttcagcgactttgtcgtttatatataagggtcctcgtggcagtatctcagaagagacgaaacgctaaactggaggcaggcatattctgcgagactggatttgttcggtgttccagccctgatccctaaacgaagcacgcctgttcaacgctgtgtgcctaccatattcgtaggctggcacaaccccgaaacaacttggcgtatttcactttttttctccagtttgaaggaacgaagatccgcgtacttggcttagcgttccgtcttgactgtaggacatcattttcgcggcacgacctccgtgtttttttttgttttcgtgtgactcatctctgtatcaacattctccggaagcagcctcagacgctcatcctgaggccctgtgaacctcggaggcagtatagccaacctcccattcctgtgaaccgacacccttaagcgcacgtagttccgccattcttccgtccttttttcatttcatactgatctgcacatattgatgtatcttcaggaaataggaggtccatcttactcagcttccgttggcgcctgctccactctcttcctcggctcgcgccaattcacagcggcgggtcacccgctggtacgctgatcctatttgcgcttgcctgctgcgctcatttcagacgggaatttctacgttcccgtgcatctgtgcaaaggacattttatgcacgagatgaactgtaggggcgacatttggcgtggtttccctggctccccgttctacctctctgcttctggagggactcgtttcgattacaagttaccttgccactttttcaggtctccgcgacgatttttcaggctgtattcagacaattgaagtctattctcccacgcagctttccaccacctgtgtccatttaggtttgacgctcggtgggatagcgttctctggcgcctcagctggctggacttaacagtctgccctttggttccacgtctgttggcagccaattcatattcagcacttgtccatcattttccaccgaacacatactgtcagtctatttcttctgtttcacgttcgaacatattggcggcatccttcttggtttgtccgcacttgacgcgggcctcaaccatccagaccatatgctcatatacatgtattgtgtacttcaatttagaaatgtgatcttgagaaaggacttttttaaggggcgaccatcacgaattctctttccccttcgtttgttggtgcttcgatagccgtgcttcctcttggcagcgtctgttcttctcattgcgggtgaagagatttgagtcatatctttcgccgctatgcctgtttcttggagcgtgtgagaacaccgttgcgcgcgtcatttcactctccatgggtacggcacacatctgcttcctcgtgattgcagtcgtccttccctgtcatatatctctgcgaaaagaaaattacctttttattccggtctctctcttgcattcatttgcaacggtaatcgtgtgctgggtcttgtagagaaagattcttttcaaccctgatcgtcgaagcctgagttta

SEQ ID NO: 3416 - DNA, 2680 bp, Toxoplasma gondii
ctgggacttccttctatagaccacagcgaagaagggaaggcagagggggagcgggaggagaaagaagactcggaagaagaggcagagactcctgagattggggaacgagattgaggcaaacattccgatgagagatgaggggtaggcgacgagggagacgcatatgttacaggcgaagcggatgtgccagggaaagaagaatgcgtagaagaagagggaaactcgcaagagatatgtctgcttccaagtcgcgagccgcgcttcggccgcctctcgccttcgcgcgcccctcctttcttcgaggcgttagccgagaccacccaggtggctaagaggcggcgagtaagctcctctccggtagaaagtttccgctctgctggagattcggaaactgcctgcggcagcctctgtggcgaaggtgcacttgtggtagacggggctgagggaggcacctggagggacacagcgagagtggaagacggagtcggaggagaggaagggggtctcacaggccgcgaagaagacacttggagcgtgcggtaggacgaaggagagagggggagagagtcgggaacctcgagagaggcaggcgagagggcattgcgacacgaagggtgttcgagggaggcagagatgccgcaggacgggtggggcgtgtgagcgaaaaaagcgaccgaaacaccacgggccgaagcctcatcagatgccgtgggtgagtgaggagtagacaccgagaacgatgtaggtgacgaaattgtcatcgccatctttgaagtcgggttttggctcatttcctacagggagacccgcactgtcgagtccatgatttagcgtaagagacaaaagcgaaattgttcgtaccgtacatgaagagcggcgagtgaacgttccacggaaaagggagggcttttgactaggcgtgcattctcgaggagcggcttccccgtgaaacgtttgctaagacactgctgcaaatacacgcggcgctgtgtcgctgaatacttgccaacttttttattctatctcgatatgaagcctttttccagaggaaacctcggcaaggcttcgaaagtggtagctttttcaggtcgctgtcggacaaagggcggaaacggacaagaaactgttcgcagacgatgtttgtggctgagaaaaacgggaccagggaaaggtagatacggtcagtgcctctgaacaagaaagaaatgttttcgagacttgacaacgatggaattcataacggctttgatgctgttttggaagcggaaaaaaattgtaagtcacaggacgcgtcgatatctctttcgccaaagagtctcacacaatgacctagccgtgtgtgtccagctggagcgcgaagagcctcgagagtacgcagcgaaaaaccggaaacaggtcggtgactgcacttttaagtggatgcttggaagaagggtgccggtctcattacgagagaatgagtgtttgtcttgacgaaaatatcttcgacgacttctgctagtgcaaaactctccccgtgccaatgtctgtatacgcgccactgttgccttgccgacttggccccggttctcgggattcgaagcacgtgggtgcgcggtcgatgtcggagcaaagcttcaagcagcgccacagaaaggaagctggccgttccgttctttcgggcatccctgcagcaagttttctaaacagacggcaaggtgttctcaccggtagagaggctggccactaagacaagtgtgattcatctgagcgccgctcgaaatgcagcgagagcgaacggcctgcagaggtgtagatacacccgaaacgaagacacgcagcgcgcagttttgggttttgtgtggctatcctaggatatcgagacagccaaagcatctcaaaattcgggcgtttccggtgccgcctacaaatccagcggcctccacatatttcggcacgagtgagacaacacaaatttccctgaaagtcactctttgcgtctcgcagcctgttcgctacgtcacctctgtcgtttcgctgcggttctgtcctgcggtgcacctggccccacagagacttgcaatggctccgcctcgacagtggccgttttagacctgcaatagcaaggctcaacgcagtttcggtgaagaattgtctgtcgtccagaagctgcgagtctcaggagccttttgattccaggcgacatccaggcagctgcgattgcaagtccatccgcgatggccgcgttcttagcgacgactactgataggcctgataggcctatatccgcttttgttacagtgcaccagcgctagccagaagatgcatcgtagtcgataagtatgtgtggaggcagttgctgtttcggttgccatagcaataaacatttcggaaggcgtgggaggcggttcgaggatcaactgactcccataccacatgcgtctcgacagaaaggtgcttttagtggtgaaagaaacacggaagagatgtggtcagggcgtatgacatgcggtcagagaaaaatgattcgccttccttactgttgctctacatgtctcctgaaatgaaacatctgcctcaccgccgtacctgctgtggacacaacgttgaggtggcgtcacagaccgccaggaggggtccaatcagggaatccaccgcgttgtgttgtacttgaaagtattctctttttacttatgtaaga

SEQ ID NO: 3417 - DNA, 3013 bp, Toxoplasma gondii
atgaagatacaggcagaccgtcttggcttttgtccttgacgcggcccgttgtctttctgcttagttccactgtctcccgagtactttgctgtgactcttcagctcgagatcgagagctgtcagagaagtcgttgcggactcttggcgggtctttgctggacgcagacgactggagactcctgggatgcgaggtgcggtcgcgaggttcagcttcagccttttcccgcagactttcagggccaccgagggcgcccggctcttcgcccagcacactttgtccttgtccccccatgtttgaggagagaccggaagcggagcttcggggcttcgcgagcgccggtgcgtccgcgtcttcctcgccctgaggaaaggccgtcggctcgggcagttctctcttttccgctccaggccgaccacttttctccgcctcactcggctcgcgccctttgcggcttctgcgcttccccacgaacgtctgtagactccacggcctcatggcggccacaagcggaatgcgcttttgacgcggaggcgacgcggaggagcgcgggagaaggcggaggcggcagacaaagtcagtcactcagctggctgcgggaaaaggagaaaagaaggaggagccgagggccggcggaactctcaaacagggagagtggcgaagagcttggccgaaacaaaagaaacgaaaccgaaagagcagaaggcaggacataccctcgggaacgccagagacacgcagcgaggtgcgtcgagaaggtcaaggaagctcgtggagacagagtcgaggttccagaaggaggccgagattttgcagaagccgcgatcggtcaaccactcgcaacctgaaagccgcggccttttacatctgatcctcttcatcgacacattccagtggccgagacaggccgacgaaacctaaacgacatgaacgaggagttcaatgcacagctacgcaggacccagaagacgcttgcaggcgatcttgtctcggaggcgatgacaccccggagcgggcgagagagttccacggcaggaatcgacccggaagcgcggctgcttgtaagacaaacagagagcggcatagcactcccaagaagtctgttccagcaactatacgcgtatgagtccaaacgtggacggacttgaaaaaatgaaggagagcctcttgctttggtccagggacccccccaaaacagcacccttgtagcgcagaaaagagcggggtacgaaggcgtcgccctacagcagcgaagaggatctacgaacgcaccgctctattcgaattcgtgtctgcacaccgaaagtactctcacacaataaacagacacactacaatctctacagagagactgactgcgactcccgtcacgaggtacaactggcgaagtctgcttgggcgctacacgcgccgcaaaaccacgaaaagagaggcggttttgcccgattttctcgccgaagcggtgaagatccgccacgagtctcgtacggagccagcacccgaaaaaattgaacgactcgggttgcctcctcagtggcgagaaaacgcatttcgatgaacaacggcgacccaaaaaccacgggtgccgttgaagaatccagcctcacacgcgggagcttttctttttcaggctgacgcaccaagtggacagagaagaaagtgtctttgaactgcaaaacttcttcaactgtttccctgggtctttctgaaccgaatgcctggagaagcgcgaagcggaggaacatcgacgcctcccaggctctccgccagctttttttgtagcgcggtgaatgctaccagaggaccctcgctcccagtctcggtgtgtcttctcagcgtctgctcgttgtctttgatggaaacacacagttcccgttttcttctccgggcgaagctgcatttgtgaccacggaaatcctactgaagttgctccgttcacgaaaccagcgctggtagctcgtgcgttgatggcactttccgcttttcagcgaaaagccgctgggcgctcgacgaacggttgaacgtgttagctgacgcctctcttctcccgggtacgttgtggccggcgtgcgttctcctgaagaaaacacagggagacttgccggttctgtggaggctatcgctctatagaaccgcggaaaagaagcagagaaacgagacacggagagaatccggtacccaggacaggcaggcgttcttggcaccgtactcgggggaggaaacgcgatccccaggttccgcactctccagtttgtagaacccgttggtacagcagtcatcaagaacttggttgccggggcgagcacaactgagttccactcagaatccgaggcgcagcaacagtccagaaggtcacccgttttgtgcgccaagaagcattcaccgacatcgtttcgagaaagccagttacggttaccgcagttcttccggcgatgctgcgtccttcgagactttctctgcttgccagccttctttcacgggagcaaacgtcaatcacgtcgtttttcgtgcaaggttacgccgtggagtctcgcccactctagccagcttcccacgtgtgcagccacgcggcccgatgtacatacaccccactgcgtgtgttggcttttgtctgcagtttccgtgcaacattgttgatttccgaattttcttggcgggtgcgtttggtggcgaaggggtcgcgtggaatcgttggtccaagtttcagcagtcgccttgtccgtgtctgctcagcgggcgtttggaacacagtgctcaagattcgcgtgttcccgcgactgggttttaagtgtgcctttgcctcaatcgaacgccgtcttccgccttttctgcgagccttccgaaagagtctctgcgctgcccagtctgtcagacgctgcatttattagacgccgaaagtcagccccgaaaaggggttggcgtgggctgttctgtcgcttgtcttgtgcctaccgtacgcccggtccgttccgcggttctccttttgttgtccgcgggtcccaccggctccgccga

SEQ ID NO: 3418 - DNA, 4734 bp, Toxoplasma gondii
ttgaaacttcgcagttgtggtaccagacctaagtacatcgaattcctgtttgaactatccaggaatttttgaaaacacgtgcggtggtatttactgacgtgtgcggcccatatgtcagctcaatcatgaagtgcgccgacagcggttctcgtctccgttcctacaggtgcactgagcggaggcgaaacggactgtagcagagcggaggcgaaacggactgtagcagagcgcaggacgagctttcaattttagaatcaatacaagtgcgttttaactgctagtcaaacactcctgatgtggtagaactctttccgcggagtcgctggctaagtccgttgatcgggcggttagaggcgcgtttttctctaaagcagtaccgatagcatcaaggggacatgacatattgtttctggatagatgacgtgcccacgtaccgtttctcagtctattgtttctcagtacacagcatgctctggcgagagacgcacagcaataggggtactgtctgacatgctggacatgacaacagccagtattccagtgaatacacctttcagcccaacttcatctttgcgtccacgcgtgcactactctgttacccgatacgtgcgactggttttgtgtatcaaattactggaatttccgagttacggtgtatcaatcttaaacatagttggtcttttgtagaagacacttcggaagatgccggtaaaaggaagaaaccactaaggggtggtagcctgatgtgattggatgccgtgttgcatcctttttgatcgaagcttagtggacaataatccacgttacgtcctaattctatgttacacgctgtaaaaacggattcctaggtttctgcagactgtcttttctgaaaccgaagtaggcaaggagccaactagcgaagcacgcaaatcgtgtgcttgcacccacgataccatgttcccaaaatccgaaaaatgtaaatcatgaacctgatgacgactcactagtgaacagggcatggtcctttgtgcctggtgcgtacaggaacagtttgttgatgaatcagttgttcgagggtaccgcgtgtctgttcacccgattcggggaggaaatttctataccagaaaaactcaatgcatgggaatgccgggttctgcttgaatgacaagcagacggcacaccaggatttgtcaggatgggttgacagcagcatgtacgttcttgcggagctgcaggcgacggtgcaggctgaaggtctagcgaccgttcgctgggaccaatcactggtggtgaccgtgaatttcgttcaaagcgcattcggaggaagtctgattgcgtcatttcctgcggaacagagtgctcccgcatttcgccgagataacacgagttccgtgaaaccacagagcttctacgattacccgcggaggtgctcattacacagcaggaactgtccatgacgcacatatgcatgtggttcacatatgtttttccggtatagcgctacctccttgctcactggagcgggtcatttacctgcgtatttacacaaatgcactgtcagccaactgtgtcagcaacttctactcatacctggacatcggctgtcgcacgccacaacgtggcacaggtgaaattgtcgtgcaagcagctttggctttcagcgggcgtgaatcttctagccacagaaccagaagggagcttgtgtccttgcttcacttctcgaagtatggcatgaaaagtggcctctttttcattgctttgtaaacaaggttgctgggaattcgctgacagagaaaccgcagtttacgtggagagacagcagatgcacacagtattttcaaatgtatctcggacatacacaccgatttgtatagtgccttcgaataacaaactggtcatcgactgttcgcagaatttttctgtgctctcgtagacgcctgccgtgtcctgcagatttatgtaccttctctatctagaaacgatccttggcaaaacgaggggatcagccaccacactctaagtaatcggcaaccgttcgaccggagtagttctctgctcgccagagagactctaatgttgctgctaagcagtgacccagttccgctgatatgctgtctcgatcagtgtatcactcatcaactttaaatcgtctccaaacaaggtttacatcaactaggatctgtctagttctccgtttccggaaaagatttcatgcacacgtaagcttcacatcagcgggccgcctgggttctttgctcaggtaacaaacttacacccgtcgcttttcctcttgtcctatgtaaacacgacgctaactttcagatgtctggttttctggtggttgaaacgacaggtggtaatacttccagaatcggcactagcggtgtgagcgaagctccctctgcttctttcgccggcgtgacatacccgctcgcaccacgagtgcttgatcgctttagaactcttgcacccctcagcattaataattgctgcttcctgtaactgtcagcgtctaaatttgaaatttgaaagctgaactgtttatctgatacttcgagaagtcggcaccagagtcttagatatctagttgaaagacttgacaatcccaaaaccatggtgcccaacggtgcaaagcctcgacttggcgaaggagcgactcagctgtgcaacggaagaatagacgaactgagatacgtgtttcgcagtagtgtcctgattcacaaagtcctcataccggcgaatgcttcttctgcctgatgagtcacacctacgttcttcgttccccttgtacggcggttccgggcagccgggcaggtttggggcaacgacaacttagacggcatcgttcgataaattgctttcaccacagtttctgagtgacagtcaacagccgttcataatttctccgtcatttagcttcatggcggctatgtggtccttgcaactgcactgatctcctcacaatcctgttgaatagcaaattcctgtttgctgttctttcccatcgagtacgccaaagtgggcgcacactttgttctgcgacccatcgacctcattcgcttaatcctgcgcagtgttctccatctttctcggtttcgttcttgcttgctcaaagggcaagatgcccatccctgaagcttggaatatattcatgaactcgagggccacttctgccaaaaatggtgacgcgtgtcgcccactatgacgtgtgcctcggctgcagagactgtttaatgaatgtctcgtgcaagcattacgcgcagacggtgcggaatgctccggcaaaacagaagataccacgcgcaagacattagactttaatggaagagtgagacatcaaaaaatgttttccgacaggttactgtggaatcctgatatgttcctctctgggcgctcacttgaaaccacgttgcctcctatttcagcaaaacgcctgttatccgtacaagtcagtaaccagaacagaccggtgagttgagaggcaagatgttctgcaaacacataatggtcaggcaccttttctctgccttgggaaacaaacaagaacgtcgcgttcgtttttcccttcagcgcccctgtgggatttttacgctgttgcgcgggcagcgatgcttctttgcatttacctttaaagcttcgtggaactgagagattcacaatcgaaacaaaagagccaacacaagctattgatcagcgctcagggacgggcgtgcctcgtcaatatgtcggctgcctctactgcgagggatttcttgcacatcttccgcaaggccgtgtgaaactgtaggcctgtttgggcccactagtcaggcttttgagtctgtgaacgtctagggcttgcttccttcgggtatgaagcctcttcgcaggcatagataatgaattttcagaatggtggtgtcctgcagtagagtgactaagattacgacaatatgaagttgatgaacgtgacagtctaaacccatgtgaacccaattctcgagctgcatgggaccatgagcatttacctcgaacttgcacagattctatagctgcgctcacacgaatgtagatttaagtacctagactcaggataccatggaagtatgaggatcctctggtggagctgttgaggctgcaggctcagctggagcccctaccggagcttttctgtgtacatctgctagctttcgaagatgaaaaactataactgcagttggtgaccgagagcggagcggtctaaaacagagcatatttctgactttgtgttcgctgcacgacaggagatgtaatgtgaacaagctcccgacctcggcactcttcagaggtctagtttcgagtataggaactgtgaattcctgcgtaagggtctccaaatcacattccagctggacccagatggaacagaaaagagtttctgatcggcccaacacagaaccttggtgtttgcttccgaggacgtctcatagagccgcagaggtcgcaggtcagagtgtgttttttacgggattattcaagacagcgaccgctgctggccttacagtatttcctgcctctcccggggcaaaacgggatacggatcgtcttgagatattcgcaatatggagctcatactcgaccgaccggaatgcgtggagggctgtgagggtgtcagttaccgaacaaacaatcaaggtgatgggcgaagggtgagcatacagcccgtccctaatgttgtggggatcgcagaaaaaccaaaaacacgatgttgtaacggatggacaaccttcaaga

SEQ ID NO: 3419 - DNA, 1998 bp, Toxoplasma gondii
cgaggactttgtgtggatgggaacagtacagtattttccgctacagtcgcgggcaagagaaagacactcggagcgatagacagaaaggtgataagagaaatcgtgtcgttgtgtgtggttcaggagaggaaccttttgcaggtcagcacgatagacatgacttgtgattcacggagcacagatcctgcggcttatttagaaaagattttcaatcaagttgcgtcccttactgatccagtcagttcgggtaagaccttttcgcacggctggttgccactcgaacgcggcgttccacgtacctggttgatgtcctttcagtgggcttttgaaaggacgaaagagtatcgatgggcctttctccacagacagaagaggcataatcggtgcccggacgagacagacacaactcgtcctgccgccaaacaggcccgacggaggcccggcgtcactgggagtttctccatctttagaatcgtcacaacggcgcttgctgggggacgaggagcccagcccgataccagtcctgcagatacacgggacatacaagaggctggagaggtgatccagcaccatctcggctcaagctgctcacgtcagtgatctccgtgtgtgattaggttgaaatgcccgaacgtggcgtcttaatagcgacagagtttcgcaaccagacgagcggatagtctctggaatggcatacactcagtgatgcaagaaacaattgcgccagtgtcaagaggcgaccgtcacctggatccttgcgagtgactcgttctgcgaaactttgcttactgagccacgctcagggggattcttctcatcgcgtctgttctttcggcaggacaccatcgggtgggggcgtgcgttactcaagcgtgtatgcagttgcgagcctcagcgatagacgcagtcgagttgccgtggcatttttgagcgctacggaaacgagcagaacgccgaaattcaacggaacgcagaggagggacggtccgcaaagaaattggagaaagccgtggccctgctttacacccaagggggaaaaatggggggaaatgggacgggactcaactcgaactgtggacagagaagtcgaaaggcaaaaaccaactcaaaaacgtcccatttgcctaagaatagacgcttccaagtgtatggatgaagatgaacagcgacgcagattctgtgacactatcgttttacacagtgcactctgacaagacaagccctccacgaaagcgaaatcccgacgacttgcatgcgaaataagtggagacatccggaagatatcgccttccaggttccgtagctcagccggttagagcgtgtggctgttaaccacaaggtcgctggttcgatcccagccggtaccgcgcctttcttgtcgcatatcctttcctcaagatttaattactttttccctagctgaagttctttcttccgacatcattgaagaattgttggtttcacaacgcctccatcacgacacgcgggcattccggcgcacggagccagcaccgacagtcatgctttgagaacaggtcactcggtgtccgttcgcgcgagtcttcttcgtacgagcctctgccacctccaagtgtttgacatgaaacgacgagacttaacccacacctgcgagcgagtgatgcacacaatcggattgggcattgctaaacgaataaccggattcgccagtgacggagcttgtggtgctgcttgtcttgactgtggcctgacagtcactgaccactcctgcgcgacagcaagtcaaataccgtgctggttgaaatgtcaccactcacatcctaagctgtatatacacccgagtcgtcattacaaaagcctcgtgtcgccgtgggtcccgctttgtctataactctgtacgagacaaccacactgtcactcaaaaaaaacgacctcatttacgacacctcgaaccatagttgcgtacgtgctttccttggtccctgttgttagattgggaacgccagctgttgtttatca

SEQ ID NO: 3420 - DNA, 4798 bp, Toxoplasma gondii
ttaatgtgtaataggcagtcgggtttcatctgttacttgattggtactgcatgcctcattcttttttctatggttctcgttcgtgggagaaagacgtagaagttgcattttaaagtgtggaagagagagtctagcttcagttgtcgtcttatgatacactcagtatatctacgagtctacttcagacacaccgtgttgctcttcaggcagctgcggtgtcttctcaatttctgctggcccaagagcggattctttctgttagtggtataatttttcatgctgagacgtcgcacttcaagcgacaccctctgagctaacttcctagcgtttgctttatctggttacctccaagaataaacgaattcacatcgggtacgaatccgatatagacgtccggatgttgagacactaacaaagagcaagcgcacgattctcttaagttggacggcgtacacgttcgtgcgaagcctgtgctaacaaatgccacgccagtccacacacggaagatacgtagatgtgtgtctgtcgtcaatcggcgtggcattgccacgtcagccgaggggaaggaacagtctctctcacggcctctccctcgttattcactgaaaagtgaacacatggcttttcgtagccttagttcgtttcctgtttccctttcaggcactgagggtcctgtcggacggccaggaccacaaaaacaaacaagcaacttgttctcaagcaaccggaaaccaaacatgacgactgaaggaaatgcgctccacactctaatatgtacttcattttgaagttggagaacggaatcattattaagctcccggtagaaacccgagacgagtttgctgccagtgagggagagcagggaccactgttttccgagtatggtggaattcccgttgaacggaacggagtggcgtgttgcgaatgaaacaattgtggcagccgttcttttgccggtggaatattccaaatggaacgcttggggcggaagaccgcacgaggggatcgattgtaaatgccgttcggttgtgcatgcaaagagtcaggtatttatactcaaaccaactcgtgtcgtctacgttaccgccacacaggagccgcaggttctttgttaaggggcagtttatattggttcacgctatatggaacggtgaatgattttgatatccttttagttaaggcagtttgacgttctgatatgagccctcctgcttttctagattcaagaggaccacatttgtcaaattgacaaacggaaactgatgtacgagtagtgtcacactgacgacgtccgggtaggcagtcggtcctttcagagtttgaatccaccggattaccgcgtcacttggaaaaaacacctctggtcttctggtttctggccgcttcgcaaacaacattttgcagaggaatgcggcctgacacaaaagaaaataatgcagggtcagcccttcccgtgtttgctgatggcagcaggcaacccgtgtgcatcacgcgttacggtctgaactgctgaagttgtaagggagtgaagagagccaataaagaagagacaagaaaagaagcagatgaattcgcgactgtgcacgcgtgcttacctcctcgtatcaccggcaatctcagttgcttccgactccactagaaactggaccccggtggaacggcctgtgctgtcagactctaggaccgagtcacttttcccgatccgactacgcaacgatttcgtttttctaccgtaccctctcgtcagcttccttttatgtcggagtcccaccctgaaacaacagcacaaggcaattcagtcccctggccttcggcgacgctggactgcccaccagatcacctgcctagaatttttactggcaaaacctttgtctcgttgccctaatgcttcgaatcctgccccagttgctgagcaaactcccgctccaccatggcacagaacggcggcggctgtttcttctccagacgactccgggaaggagaggcagtatatgcagagggatgtgtaggctgtgaatattgtgtgggttgtgtcacaggtgactttcgctgtaattcttcaccaaacctcgacgctgtatgtgaagcactgggtgccgtaccactgcctacgcacgtgcatgctgctttctgagaattcctggagcgaagttgtcacggtcaccacgcgcgttactagtttgcgaattgcttggcagagacacagaaaaggtcacccgaccagccacgaggcggtgtgcggttccggtgtatggacggctcgccgcggcagggatgtgcacgctggcgcgcagaagcttcgcgcggacactgcataaaattatgtccattttcttcccgcgagacggggtcgcggcgacaggatccgtcgcctttctcgatgccagttcagatcgcctgctccatccgcgctcttgcaagatcattcgtcgctttcgcgagactgttgtccgtcggaatgtcgatttctgttctggacgactccaccacacttcgtcatcgttacatgagaacttggcgccgttttctgcgcaaaaccctcgctgcagcgctgcagccgtttctgtgcagaagcgccgggggacggcaacacgcaacgttccttccgctccgtgtcgctccgatggacacggtccggtggctctttgccagatcgccgcgcgcgtcgccaaaccgaggtcgcctggcggtcgcattttcggcccgcctagcaactgggcgcgtggactgcgctgccactttttcccaacgagcaactgtgggcagagcgcgcgcgcttcgaaataaggcgtaagtctgcttccttttttctcgtggctagatttcgcaatttcatgcaaatgttcttcccttttccccgctagctcaggcatctgttgacgccgtcgcgcccgtcgaatcctaggctgtctgtgaggggcgtaaatgctgcgcctctgtgcctgtggagaactcgccaacagacttcctgttttgcagatttctgtttcgaaccgtttctgaggagaaggcgccgcagtaaaaaaaccttaggaaattcgtttcgtcgaccgtgtcctcgctaccgggtctcagaaggtcacaggggccacctctgcaaacgcctggcgtgcggaatgtgtccgcgcctgctctgtcctctgtgcgagaggtaggacaggttcgagagcaccacttgcaaggcgcggaaggctgtgaaatcgttgcgttctgagagggaagacgcttcatacatcgcgtctttttttaaacagctgagtctcgtattcaaaggcggaaccacgctctcattttttccctcctgcgttcgcgtcgcgaccccctattgcatccgggccggtcaccagcgccacaaacctcagccttgactcttgaagaccacggcatactggcatcgtgtgcgggcgcgaaaagaggggctgcgttgtcagcgtacttagcctggcaaaaccctccgtcttcccgccccccgggaccgtgtgcattctgtttctccggttccgcgccgaatttcgcctttcttgcctacgccttcaccaggcgcgaccttgttccgtgtctaggccctttttctgcgaaacttctggtgtcagtgagagggaatattgctgccacctttgaggcgctaaacgataaattccgatcacgtgtgcgcaggggcgttgtgccacgtgtctttcggagccgagatttgccctcagaaacccgggcgtgagttgcgtgagtttggggaacaactcttaacttggacgacgaccgattcagcacgtcttggaacgaccaggaagcatagcttatgggcgtggagaaaggcagttaggtccgaaactgttttcgactcgtccagggtctgctgactctaatacgcgccgcggcgtcgtctggtgaaggggtcgctgtgtcaaagcgtgtgaaagaattgacggcgggaaagaccaatctgggcaggacggctgagttttagctacggtttcggcggatgagtagcgagaccagagttgtcgtactaacaggaagaggcaagcatttcgaatttttccggattctttgcacgcgtcgctttcccttttcgcgtagagcgcttgaagctgccgacagaatttcctgcaaaacgccattgtttccgctttttcaaccttcgagtcgctgggctatgctgcggcgtcctccgggacctgctttacatgcagccgcgcttcgccactcgagttagcgcgcggcgcccccatcttcttcttttttctcctcggcgccgtgtcgtgctctcaaaacgtcgggcgcgtctgcatgtgtatgtacgtcgagtagctgacgattcgttttggagggcatttagctgtgtgagcagactccgcctctgtggccccgagacccgtgcggttccgtcttccgggactggcgcaggcacgtgcgcctctcctggggttctgtacctgcagtttttctcgtaattgtttcggcttctttcttctgtttcagtgtctgcgtcttcacgcctcggtagatcttcttgacgaacaaccaactgcccttctcgaccggaacacctgcttttcagacgggacacttctctcaggctggcgccggcattcctttgcttgctcgacacccgtccctggttggtacgacacctgaccgggcctcgtaaagggagtactccagctggagcaggcattcagcatccgtcacggacgtgcaaggagttttgcttcctcattcgtgcctctgcaggttcttgcccccgtctccctctccttcgcgctctcctcatgtggatttctgggtgaagcgctcagaa

SEQ ID NO: 3421 - DNA, 4686 bp, Toxoplasma gondii
aactgtgtgagtcgtctggaagactcacctccagaaaacgcagctccagcagtacctcgaggcattgcggagaagaggagaacgcgaagcaagagaagaagcggcgattcgagagcgacaactgcgcaaggagacggaggagacagcggagaaaaagacggggaaaagaaaacaaactggcctttgcgcttgacggtgcgttgaaagggctgtgtccgtcggcctcgcgacgaatcggagcaaaggagagcgagaggacggtgagagagaacaaggtcgccaagaagacgcctcgaggaaaaaggactcgaaatgtttcggaacgaggagacagcgaacaagagagtggcgacagtgcaccctttctcacagaatttttttttcgcgattctcgccggtgtcttttcgtcagaacgcaggtaacgcgggaagcagatactccgaagaaaggtattgcgaaggacgccacaattgaacaaaaaagttttttttttaattgcacgcaaatcctgtggcgcagtcacgaggaactgagttgtcctttcagatcctatccgctaaaaagccttgtgaagggagtttatacatctgaaatctacttgtatctactcatatatacatatacatatatatatatatatatgtatgtatgcgtatatctgtgtaggtacactcccgtttctatagggcgtcttggtgcagatgccggcgccggtcagagagtctttcgcttccgcaggaaaatgtcttgtacaggacgctagcagagaggagaaaggacgaggagaaaaggttgatgaagacgagatcaagaggacgttggtgaggaaaaggaaagatggaaaggacgttgacgtccgagaactctgtgaggcggcatggagaaggggaaagacggtcgagatttcaaatcgaacgatgttcgttgcagctcgcgtacacacatcgagtgtatccgagactttacctaacgagagacacagaaacggagggggaagggaacctctcgcctgtcagacgaagggggacaggaaatgtgaggacccgcgacgtttcaaacgcgtcgcaagctccggaaatccgctttttctgacgttcttttgctcgccaactctccccgaaatgcccagaacgcatgcgcatgcacagcgggagtgaggacagtccagaatagccaggaagcaacaaacagacccttggcagagacctcgacagaaaccgaccaggtccggcaccttggttttcacggtctttgctcgggtcgacggcttccgtccgctccgaagaagatgtggagtcgcctcgcaagagttttcttgttttgtggagccgcagctgcgcggctgtgcgaagagtcctctcttctgtgtcgcgagactacttgctcgagcactggggacgccgaagcagccacagagcgcgtaaaaaaggatcttttccgacggcgattcgctgggagaatcgactgcaaggcatgagctgtacagaactcctgattaaaactctgcatgacaggtatttgaactaaaaagcgccgagcattttaacatttatcgacggaaccgtaagccctccccccctgacaaaccccggacgcgttcgcgccagagactcgtgtacacctcagggaggcgaagccaccagacgagagagcagttgaacgcgaattcctgcgtagcacagaaactcgaagttggactctgtctttctcgcttacagtttagctggcacttcgcttggctctcggcgtttaacgaaaaggcgcgcgtctcaggaaaaaacggtcgaaggtctctggacgcccgatttgtgtgcagaaaagcaccgcaggtcgcagcgccagctcactagagtaacactggggaaacagagcgatttgcggacttggtgaacgacagaaatgactgtgcgttctcagtgcagatcgacttttccacggcctccaacggagaggcgcttcacagcaggccatgcgcgactctggacaacgctgcccccctttgtggcttctctgctcttcaccctacgcgcacaaattatatggccgatcctggtgtaaactttaaacaactcctaaaaagcgtggactgttggcttcttctaactggaatgacacctgcagtgcctgtggcgaagaaacagccgatctcgatttacagggaaaggcactttcagttaagaaccggaactccgcatttccagtcgagaacgcgtatatgtacacatatgcattaataggtatatatatttatgcataaatatatgcatacatgtatgtcttctgcacatatgcgtcctagatggctcaagcatatgcatatatatatatatatatatatatatatatacttctatcctgtgtacatatgggaccagggtggcatacgtgtgacgtacatatatatatttatatatatggaaataattttcacaaatgttacgtagatggtgcaaggttaggtgcagatatgttaatatatatatctgtacaaatagatagataaagatggatttgtttatcctcatttttcaaatggaactagatggtgtatgcatatgcgtgaataaccatgtatatatatctatatatctatataaaaatatgtgtttgtgtcctctgtaaaggaagagagcgtagctggtctatgcgtatttgtccccacatacgagcaggttctattgcatactttttacgcctggaaaacgtaagtggtctacgcatatgcgtatacatatatatatatatatatattagtaggcaaggacggattttatgtagagaaggcagacctagcctgcctcggcgcctgagtagaatcctgcgtatgcgaggatccgtctggtcgtccagtgtgtgtggggtaccgagatgttccccgcgccggcactccccccggcgaggatcgtaacgcgcagaggtccgcgctgaaggaggcttcgcttgcggcaggttttcacatgatcaaaagtgactgttctcctggagcacttccaaagaactccgacttcaagggtgacggttttaaaggtcttgaatcccgcgcccggtttagattctctgggagttctgtgtcggcgggccgctgccgagagcgaggcactgtcagctggtcttcctcgcaaggacctgaggcctacattttccagtgtcgtctcgcgaagctgggtatttttttaaaagcatggatttgtctcttggggctgggagctgtgtgtcctcgttactgccgacaaatcccgcagaacttgcacgccgtttccctcgtttccacctgtctgtacgcagtttcgcacaatatcgcgggaacaggaggagcgctgactagcggccagcaggcccacgagtctccaagccccgcgaatgggggtggtgaagttgcgtttgccggtttgcgcgttctacgctcttccttccacactttgatgtccgtttttcttgccgggggaaaggagcctcaggatgaactgtgggttcttgtctaggcgccgaccctgtggttctagcgacgccccgcggcgctggagactccgtgtgtgatttcacgaggaattcgccgtcattttccgtgtgtcaactgaatgtgcatctttgttctccacccgtttcacagttcctgtgaaaccaaccccgtgtgtccaggcctgttccaacgacttcgcgggatgccgcgagcgtccagtgcacagatcacgcgaggcagcgcctcggtttagagctcttcaggaacgcccgaatttcaagttttaagaaatcaggtacgtgaagtcgtcgtacattgcgcttcggtgactctctgtggcatacagcggggacgagtccgtcactctggcccccgttgagcccagagttcttgccgcgcgcgctcgccagcttctgggtttcgctcctacaactttccagtgtttgtcttggcagaaaagcgcttttcgctgcgcttttccgtcgtgcgaatttcgtcctctctgcccagtcgggcctggggtgccggtctcggggtgcagggatctgaggctcaagccgcgcgcctttctccccggactgccctcgcttttttgattttccgcgttttggggcacagtgtcgtgacccccacgtagcgccgaggaagccgtggaagtctctgagtcgcgcctttctgcgtggataccgggatctttctggaggcagcaatcggtctccttgtttggctataggttttcgcttctcaccgcgggcaaaaaacgcagtctttgtcgttctgcctcgtgttgtccgcttgagcgcgtgccggcgtcgacgaacttccggctcctgcttcggctttccgcgtcgtctccgccgtcgttgggcctccacagcatctccagggtttttcgacctcggtcggtgcagagcggccaatcgaatccttgtagagtgacgagtcacacatgatacggtttcgctgtgtatccatcactgtgccatagttctgtcacaccccagtgcgattcgcgacttttcgtctttttgtctccgcggagaggtccacaatgaggcgcctgaactcctccacagctgctgacctgtcgagtgcggtgtccgcctgagcttcctcgagtcttcctccgcatgtagccttcctcttcccgcgactcgccggtatcctgtggagcgcgcgttcttcgcctttgtcaagttttttctcgcgttgttgttccggaaga

SEQ ID NO: 3422 - DNA, 3054 bp, Toxoplasma gondii
ctgcaaaaacgtgagcttttcagcgaggaaagaaggtgtcaaactggaaaacaggaggcgtcgatgtggaagggggtagggggggtaggggggtgtcacttcgtgcatgcgattcggtggaagagtggcgacgggagattcaagcaacactcagttttcgcgaaacactggatttcaaatccacgacagagtgcgtcgttttccccgcagcaacagagtgcggaggcacttggcgagtcgccatttccactaaatatttggcacctgaaaacgcgagaacctgaaaaactggacagtcgtctagtaaagtgtgaatcccgtgggaactttcttcctttaaatcttttctacaaagactggaattttgtgaagagagtcggctgttgcccggcagatacagcagacatcttgagttcacgcagaatcgtcatttctcggaacccagctcagcattcttctcgaaaaatggtgtgttcaaaagtagataaatcggtgcttatggatagatatgcatacatgccttcaaacactcgtacatgcagaaagagaaaacgtttgcgttcaagcagaactgtcgtcttttggaatccagtcaacatgccagacccgaggagactcgagagaaaagcacgcagttacagttggagaaactgtcgctacggctgagacagcaagctttcttcaagttgcacttgaaaacgaaccttccggaaaaagacgttgtcgcccgactcagagttccgtaaaggaccactgagacgcgttcgatgaaatgtgctcacgagggcttgccctggaaagcagggaggcgacagaaggaaagttgaaataccacgacgtggtagaagatgtgccaatccaccgcgaagccaaaacgagttccgcagatgtgttttctgtcgtttcgttttccgacgttctcttcttctggttgcgtttttttacgccgggacgtcccgcttcgctgtcgcctctttcgcctcttgttactccgtgggtcgacctaaatctacgggtggagtggcgacggtgtgtatcgtttacacttcctgggtttcatataatggcaataagaactgcagtgttgaaactctcaggagttcggttcccagctcagagattgaagatctttgttcgccagctctgaggaacctctagcctttcatggccactgtgcaggacgtttgccactcccatcgaaaacgcagagacatcgcggacgtcggacgcgcttgaaaacaactccgttgtccagcttcggaggaaactacgtgttgaagggagcacatgttgccgggttgaatagactgcagagaatttgtggcctaaacgagaagaggttcttcgcaaagcatgtttccaagaaagtgaaggcggtgcttcctcaatgcgacagcggtcgagagtgcaacgggtcttgccgctctggcgtgagcgcccagagaacggcaaacaccacattttccccagaggctgcatgcattgttcagatgtgctcaggagaccctccatctgtgaaggaaagaaccgtgaaatctgctttgagtttcgcatgcgttaacgcacagaatcatcaagtgttccggggtgctcctttcacatggcagtggaagctggctgacgacccttttagctttgcgcttcagagctcgagtctcagagctcagagagaaatcctagagtaccaaggccataggtaaaacgcgcacagtgccggcttggatctgctgcggggggggacttgacgtttttacggcaggtcgtcatctgcaggtcagcagtggtgtgtgtatccgagaaacacggaagcgattgtgcgtttgacgacccgaacggaatagaagagaaacagaggaccagttcctctgcagagaggtggagaagcaaagcttccagtgttccaaaaaaaaactcaacagaaaacaggcacatttgccgcagagtcacttcttcgactgactctgcatgccaatgcttcggcgtgcgtgttccgtagcgctgtacttctccagtcgcttccccgagaaaaatgggtgtgtagagattctatcaaccagttcttctctgggtagacaaagaaacatcttgtttcctgaaagaaggacttccagtgccgtgatatgcctccgtatctgtgcaccgcgtcccgctgcgtgaaaacgggagagggctttgcagccagtctctttttcctgagttattagaaaactgtggagagtcgatgactgaaatcgtgtttcgtatgagatctgcacgtgtttctctcttcgatgagacgggcatttgcagacctggagaacatgtcgagggtttgaaggagcggcgcgcgactcccgcagctcgccttgaaaaatcgccagtcctcaacctcccttttctccgggaatcaagagccgcaaggtcacatgcagactcttccaacgttgaaacactttctcgtctctgcgttgcgtctttgtctgtgaccctcgaaaccgattcgccttgctcccgcgccctgtgaggagcagctgtctgtacacccgaagacaaccgggaaaaatcccctcgaagcagcgacctgtttcagaccttggcgtttgatgcgcctctgtgttttgccgcagacattagggcgtctctctttgtcggggcgaagaggaaagaagcagactggggagagctgaggttcggagcaaagagtctgaagcacgaccgcgaagggtgaacgcttctccgagaagttgtggtctttgccgagttttgtagtctcaaggcgccgcaccaaggacacacgttgactttcagcggaaacatttctcagtctgctttgtttttctggatcgaaagagccgtttcctcgcactgactcagacctccggctggtgcccggcgaaggccaggcgttttctcccctcttttctgccctttcgctcccctttctgaaacgtgagatctgctgtgcacgctcttctcgaagttctggaattctccggcggcgattcgctgaggtgtctcgcggaaacggcctcgcgacttctttccagcaagctcgactgtacatacaccgcacca

SEQ ID NO: 3423 - DNA, 4882 bp, Toxoplasma gondii
ggaagaggaagatgacattcgcttgcgactgctagagtacgattcggacttctcatttgcgcttccgccgctgcgcctcgtgtctccgcctcgatcgcggcgagacgaagaagacgaagcgctttctctctctcgacttctccgacgctctgaccagccttcgcggccagagtaggacgcctccgtcccccccctgctcgaagaggtgccagagcggctgttgcgagacatcatttcaccctagagatacacgcgcgaagccgcacatggaaatcaagagaactttcaccgattgtatttgtgaaacgtgattagttttcctagccaacaccatccagttgcttgagaaccagtccctaaatatgagagagacaattcggatactgggcagtctccacgggaggcacagaggacaaatgcctagcagactgggaggcccggcgctagtgagggctccggagaaaaagaaacaacgcagcgacagggaagaacagaaggtaggaagctaaccgacgtgtccaatgacgcaggtgagggaagtaagtccgaaaccgcgagggaggacgaagcgtatgacaagtaacgcagttgacgagagaagccggctccgcaaagtgatacggggaaggcttcacaagagcaacacagaagagtcagaaggggtaaaggcacaggattgcgaggggagatctgacggacataggcgatataatgagagaaaagcggtctgtggcacacgtggaaagagagatactgggttaacagttgtaagaaagcgctgtgagaaaactccagaacaccccaaacagatggaccgccgcgtggaacacgagacagggagaaaagggaagcgcccgccacacacagaaaggcagcgaaatacagatgaaccccttatctgcggttctaaccaaaaaacgagggctaatgtagaaggaagagacggcggccgacgaagctgttcgacagtaaaggggggtgagaatcctgctggcgacttggggagaggtgcacgaaggacgggaaaacggagagaaatcaaaattcatgtgggagcggaaaaacaagggggaagggaaacggaatgcaagcgcagagactgatattttgagaaaaaaagttccggaaaaaagcagatggaccactaaaggcatgtagactcagctcgcgcatcgcatccactctccagcagaggccgcattcgaggcgccccagggggtgtacgtacaccgggattctccgccgactgaaaagccgtttttcttgtcttctcggtttccacagaaaacggagaacatggaagaggaaggcggcgaaagcattttgtcttcaaacgcaagatgcgcaaacgccaatggcgacgaaaaggaatcgcagctcgtccgttctcagggaacagcggactcagctacgactcttctcagatggagacggggaggcctagagaaaagatgcaaacacaccgtcgtgcatgttcgaccgggcaacttctcggcttattttcggtaagactagccttcgagttttgtgggttctctcggaatttggggctaagtcacttggaaacacgacaatacaaatccttggctccttcctcggcgttttgtacaggcacattttctgcttcttcgcgaacacggaagtagcacagtcgccctgtctttctcagacaggaacagagtcacagcggacagcacaagatgcacacagtcggccgggaaagtcggcatgcctcatgtatctatacgcaaatgcttatttgcattcttatgtacgcgtatgcatgaagtcaaatactcgtatacgcatggtcttttattgtcgtatcacacatttcttcatgcagagcagatgcctgccgtccatttaagggtttgaaaatgtgtacgaaaggtttgtcgcctatcgtttccagctaaaccaccacgtgcatttgcctctccctgcacaggactctcgatatcttaatctggtgaacatttcaacgaaactgtttgtcacgtctccagtgtccgctgtaggactaacagtccggcgtagagacaaagtcttcatgcacatggaacacttggatgcagcgacagctagttgcttttcaattgaacatcggttaacgcgaatttgcgttttgttctgtggcactctagagaagacaaggggtgttgcggactgctgccttgggttcctcaaacggcaccgtttctcttctcggcaataacaacaaccggacaatacaggaaaaagagactgccgaaagtcttgacccgaaccaaaggctttttgcacaccatgacgcttctacggttacaaacatctgccacaaatatatatatatatatacgtatatgtattatataggtggagaaagagacatacctatacatgcaaacatgctgcatatctaatatagagccttgcaaataggggagggaaatgcttgcgttgttcttgttcaaagtcctgaacgaaaaagctatgtctgttgcaaagtactgtcgatgctgaaaaaacagaaacgcaacaaagaccggtttctgacagactcgtgattgagattttcggagccgttctgccccttttccaaaacgacagatcgaacaccaagcccccgatacgcgagccaccgtcgttgtttctgtgtcggtcttccacctgtcgcgggtcctctaggtcgttgagggtaggcgaacgggaggagatctctgtactctttcgctgttccttgactcccttttttcgtcggttttagaaggaaacaatcaacgaatcgcgcctggacagagtacactattgtcaagaacaagggtcttcctggcgatggcagtgagcctttttgcttgcgagtccaggtgtacaatctcacaagagacgaaacaacagaataggtgataccaaaggggtagactcacgaataaccgaggtacactgaggatcacgagcttgtttctcgataactacagaagcagtctagtagaactgttaatggactgaaactcttcccttccctctgtctccataaatgcttgcataagaggaacagcgggagatgggactagtcggacattggcggaggtctccgctttttttgtccttcttttgtccctgctgtgtctcgatttctgatcacctgtctcgctgtcgcagtggcattgccactctttcgtctccccacctcatttgcttcttcgttctcttgctcctgtcatctcacatcttcttttcaccttgtcacggtatgtacgaacataaaaaaatgaaagatcttgtccgtatgtcgtcatccgttgttgcctctctcccctgttttagccctcattgtttcccgtcttgcaaagcagtgaaatatgtacagtttagtacactttactaaccttgttgcaaaaaaacggtttaaattccctcctggacgagtgcgcacgctaccagaaaattcgataaaaaataatggagcgtctccagctgttccactgtgcataaagagacacactgctgcacaaacgcagagctctacacacgctgccatgcttgtgatgcattccgcacataccagatttatggactgtcatctatccatctagctgaatgtctgtgtacatgcatacacaattataattacatagtgaggtttatttctacttgtattcgcaccgggtgacaatcgatgcgtgtcaacgaggcacttacgtgtgaaagactcactccacaaatacgcgtatctctagatactcgtaagcatacttatacgaaaaatgtccacttgatgtaaacgaatccatgtgtatcttcttccttttcctttttgtctttgtgtacaagtgatttttccagagaccctgtattggcatccgcctcagaaactaactagtcggagacgcacaacattgaatccaggttatcatcatcatttgacccaactgtcacctgtcgtttcataagccgcctcgtctactctttatctatctccacttctcactttgtcttaacacaaccgctggagaggagaaagggttgattggaggaagcagagaaagtcggaatttcacctgagaggacagatgcactctgctcgtaccgtcgtcggtctcgccgctctcgccgctctcgcccagctagctcgacggtgtcccgagagtgtgtgagaggattgtttccgggtttcccagcattgttgttcccatcctcatcgctgcgattcctcccacattgaaactccctcattagccagatcaacttttcttgatcttcatcttagccggctaatgggcttcattccaattttaacatgtcagttccatcgaggggagcaccgacactgaattcacgttgtggggggaccggatcctacaaggtttgtacctgaacgataaagagagcggacatgtcgagttttcttgttctttgaacgcaggcgaattttttttgcctcaattttagttggtttgccctctcgttgtagacaactcctctgctgccctgcatctgagccgggtacaccagtccccgatcccttctgattccttgggctcgtggacgaatcacgaaaaagactcccatgtgaactcggacgctcctgcaaacatgaacccaatttccaaaatataagtgttttttggactgatgagctgtgttcatcaatcttacactgcagtctctgtgttgctcctggcagtgccgttcatcgctgtgttcgtagcgtgtcgttggatgctagacggtaacacggaattctcaaatttctctagttaccaaagacgagaggattcgtcccgcttgtatgttttttccatggatcatgccagtgcgtgtttcctcccgcgattgcagttctttctgatagatgcttctattgtgtttgatacgtgtgtccgcagcgtatccaaga

SEQ ID NO: 3424 - DNA, 1461 bp, Toxoplasma gondii
acctgcgtctgcgggtttctccgacgaagacaagagaggagtcttctccttcttctgcagaaggcggcgcaccccgacactgatgggcaaaaacgccgcgtccagctcctccggcagtgtacagacacctgggggctctctgcgggtcggcgccttggtgagtggcgaggagcagacgttcacgaagtactcgagcgtctccgagatctctcgcgcctctccagcttcttcggcgccttctgctgcctcggtggagtcccccgcagggagttcgacgatcagtggcggcgcagaaggcgaggagacagagcgttcctgcttgctctgctgggggggtgagatcttcagctgagcacgaatgacgaagcctggccgagggcgaaacggtggcagcgaacgcggagccgcgcgggatgatgcctcgctctctgctctctgctctcttatcgtgcttctgcgagacacagaagaagaggaagaacaagaggaagaacaagaggaagaacaagaggaagaagaggaagaaaaggccgaagaagaagacggctggctctgtcctctggctgcatgcaattgctcttgaatgaaacgttgatatctttctgggtcactctctgcgaggtcgtcgagcgccgcccagagcgcttgagcctggaccgcgaggccgccggtcggagacggagaaaactccatcttcagagactgtctcttcgcctcgaatggcgacgaaacggaaactaaaaagcgagaacaaaggaggagatccggacgaagaggagcgaagacaaggacgaagaagagagacaacaaggaagaaggactgaagatcaagaggccttgtcaacggcgaccttccaggtgagaagagaggagtaggtgcggcatggtaaaagagaaaggagagtttttgagaaagagaaaggggaaggcgacgactgtcaggagggaacagaagagagaagaaggtacggagaatcgtgattctgagtgcactagtaggtatatggacgatgaagaggaaatagagaaaagagaaaattcgcgtagatgcgctgagtcgcactgaaacgctggtgcaagccacggcaaagctgtactctgcctgtcaagcatgcatccgaactcctcgtccgacgaacggcaggcgaaaagttaaaaacgaatctctcacttgtttcaggttttcatgttgtgcgtctcaccacctgttctttaaggtcgtttttctctcgcgttgttctgttctgcgtctgtgtctggagtcgtcgctccttacgtcaaaaacaggggcgtccctattcttgctttgtaaaatctttcattttttctctctcctttctgttctcaattctatcctatcgtcccccccttctctatttcttgtcttgtcttattcgcttccccgacttttttctcctcccgtctcttctcttctttcttgtctccgtctttgtaaaaaga

SEQ ID NO: 3425 - DNA, 3832 bp, Toxoplasma gondii
gaaacgataaactcgatcaatcagaacccacttccttggcaacatgcgtttgtttgaaacatgggcaacgcgttcgagttccagtgtgtgtttgtcatcgtcaactccctccacacaccctggtacagcttctttacaaaacaggaagaccgtaatcagtggtgaagcgaaccggtccacttcgttgtttcccacttgactcaacgaatcgcatttcccgtcagtgttttgcagctccagcggtgaagacaccggcgatacatgggcaacgaaggaattagtctaacaagacacattgtctatccatcaggtcctctgttacggactcggactcggtacgttttccagagaagcgctgaatccgcgatctgacctgtggttttgtcctttggaatttccagctgtttaatgtcgccgaatggtaaaaaggctgcccgaagcacctcctcctcaacctgctcggccaagcctccgacgtacaatgtccgcttcagtctctcttccccagtgttcgccaacagactcgtctgcccttgaaccggcagcattgtgacggataaagctctagaagacgcccaaagcaagaagaaaagctccgcacgaagtgctgtgaatttaaatacatggaaaaatgagattaccagacagtcttggagtttaagtgtcaccgccttgagaatcactgctcgccacaagtctgcaagtgcgttgcttgcagtgtcttgacactttgatggctttgtcctactgccacttcctgcagcgatttgaagaaaacgaaaaaggttatctggcgaaatgccgtaagattcaacaacaatcaaccaatagagaccgtttcagtatcgctctgacactggtccgccgccgccaagcaggaagttccctccccatatgcgaagttcagagccagtctttgacacaaagaaagccttttgcataaaaaagagctcgaggcacagtttcacgattgttccgattcgtcgaaattgcctttgtttctgttgttcaatacgaagcagctgtcaccacgcatgcgcgggaaaaccggcaccaggcagcattcgttcccgcttttaaatgtccacggcgtatgcagcgttcacctagattttgtagaagtcacgaataatgatgcgggaacgaaaatcaaaagcttcaggggtattcactgtgtgtcctaaaacaggattttgcagtgcgtgccgcttgttcaaagcgcccgtggttccgtcgctgcatgcgtgtggagtctcgacgattcgtagcgttacgtgtgtcagccttacgccgtccctgtgagctgccctgtgcagaggtgacttcaacttccgaactggcctggtgagtgtattacaaagaagaaatagagtatgcaccttttaacgtggcgtaagagctcagacgagtttcgctccaagcccattcggcgttgccgcctcaatgaaggcaacgagttgtgcaattcagctttttagtttgctcaggtatcccagtcgtgctggtcagttttaaattagcaacaatggtgttccactcgatgtttgagcactgggttacctgaagtctttccgttagggttggggtccagtagaagttcccattcctttcggtacaccaaacaagcagagctacaaatcaagaatttctggtcaagagcctaggagccttcgtcatgtgcatgagtgctgaatcacaagaatatgcaacttgtacataacgtttctgcaagtgcataagacgaaacagtttatctttgtgcaaagtgccgccctccggtagccgcgacatcccaatatgggggaccgtttccaagtttcagacgttactaccccctgttcgatggtccttgtcatactagcacctcagcagaagtttcctctccctgttgataagtggtaaccagaatccatatactacacctacagcaaaaccgctggggaatgtgtctttaaggcagcagaagcagcatgctggtgcgtggcgaattcctccagtggaaagaatttaggcgtgaagtcgccgcaactcatgagagtaacagtgctgatgtccaagtaaaacaagccagatcaacgatcgttcaattctattctcggttgccgccgtacttcaagagcgtattattattgccccgacaacgtggaacatctggcgcacatgctcccctacactcccgagaggtctggtgactgaccgctacattccaatgcagtctatcggttgtgcctgaagtgtggcggtgcctacaaagtgagtcggttgaggtcttctataactcgtttagcaggattcctccctgttgctgacgcccgccatattaacctgaaaagatagtctcattcttgcctttgaccaagcagagggtagacgctcgcctcaaaacaaggatgctcagtggaaatgtcagacaaaacccttggtggggggcaagccacgagcgaacttagttttgagtagatccccttgtatttttcaagttgctgacatgtttgtcttcctttgtaaccgcaacctcccaaacactaacggagacctccatccacatcttttttccgcgttctcgtgaaattggatcattttcgatcagcggggggaagctgcagtttggtacggttccggccttcacaaaggaacccaatccatactggttgacgcacctctctgttacacaaatacgcatttccaaggaccaattccagtagccaaacgaatgtcacgcgcagcgttttgcgccatgtttgttggcggtcaatatgcgcaaacgagagactcgagaggcggacttatgcgacacatctccccgcgttttgatttccctgtagaaatcaaatgaagttacacacggtaaaagcactcgatgtggagagagagagtccttgtctgcgtcgtgtctgtcagtgcccagccgtcacaaactgcagcttattttcgtgtgcgacacaacctgtgtacggaggcggtgcatgacacgtgtacaagggaactcattttttaacacggaaacacaacttcgtccgcgcgatacgtgtcttctgaggacctgtcaggttacgtattcgctttaccacagaggccgagcgcacgacacaacaaagcttttgaaagagtcacgtttgctggcggcctcttcgccgaccatctacaaaaccctggggccggccgtcagccgttcatgtgttactaaatcacaatcgggcgttgtgctggtggcaacagctcctgccacgtttccgtggattctagcaggcgcgcggcggttagagcaagccaggcgctgtgggaccgacaacagggcgcgggctagcgagtgaacatgacacggaaatacgtggctttcgctggaaatgagtttctgaatttgcatgtgttttttattgccaactagtacgattattggctttaacaaacgagaggcactgcggaactggctactcacttgcggcgcttggctgaaacgtcatgcgtctcggtgtcttgacgtgacattgaaccttgctaaaattgagcttgagggtttcctcgttttggatagtaaagactcatccgacgcaaaaattgcttcggcgaagttaaatgtgctttcgctgccacggtccaactcaagaaatcgaaaaggcccggtttttcgtcataggacgacagttccttcggccgaatttgttcggtgaacggggtcaaggtctatcctaccgcgcctgacaaagcgggctcaagaattactccccaatgtggacctttgatgagacgttttgtcttttacacgactactaaccgggaatcctgggtccgacagcatgaaaaatttcgatattcgatgacccctttcgaa

SEQ ID NO: 3426 - DNA, 4008 bp, Toxoplasma gondii
aaatgccgagaacagcgactttcgcctcttgcgcccaggcgaaaaaagaaggacacagatgcggactgcctgcctcatacaccgacgcagggcctccggagagaatcactgccgaaggtgagaaacctttgatttcctaaacaccacacagacatacaaatgcatacatgatcatacatatacacatatatatacatatacatctctatatagacatgtatacatatatatatatatagacatgtaaatgtgtggagagaagatcggagttttgaagccgcgtttacggaattgttgaggtccggtttgtgtggagtcccttgatcaggtgaagaggcaaagatctaccgattttttagaaaaaggtttgtcatcaacgcacagtctgacagttccatacgtttagacgagcttcgacacaactgcccgcctctttgcgaagttctgcttacttggagaccaatatcacatcgtctgagttcactgtacactccaatttccctcagtctcctgacaatgaggtgactgtattgacttccaaagtcgaggacgaggacgcggccgccatcgaactcagcagctgcgctgctgccgtcgcaaccgactcccgcagcattcgccattttgcctgaaaaatctctgcgttgacaacctctgccgcaaaacctgtcgttcctcgtagacaaaattgtccctgtcgcaagaatgaggggagagactcacacgaaacagcccagtggcaccacctagcggggctgcatgcaacttgccagcgaaaaaattcggcttgacgaatcttcaaactcgcgagtctctgcatgcgcggaagaaactactttgacaaaaacacctcaaagggcacgcgcttttgcatgcgacgcagaaaacgacgaaattggcgtcaagcggaagatttcagagtcacacagagtctcaggaacacacagactcggaaaagctttcctttttcccggcagagaaaggcggaacttgacaagagccgctgcgccgcttgcttacgactcaaaaacgatcgacaaaaaacgaggatgactggcaatcagacctgggaggaacggaagaggcacctgcttcttccgaaagagaaacaatttcaactcgctgaaaacgcatgcatcccacatgggactcaccgcgtcggagagacaccggcgactcgcgatgttcgatcgcatgcagctgcgaaagaacctcactgtgaatttaagaggttctggcgtaccggatcctagatccaatgggtgacgagagttaaaagaggcattattgcacacgcagaggacatgacgaagtcctgcagtttacctctctgctcattctcgcttcttgctgggcggggggagggatcgacgggatgggggaagaaaacggctctctccgaagccagacgcttacttcgaggaaccgcgtcgtatacctcactttttgttgaagcgcactgaagtttttttcttgcgctcaaaataccacacatttcaaacagaatggcctacccccaaaaacaaagagcgaacacagcggctccgcagaagctggacaaaacttcctcgttaattgcagagtccagtaggtacataccggacaacgtacaagcatcaatgatgcctatctctgcttctctctctagactgggtttatacgctgggtatcgattcgtatattcgcaaattaaaatcctcatccaaatatatatatatatatatatttctatgaatacatatgcgtgcatgcttcttggcatttctggacctcgccagttgcattttgcgctggggtgagaaatgccaaagttgtcggcttgcccaggccagaagtcaccatttcctggatacgcgtccttgcggacatcatgcctcctattacttgcacactctcctgcagttacgcacaggtacacttacttgcgaatacacagataactctctctctccatatatgaatataaatatgtgtatatatatatatatatatgtatacacatgcatatatgtgtatatatgcatgtcctcggggctgtgcgtcaaactcgaaatccgcatttgtggagcagcgaaatggagaaagcgaaatggaggaagcgaagtgtggcgacattgcaggctgagcggtgcctccaaatgttttctcttgatgcagccgattgcggtcttttctcaattgggtctccacaagagctttgggagcgaggtgtgaatctctcggactgctgattgtcagaaattccgccatccgtttgctgggctcccccttgatgaggaagaggacaagcgaagcacacacgcggtacacagggagagagaacagagggagagaaaacaagaaagaacagcgggaagacagggagagagaacagatggagagaaaacaagaaagaacaggtggaagacagggagagagaacaggagggaggagcaaggagccgacaatcagcgagcttgggtttcgcggacactcgcatttcacaggtactctgtttttccttcatcgttttctcgttctctgcttctccatctctcgttttttatcacctcttccgccttctctttgtctccttccaccgttcactgtctgtgtcactccggaaatcaatcgtttgtcggtaccaggctttcaggaagctctcgtaccttttgctcgagtacagagctttctttggacttcgtaactctcgcagcgaaaccagttcgctgcccaaggaaggaatcagagattcgcgcagtctctccaatcatgcgtggaagtgatgtcttctgttcacttttggagagtcacttttttccccggtcgttcacagcagacaacgccgacattccctagcggcgtcgctgcacaagatcgcgaatcttcttgctgacaaaggccttcacaaagaaggaccttccacatatcgtcgccaaggtttcttcaactggcaacttctcacaggtttcctctcaaaaaaaagagaaatccacccagcctggctaccttttgctccttctcgctcctggcctgcgctcacccacatccaccaggcttgtttgccggagagctgtcgtcctctgtgcagccacaaattccttgtgttttgcttcgccgaggaaaaagccaaaaacctgacttcccgacagtcctgcggtcggttctccgtcgtgagtgcctccgaggagactgtgactttgagtcgcgcggacgacgccggagacgaggagctccagttcagttccgagaaatatccacaagagcgttatcggaagtccagcaatgaccccccgactccacagagtccggccgcgtccctcgctctagcgaggaagaaaaaaaagcaaagccatgaagactgctgactgctgtcgccgcaaaagtgccttttcttcgcgttgtatgtcgggaaagtgtgcatgtgtcgcaaacgtttttcggctgtttttttccgcgtcctaatcgacatttctgcgtttttgatttttttcgctcgtttctcagaaaaggactttccgcggaatcccatgtcgagcctgtcggaacgcgtttgcgtgcatccgacagaacgcccccgcgaaagtcacctctttctgctctgacaaacttttgggaagttccgccggctctctcccggccttcgcttctcaaaggcctcgccgtttgctcctcggaaaatccccagagccactgcggagttgcaacgtccgccttgtctggtcctgctgcctgggcagcgccgctctctccttccagccgccagaagcgttgaggacctaaaactcagcgaagaaaaaggtctcttcagtccagtcccaagagaagacgaactcgcatgtagactgcttgacgcgtttcctttgcctgttgcccttctgagactttcatgtcgtttcctgcacactggggtacatgcacagagagtcgtcgacacagaaaaaacaaatatttccgtatctgtctgtctacatataaatatatatgcatatatttgcattcatgtatgtgcgtgtatatatgtctgca

SEQ ID NO: 3427 - DNA, 1089 bp, Toxoplasma gondii
tgtaacacttcggccttcaagtgttgtcaggcacttatctcagtacacccaggctggatgctgttgtgtgagtacatcgtgttcgccggagttgaacgggttttgtcaccaactgtaaagaaacgcagtagctcgagacccatttgaacggaagcaagaaaatgcatctgatttagaagaacgctctatcctcatgctaaggggacctttggtatcggtcaagacgcacagatgcaactgtagatccctatggagtgcaggagatctgcaagtgcttcagtttcagtcctaccggtgctgaaacgctagtactttaccttgggtcggattgactgccagtcacccacagatttgtcataacaagactcagaaagctgagaaaatgccacaatagaatcacatagagaatccgtatgttttggaatggcttcctcggaagcggagatgcactggctgctccgtttgaagcctgaacgttgaagggacaaattgacgccaaatacctatcttcttggtctgcatcgttacagtcctgtcttggtagaggggtgaatttgcctttttcactggtgtcagttcaatgtcatttcgttgtccgctcagacacgaacgactaccaggtacatccattctcacggaagtgcagcgctcttagtacacaaatctgactgtaaagtgtgttctgtgtacaagcattcgctttactagagatgccagctggttccaagcgtggcgttcgtagtattgattacaggaagcaaacgttcggggccttgctttggacgattttttgcttgacacttgaaagccgtcgaagttggctcccagttcctcaagaaaaattgcacctttccttgttattacagatgactccatctggaacaagctccgcttgtggcaaggtcgagccggttaccggggttcgcctggacagacacctgagctgccatcagattttgccaaaggatttccgaatgacgcagctgactcactacagaatacgcaccaaagaactttgcgggagattcgcgaagaaaaaaccaacaggtctgacgtgaaaaccttcgtgtgacgtacgaaaggaaaaaa

SEQ ID NO: 3428 - DNA, 1865 bp, Toxoplasma gondii
aaagcgcgtccaccttttcgttggaagaaggttcgcgctaacggagagagttgtttcgtattctgcctcgtcaaaagcgttgaaatacagctggcggacatggcgagaacagaggattgttcgtgtattcgaaaggcctacgtcgacagcaatcgttttccctgagaagtctcgaaggtgcatgcgctccttgacgttgctgtcgagccagttccagagtcccttgactcccattgcttcacgcgtttcctcaggtctggcttttttcgagtttgcgaaagagaacggaagtcggattcgccctcatcgggatcggtctgggtctgcttcggcaggtgtgtctcctgtctgttcagtgatgtctgggtcctctgcagacgcgtctgcagtttctcttgtcaccctctgcctcttttatgccatctcccagaacagactctcctcgagcttctcctctctttgcctcaaaaccgcagtgtgacatctggcggaaacgtctgggctatctccttctgtggcgcgtctctccttctttcctgtcttcctcttttttcgcttctctttcgcctctctttcccttctctgtgtgtcgcctcgttctcttctctcctgttattcttctcgtcgcttcttgctgtgttttcttttctgcgttctttacctcttctctctcctgtacttcgttgtttcccctctacctcctgtcctccctgtgtatggcgttcctcgctctctttctccctcctccgcggcacagatgagggcaggaggcgagcaggctgaaggcagagttccaagaagttcaccacgagtggcggggcggcgccagagaaggcgggaagaagaaaaagttcctctcgcgtcgcttcatccgcacaggagaatcggagagaactgcgcagaacgaagaatgaaaggcgcgaagaacctgagtaatagatggcgaaaaaatccagtgtccctgcaggtggcggacgagacgaagcggaggaaaaaatctgggacggaaaaagaaaaaactctttgcgaaagaaagaagagaggccactgtcgacaagacacacatgtcctccagtgcacactggggggctcgagtgagaaaagcgcgcgtgcatgcaacagaaggaggggagacaaggctcttttcagtcggttttctcacaagacaacacagcagagcagacgcagaccaggcaaagaattctgaggagcaaatgaagagaactcttcttcagaaaacgtctcttctcccggcatacgcgcgcagctatctaggcccctggcctcccgggatgcacactcacaacagactcattttcacacagggcctgctttccgctgtgctttctcgttgttgtgtctcgtcctttatacagtgttttggacttcctttgcttctcgaaaaccttggcctgctctgccggcctcttccaaagacacagagagggcgtgtaaaataggattccgacggtccccgtagtccagctttttctggcgtgtagatacggcaaagcgaggccgaccaccggctccagagctgcatctgcagcatataaaaccccacgcacagaagcgcgtcctggttttgcctttacatcgcatctatatgttttgtatacaggtaggcagacgagaggttctccggccggagcttgcatcttctttttggggaaaaggaattcctagacttgcacctgcggcatgcggcaccgtatcgatcaccgagttctctatctgactctgtccggatgcccagatgtagttttctccacgtatataaacatatatatatatatacatatatatgtctttctgtgtgtgtaggcatttgcatcggtttacgtttgccttgcgtatttgtcgca

SEQ ID NO: 3429 - DNA, 1808 bp, Toxoplasma gondii
atctatgctgtgagcagctaacaactaggcagtcctacaagttcgatgttcacttacatatatgatcataaatacatacatatatataaaaacgtacaaagctaattaaacacaatattttattcgcgcatctatccatctatagtatatatatatatgtatatgcaatatgaatctagatgtttgattcgtaaggattttgtacactttcgtgaaaaagcatattaccacattctgtttcagtcccatacgtctgcatatacttgtataaacttgtatgtatatatgcacacctgagttgacatatatatatatatatatatatatatacactatatataagaaatctgtctacctatatagtttatctatctttctatgtctatctctgtaactacctatctctctatctacatctctgactatctatatctacctatctatctatagctatttatctctatctatatctctacttatctatctatctctctctctctatatatctctatctctctacctctatctatctatccatctatcgtctatctcacgtatacagttcatgggtggcagatgcagattggagtgcatcggccttgttcatgcgccctttgcgcatgtatcattccgcgaagatttctgaggtttggcatgtcttccgtttgctctcgctgatctctgctttctgacatcctgagctttgttgtttttcagcgaagacagccaaagactgagcccccgggggcagacgcgcgttttctcccagtcgcagcggactttgcttttgcgacttttctcgctttctggggtcctcctttctcgctctcgctctgcggcctcgtgtccgagacgacgctttcgaaaaagagagacaaacgaatgagagaacgtttcagctcctggaaaaagaacttgaggtcggaattctcgctccgaggatctcctctcttcgcgcaacgccgccgtgcgaaaagtaggcaagacggacggcccgaaggcaccgcaaagaggccgctttttgcggaattgacgctttttctcagaagagacttttccagacttttaaccgtcgcagagcgaaagccgaagcgtgcgacgcccgcgagagcgattcggggaaaacgcaggggatagggaggggggcgcttccttttcgtatcgaaatccggcaccgcaactcccagcttcgtctcgctcctctcgctctctctgttcttttcgaattttttggttttctcctttttggagtcttttccctcccgcaccggccgtgtctccagtgtacgtacaccccaactcacacgctgcgtgtgcccgaacggaggttcctgcgggggtggaggaaaggcgttttttccgcgaagctccgcttttccctcttttgtcgcgctctcacccgggctgcaagcaccgggaaggccttcttttctccgtgctttctgcctgaagtttttgtcgccgcctgtgtgcgtctctgtggaaagcctcggatgccgagacttcgagggcgccttccagctctcttgggttctcacgaaacctggcgcctgttctcaccgttcgtctcccccttttcttctgcttgtccacctccatcttttccacctccatcttgtccacctccatcttttttcaccctgtcttcttcttggtctcttttgtctcgtgtgctcggtgctgctggtgtcgacctgttcgttctggggctacactcccaatatcccagaacccagaaccgcgatttgaccggcgcctttctctcttcctctctccttttcattggtcgccgtgtctgcgtctcgcga

SEQ ID NO: 3430 - DNA, 1750 bp, Toxoplasma gondii
ctggtaggaaccgggcgacttactcttcatgcctctgtcgtaactgccgcgtgactcgcgaccacgtcgcgcgttgtgcctgccattcaaatgcagatttgtgtaagagcctccctctcaacgatccatttatcacattgtcttccacttgactatgttttcatcgaactggatgtaggactacactcgctgttaagagaagtggatagttccacacaagtccgacgtggagaccgccgtttctcgccgttatccggcttcgtggaacctttaaactgatgtgcagtgttccctcctagacctactatacgcaagactggccaagcggccctccgttgttgcttttcgccttgtgtgggacacgagcaaagactttcagaaactcccatgctgaccacgaggcccgctaaacatgttgatgtaaaggtcagagaatggtatctttcgtgtgggattggaacgccacatgtcctcacaggcgagcacgcacttttgaatcttgttcgttccagtctcatccccacgggagcacagctgaaacgcagccaaacacaaagagtaaacctgcgtctaattccaagggcagctcagtctttccacaacaccagatagggtggatgcacatccgaatttgcttcagcctgagaaatcgtaaaaggtggatagagcgcaagtgccttattcgtacttgatgcagacgagggcaaatgtgtgctgcggtgcctcagtcttcctctcacagccacaagcatgaagttctccttttatgtaaaacttcagctgaactgatgtccggtaccacagtttcttgtatttggggaggtatgcctgtgatgtgccagtttccttcaactaggcaacatctgtctcccggggactctcgcagagtttccgatcttgaagtggaactgtagcactctgggcactccatatccgagcaaggcagtggatatagtgaaaacggaaatccaaggagtgaatccggtaaaaggaagccttcaagatctaaaccagtagtcaaaaactcgcagtgtataccccccagcaaacacgtcgtcgacaacacagccgccaagatcgcggcggcacttggatatgtcatcgcaactcgtgctcttttgtgttctgagttccagtttgttggttcaagcatctttgcatcccaagcggagaagctgaaaaaagccattgaagagcagggaatatggagcgcgacaagtgtagatttgtgtagctgtcgagcgcatgcagcggcaaaaaagcttccacatgcagagccacaagaagcctcaaaaactcctggaatttgctttttcttcaattagcctctttcgaaactgccgtcttcgcctgtgtattttttctccatatgctcctagttccactcactcctctcccgctctcgctgcgggtctgccagcgtacgagacacaaactgtagactgaatgctgtcggctactctccgacatcccttggacgcgaaaccgggttgggatgtctcctcttttccttcgtttcgttcgtttttttgtgcgtgtttgttctcgtccggcgtcctctcgtgcttttgcctctctgtgtcgcctgtctcgatgcatatttctttgcactcgcagttttagctctatagcccgtcgattgttctgctcgttgcacgcgctccatttcccgccttccctttcttgtctccgccctcgtctgacaacctcgaagttaagcagttcttcgttcacagcttggaccgctgca

SEQ ID NO: 3431 - DNA, 4816 bp, Toxoplasma gondii
aagaactcacggccaagaaaagacagctgtgtgctggactcttgtctcgcgcgtcgtcgcgtagtctggacagaactttccccgttgtcccagggagtctgccgccttcttccacatgccgaaacgactgcatgcgcctcgcgagaacgcgcctcgcggcccaccaaaaagcagcaacgcggcgccgttgccacgaaccggcggggcagacgctcaggtgtacgtacctgagactgtcgggagcatggcggagatgcgcggctggtgagtgcggcaagtctgtaagaaggcgagtttcgttgaaaagagcagtggcgaggtcgaggaaaaggcagggaaggagagaaaagagaggagaaagaggaagaagagtaacgcgaagggatcgacaccagcaaagacaaggagcgaagagaggtgagaggagagtgacagcaaggacgagaggccgagagaaagtggagaactcgagaagcttttgccattgttttcatgaactgatgaggaaacgagaccccagaaccttcctggggggcgtacagacaagcatggatgctctctaccgaccgcttctcacagtcggaactgcaaaaaacggagagtccttcaatcgacgaatcgcagagaaacgtcgggatttagaggcatccaccacgcgggacaagtccgtgatagtgtctaccttggtgctcagagaacatcggggcaacgttgaggagttcggagatctctcgtccacgaattgttactgaaaacctcagaagatgctcttctgtcttccaaagataagtcctctgcattagccttcgacattcggcgggtgacggcttgtgacctgacgcgcgcgtttctcttctgctcggatgagggccagtcgaatcggaagagagccagcttgttcgagagtcgaagcccttgtgaattcagaagatcctcacttatcagaaatcttttttcctgtccacagcacacgcgctgtttgagtctgcggccgcttcctcgcacaacagccgccgctcctcgggagcctggcggcaggtcaaagtccctttgcccgagttcgtagacagcaccgaggattttccagagagtcctcactcaccagcatgttgacgtcctctctgcttctgtggaaagagaagctgggtcgaaagacacggaagaaagatttctcacggtcgaggaagacacacctgaaaactgcatgtgccgactgtcggcgacggcgggcgcaggaaacatcgaagagctcacctgatctcctaaagctggaggtgttgctctccaatgttgagaagcgaagattgttttcaggacaacgggacggcaaaccgacgggcatcctttgcagagaacgcgtcaacaggaaaaacacccgcggagtgcatgcacaccagctttccgctgtgcaacgttgccggcgcgagatggaccatggaaaaaacgagacaggcgttgagtctcggggaaatgtctgatgtttaaaaaagggggaagaatgcaaacgaaggggaaatgtttcagcgcgatcagtgatactttcttgaaagcgcacattggaagggtagcgccgatgccccttttccgaactttctttttcagtctactgtgtgtaaacagtcgaagtttcgaagtcccggttgcaggaatgtcagaaattctcggccctcctgcacagacctacgggttctttcgaggagcaattaatgtttttctctttttgggattaaaaccgagttggaagttacctcttgggtgtctatgatgcccttcatgaccctacgcagagagtcgagcgagagtaccgtgttgtcggcggtaaatagatctgaaataggcctatcatctctcacaccgcaagaactaaattacgcagaactacagtgaaacacatgaaagtacacttctacatttcgtgaaagtgaggcgagaagccctaaggtgcaagagcgttctgtgagggccgacagcctgttgcgcagtcacaggtccttcatttttttcatttttgccacgttgattcgtcgaagaagctccacgaaaaacgaaatctctccctggcagcatagccaccatacgaacgcactgccggatgagccttctgctaaaaccagtgcttcaagtctgcgcaaaaaagctgtcggtgtcgcggtgacagcttcacgggaaccacgccccctttcgaacaacgccacaaaaaatgtttcgccggcctttttctgtatgtttgtgggtgtgaataccatcaacgcgtcactgaaacactagcaccctgcaggtatggatgccgcgcttaaagttgtctttcatcctcctacgttagtgacaaatgctcaatgcctgtgtcatctacagttgtgatgatcatcttacaagggcaaacgatgacactttctcgattagctaacagcttttaacagctggcgagcaatcagaggcaacaccggcagggcacacagtgcgtggcgctggagcgatgaaattacagtggcggatttccattcctgttaccgggcgatgtgagttgtgccatgtgaacaaagcaaggagtcgaataatgggttctgccgatgcatgcaacggcatcaagtgtaaaacaaaaaactctgtcctcaaaccggacatcgatccacctagcattttccacgagctgctcgaagcattcactggagtccgtggttcggtttgcgcgtaactctctgggcggcagcgttaccatatcttgtctgcttttcccgaattttgccggctcgtcacccgcgatgccagacgttcctccctcgagttgtcaatggtgtgaaaactgtatcccaaagctgcgcatctaaaaagctcagtggcagcctgaagttgctgcgattggggcagctgtgaagctggtgtctaccacgattctgtctgaacttcagcgccagtgaaaagcatcgcagggtcagagcagcccttcaaacttgccggtataaagtcttcccgaggcatcggcgagaactgattcgcaatgtctcgtctgtccgcgctgcacgcagggtggcgtcgactgctttctcaacatcggagaagactccaaacactcaaaaaacgagcgcagcatcgactcgctgcgcttaaacacactccaggaaaaacgctccggcggttcgtagccaggattcgttttttttgccgtctggtatcggaggtcaccgagttcacgaaagtgcgagcctcgccacacagacgcgtgaattatgaaattttggaaagttccccagtgcatgctaaacgtactcgtcgactggttttctcggctctttgcgttctctgcgagaagctgcctcggacatgaaacagtctcttccagaaaccccccttctgactccgaggtagtctgtacctgagccagccgcactccggggggtacgggacttccgcgcctttcggcttgccttggaacttcacacgactaaaaggcactgtcgaccacaaagaagaaacctgtgctttttcctccacggcttgggtccacaacttccctgggacggctgcgctggaggcgcggaagaagacggagagcgcaagaacgcatgaccgtgtcgtgtggcgccgcacagttggccagccagcacgcaaaagagtcgagagccctcaatcttttctggcgggacggaggccgtttgcggcttgattccgaatcgaagcaactcacattagacaacggagaagctcttggaacgagaacgcccgcgaaagtggagagttttctacttttccggcaccttgcggccgcacggtgccaccagtcgagagcacctcgcaatcgcgcgtcccttttgtgcgcacaacggtttctacgagacgaccaccggtggactggcagctgcgtggctctcttgtcttgcaacgtttcgtgcgaattctccgcgaaaaaacgagaaaggtgccggcgggtctttaccgagtctctggggggttccgctggagaacgccgagccggttccgctgcgtttttcccgccgcgtttaggggaacctttcgtcgcacaagctgcgtcagctgctcgtgcagcgatctgcaactgtcgcagcatcggtttgaagaatcactgcacatttcagcagccgccgaccttctttggtcgcaaattttcacgaaccgctttcggaagccgcccatctttgcgtttttcccgcttcttcttccactgtcgtcgccgcccttgtcgatttccagcgctgaagacgcctggacggccttccagcgactttttactccgggcgcggcggcgcagcagctcaaagcgctcgggtgtacatacacctcagaaactgcgcctgtggctggactgaatcttcaactcatcttgatttcaggagcgagttccctttcacgagattctccgttcgccgccgcttgcggggtcgccttccgtggtctcgatatggctaggagcaaggcaacgccacagaggccgctttgagaacctccttcccatgctctttcgtctcagtttcttcctccgccttcccctccaacactccctgacctccccttgaccgtgggctctccgcgttcctcgtcttcgctcttctcttccgtaccaccccgcttccttcaggcaccgctctctcttccggttcgacgcacatttcggtttctcggtccgtgagctctgctccggaaatccgatcaactctctggtgaccttcaatgcatgcgcgaatcctctcactgcctgcatgctttttgatgtccgtgttcgtccttctctgtctctaactcgccgaagcctcgccctgctctactctcgcaccgcctcctctcttccggttctccaaaa

SEQ ID NO: 3432 - DNA, 1542 bp, Toxoplasma gondii
cgcaatcgacggcttaactgaacacaaaaggcagaattcagcatgaattagaagttagcaggtcacaggacccggtcgcgaagtcgtgcatcacaatggccacggaccggcaccagaatcgaagacgaagtttatttccttgttacctcgagatcttggaaatattccagggtgtgaagacgaggaattctgagtggcgacactgtggtaccgatctatggaatgggacggagccagaagaaaaggcatctgtcgcgcagcttcccatgggatcgctgcgaaacgataaaaactgctgtatttctccagttcagcttccacacacagaacacggcaaaacatccagcactgtagaaagaagcagaataccgtgtgaacccaaacatcgtgacaagcccacttctgcggcttgtatctctggcggaatttacaatttgatgaaatagaggaacgcagcgcaagcgaatagcgcaggacggaaacccagtaagagagttgacattccctaccgaaccaaccttgtggaaagcgctcgcaggaggcccaagaaacgacagcagaataaatacgatctcgtcctggagttcgtgaatataacaaaagtccgaaggatcttgcgtggcaacaaccatctgccgttcttgctctgatgcagccgaagaccgcccagcgaaattcgtatctggaaacgtggtaatcgcttttgatctggcgtctgacagagactcgccctttacaacagaaaacgtgcttgtgtcctcggtagaatgaagtctgagaatcgctttcgcagctcttcctctgggacatgtgtccatgttttcaacaacttgcgacgtcagccacgcggaaggaatttagggctgcagcaaatcgtgaggtgtccagggggttgtcacgcgtttgtgatctacgccggcggaaaaactcgagactacggaaagagacagaaacacagacgcgcctttcctctccgccagcgttggcattggctgctcagatgcaacggcctcgttgagggcgtcgaacgccgacgatcgctaatacggtacagatgataggatacatgttttgtgccatctgataaaaaaaatgagttaagttgaatgttcaaactgcaggagaaaatcgacatccagtgatcactcaaaaacgccttttgagtcaagtgagcgccaaacaacccggcgccgacatgatgatacaataccgaccggtttgtagagcacgctcacaaccgtacggttttttcattcgtgcatgccattggattagcgcagatatcaagcttttgacgttgacaagtcacaattgacggaaaagactactttttagtctctctagcttttgcagacataagtaacgggggaagcctctactctgcctagcatctctaaaagagcatgcatgcattgttagacgagctgtagaacaggtccgagcgctcgcaacaggcttccgagaagatgtgaagagaaaaacttaccggcggaagacgcagacgtctaagcggtgcaccgggtcttccattcttagtcaata

SEQ ID NO: 3433 - DNA, 3291 bp, Toxoplasma gondii
tgggaaaaggagttcgaacacatggaacttagggaaaaattgtcgaatggggagcagtatgcctcctgcgcggatgcgcttggtcaatgaacactttgtatttctggcgtatctttgcatgtcatttgctagacgaattcgtggttcatgcgcccttgtgagtggaacgcttggtctttgaaggcatttcatctgatatcctctgagctgaaaactgagaacgatgcgcaagattgggatgatcaacgcaacagtcacgagaagacagaagggtacaaactgtcaggcagaattcagcaaggttctcgtagttgttcttttatatcgacactcccactcgtggaaacgacacaactagctttgtctagacgtccaagcggacccaacaatcgaaaacgggtggcacaagtttcttggcggtgccatcttctttttgtagatgtgactttacagtgagaatgacaactcaggcgcacttccggcattccgttttgccggaggcccgggcaccagcattaatgcgtgcagtaaaaccaaatctgatttgtttaatccgcgaaggacggcccctggggggacatccgaaggaaacttagcagcgcgggtaggtccggtataggccgaccaatagtggccctccaactgatgggggcagaaatgcgccgtttgtgtaacaaacatatgggcttaatctacgccagcgcaggatcgtccagttgtgaaaaaatgaagcgctgcaagctcacgacgtcgactgccagagttcttgcggagttcactgtctgtccagggcgctaaatatagttgattacgtgcgcacgcatcgcttacacttgcggaagctgcgaattccgcaacacaactagatgcagcagctttcctgagccgatgatggatgaccacgagacagcgaaccaacaggatagatttgctccgagcacagtgaacgacataagcacaactgtcgttccccatgaatgagcacgcagaaactcaaacacaactttttcaagggctgacatatctttttgtgaacagccacgaacacgttaagcacgttgccatctgactcctaactatgcagctaacgcggtgatatttgtgagcgccacatcactaccgcaccaaaatggatacggtgtgatgaaccaagtttcaaaaaagtggtgatgaaggaccacaaggcatggcggtacacaggtttacacacgaagtgtctgtacactcgcaacgcgagcttgcgtgttagtgagcctctctcagatgtatgttccggatggttgtctttacaacactttccgtctgaacagcgaaacatgaagtttatttgcctggtggcagttggcgttttgcctaccctgaggacagcggcgcagcgggctccggtaagtccctgcccttgcatcattacgctctgtggctacataaaattcacagaatggccccgtcccgtacaaatttccagaacgacggggagcactcgctcctcctccgcctcgctcgctatcgcttcaaggtacatgcaaacgctacccgacttgcttgagacttacgccgaacattctgcgtgcactttcgtgtgaagcagcaactccgtcacagccggcacctctgacggttttccccaggaccggtcacgcgctaccaacttatttcccacatgacgactacgaacgagcgaaacgtgaactaacggaaaaaggtagagactctcagtgatctaaactacgatcttgttggaatgccaggtgttgttcgttgcaccgcagaaatgaaaacagagaagactccccctccatgccaaccgactggtaagcgatattctgaatatggatggacgccgatgcgccatgttagtttagggcagctatgcacgggcagccagtggcagggttgaaccagagaagcatcgaaagcagcacagtcatccattctgaaactggaccgtatgggtgagaccgattgttttccctttcaaaggggtacctgagaatctcccgcgattcagctatgtgaccgacgccccacctgcgcggacgaagacagtcagcctcattcccccgccaccgatattcccaaaaaaagaggctcctccaccgctcccaaatgtccgaacgcttggcgaagtgatgggaggattcctagaaaaagccgcaaccgtgcttcctcctcaccactgagtactttacattttcagccttgcgtgctctacatttctaagcagatactgaaaccgtgtacggcttgaccgacatagattcgatctctttgggcggccgtagtactgcacgactatgtttatcctcagcaaaaacaccaccagaactgaagcaggagtataggatgacaacgcgaagacgatagagtggatccccgcctgcgttccgctggctgtctccacgtttattcgctgctgcctctggccacttcagtttcatgaggtccatttcctgcaccgtctgacacagcagcagagcgcagtctcttttcctcttatcgcctgaatcagatcactgacaacgttgtaagacaatatgcaccgtagccaggcgcatgctgctgttcagtgacaaactggcaatgatggatgataacagtgtggctgcaaggcaacaatgccgtctacggcttctctcgccgtacccttcacagaacatttccttcgaagacgctaaacatgccgaagatttccagcaagaacgcaacgttctccgttcacatctgtgtccaacggccttctatggaagtctctcttcaccgtccgtgcatcgctgcgccgcatgcaactcggcgcggaattggcaacgtgtgcatgtcccttgggatggaatatctcccaggcagttgcgcaaatgctcggtgcacacgagatgagaaacgagctaattttaatgactattttcgttccgttttctcagggatacttgaataatgtgcgcgaactcctcacaggcttctctttcacactgcgaggaggtcggcgctcgtagcggtttcccaacccgtagagtctcggactgatcgtgcaaaatcgcttgttgaattattttatttagcggaacgtagtgtgcgcatttcggttgttggagcgtggctctttagtgttgtcccgccgtgtgtctgtacccgtttccgatgcgtgttacgtcggcagcaaggctttctgccgcggaccctccgtgaaaagggtctccgggtctgtcggagtctcgagcttccgcatctctcgttgtcctgctagctcagtttttcaaaaatcctgaatgctggcttagctcctgtgtgacccga

SEQ ID NO: 3434 - DNA, 4570 bp, Toxoplasma gondii
agtgcttgtaactggttgaattcctgatggacctcgatgaagtgcatccgacattattttattcctacgttgtttggtatcgtcgctcctggccttcgaatctacctcagttttcatgttcggcacaaaacagacagattccaatctatgggctgtttccaacgaaagatgcgccccatctttttcttggcacatgggcttccgatgaccctctttctttgcatcgacgccggaagtttgtagtgggaacaaatctgaggcttgtgaagtctcggggaccgtaattcgtgcgtctttggctgctggcgaaattgatataggggagtttgctccaccctccatacgccctgctttggttttgatttctccctgaccacaggtcttttgcgcttcctcccctttcgcgcgtagtgatgacatgtagagtacggtggccaagtctggtggagaaggttcagggatgctctgcgccttaccggagggaaacgaagatggaggtggggacacggacgacgtgcaaggtaacgaggggcggttctcatgaacaggcagacgaatacggtcgacagcgacaagatccctgtcctcaaatgttgcaggattattcgagctactggatgaaacaggcagcacggtggcagtctggcaagaagacggctgaaccgaagacactccgatggtagcctgcaccgttcctgtggcaatattttcggcgtccttgtgcggaggcgaggatggatcgatcgatccatgagacgaccttgatgaggcgcagtatgaagagcggaacttgtcaggctttgttactagcgccttttctgtgatgtctccaacaatctgcccacaggtggaattctttttctggaggatgtaagttggagtggtcgggattatacccgcgccctgcagaaagaatttgggcgaaggtttgataactgcaaacgacacactctggttgtggtcgagtgatgttacatcagtcgacgggtccactggagaaccactgatggacctcccatactccggagtaattattcgacggaaatgctcctgctgcgtcggctgcagcactgtggactgcacgctcacgtatcgtttttcgggaccggaatccggcacagaggtctcccatcgaaccatagtgacagacttgccatcgaaacagtggtggactccaaactttagtgtaggatatgatatggcgttcgacactccgtaagtcaagaggtcacatgctcctcgtacgtgtacccccagtagcctgcactgtccaactggttgaccgtctccagatcgccgcaaaattttggaacaatcaagtgaagaaagatcgacagctgtttcatttcgtagcgtcgtttagtctgaagtgtttaacacagcgtgacacaaaggaaaaaagaaactggagggattctctgctttcttcgctttcaatcagaccagatacaacgatcttcagcacaacccagtccagcgggcagaggcgagcgcgcttgcctcggtttacagtcaaccaatgttgttctcgaaaggcactgggcacaggaagcatggtgtattccagtatactttggtcgacacaggagctgaaatatgacgcctaaaactcactgatgataatttgatgagcctccggcaattgctccatgaagaccatgaagaagtctagctgcggctgctcatccaactcactgcgcgaccctccatgtacctgagtccttgcaacaagcaccccaaacgagaaacagtcacgtagcttttctgtccagtttccattggggtgatcaatccgattggaaagcacaaatcatctgcaacagaggcatatttccatactgttaaccacagctgaaagccaaactacgggggggcacccttaccgtatcggagcgtggatagtggacactgcgtagcgcgcgaggcggtcgcaagacccggcgagggaaaaagcgatcagagagctgtgttatgtggctgttgcaggccagggaaaacagaggtgaaggcgaccggccgacaacatcaggtgatttagtgatattccgcccacgcttctagaataaagctcgttactttcatcacggctcgtgtattggcgcgctggtgtcctgcgagctcgagacaacatgtgtcttcattcgatgtcttgcttgtcaaacgcctgtctggagcaatgccgttagctgtgttcgccatatgcgaaatacgggaggaatgtgcacacatatttatagaaacggagctggtgacaccatagcgtcctcgaacctggcaaaagagatgcggagcaaaaaagctagctctgtccagccacgcatactgtgctcgcggaaatgtgtgaaaacggtgacagcgtagtaccaagagcggcgaaggagaagaaaagactcacaagaaatgagcaggtgcaggataaaactttgaaaaagtggtcagaaagatgtgtggactgcgcatctcacaacaactatcgaaaagtaatgaccctcaatgtgtaagccgatgtggggattgatggagcccagcaaacgtagctccacaatggttgtgcacccaatctgaggcgccgcagcagcacactagtcctcgccatacgatggacgcgcagtgcgaacgtcctttctccctgtgaacaggaacccgtttacagaatagtgcaggatgaagacgtaccgagtggaatagtgatatctgtacgtctttaggtgatcgacggtgtgcggtacatatcagatgccacgttattgtgagcatttggaagttactagaccaggtggccctgcggtccgtggtacgggttgcctcgttcctgggcactaaggcaacctgaaagagagccatcctggtacgtgtttgttatatgccacattgtttcttctatgtctcatggctacatatttcggccgttagtcaggggaaaaaacctacaaccctagcaacctatgagaattcatcaggcggtagatggaaggtgacaaatgctgagctgcatgaacggtagacgttcaggtggtggtcgcttcgagcgatatttgcagtctttgttttctctgcatacgactagtgaaaaacgaatgaatgttgcatgcgggctcccctccagcttgagcagagagcggacacattggtaaacgagtaacatgtgactcactcgacctcgtcacaatgaaagcaggtaaaaagcatggcttcaaacctgctgcggatatactgaaacacgggtacgccgctctcttgtttgttcctactgggcggcgtgagcggcagtgtgccgttttctgtcgaggatacgcttgctgcctgacacggtgtgtcgactggctctcaagattttcaaggaaaggaatatccggccaaattggtatcgtgtggtcgagctgccgcgctgcagttcatattaattaggccaactgaggccccttcaaggaaggtcgctgtgccgaagtagaacacgacagccgagtttggagatatattcagacaacgccaacgagaagataccagccacagtacaatcggccatgatcctgtaggacggacatcatgggctgagctgatgcggtgttgcgcttgatgcggtcacaggtttgcctgaacacaacttcataccgccgaccgccgcgtcttcacaggagcaaaagcacgacggatgaaggaatttttctgcctgcagatatgctaattagttaactggccaaccatatacactgtacagaaccaaccttgggtccatgtgaggcctcggcagttactaccaagacgcatttgcgcagtggtgctactatgtgagagggacacttgaaatgctttatacattggcgacaggtgtattatttcagcgtggccaaacagccgaaacgagcagacgattgctgagcgatgagaacggtgctggggaactacgcggtgccgaaaaatattcactgaattactagctctccgtcttttggcttgacgtcaatgtcgtactcagacgcttgctgggaagaaagcacgcggccctgccttgattccgcgacgcacccgggtgatccccccacttactttttgactgtggcgttctaggtaaccgttcttgttgcccacactgggttcgcatagccgggtgcattctctccgtaatatagaaccgttttttaaacagtttggagtccagaagtccgctgtttgtttttaccctcaatcataaactccgcaggggaactgttatgtgtctgcgcaccgatacgcgtgtaggggcagtaatcgcaccgtgggcagacagtggcaacatagttgtttgttcatccagtttgccacaccagtgacgtcgtccgctgttacaggacatctggaaaagtgtgtgccagctgcggtggggaggtggcttaactcatgatcgtgtcagttctgtggcgcagttgggactcgcatttaacagagaggcagttcatgcagcgacaagcagggacgtgtaagccttgacaacctgcgtttcgtgtctaaaagcaattcctcgcagctcaggctgttgggtccatctattttctggtcatatttcgacaacaccgtcgtttttggtgaagga

SEQ ID NO: 3435 - DNA, 2143 bp, Toxoplasma gondii
ggctttttaaactgcggtggtgcgggcgggagtgttgcagctaatggtggcggcgccacaggtgctgtgtagcgatcgcagtgtccgttttatgcggcacggacaatctctctccgatatggtgagcttataaggagcattacttctccggagggaggtactgctgcccggaaactgcgagcgtggttttgggtaaggcttggtcacaactgcaactacattcccccaggtttcctacttcagaaaaaacctttttgactcaaccgagggttcgagcagtgtatgcttctctgcaccgctggatctcctggattcgtaagcgtggaggatccgcacgtctccctggctcacaacacctgcccagttaagtgttttccgtagagcactcaattgatgagaggttttccgtataagcaatcgaacacaatgtcacgttatgtcccaaacacatgcgcacgcgaagtgttaagcagctgatggcacaacaaaagcgcgcagaagacagacacagcctcgcaagaacaaagttttccagtgctgctttgtggaaacacattcccggctgacttgatgagtcataattacgcaagatgtcgaacagcagtacctctacgagtgtcaggacaaagatttccgtgcgctggtattactgaagctccatgcgtcagagagcgaatttcaaatgtcatgcgaaccgtatgaacgtgaagaagccatgcttggtcatgtgctggaaagccctagatatctgagacgcacttaagaactgatcgaaccggcagatgcacgaagcaacgtttgatgctcattccctcctgcactgattgctcagtcctgtacggagcaggtttttgaaatcatatggatgtgcttagtttcgtattcgatagctgccgtggcactgaagcgagaagatcttattgtcagctcgatgcatcaatagttggtacacgtctttactcgactcaaaagaataagctttgattgcagaactggcacccccctttcacacaagggagctttccagtttacactagccggctttaggcccttttctgaacgtcttggtgctggaaccccgtgcctcctgctaagcagtccgtgtcagagctgctttggggttttgttttccattgaggaacacattagctgggcaacggcggtcaaggttgatcgagataactcgtttgactgaagctgcaaacataggcttggttcgacaattctgcgcgatccgtttaatctgctttcgatggcttcaatggaacagagtcttcaaccctcagtgattttccggattttttagccacggtaaccgttccgttcaaaccaaagtcgtccggcctccttacggggctttccctcaacgaagtggaacttgtttacaaaatggagaccgaaagtttgaaggttgatcactcggtcgcccaccgatcgcacgttattttgattctttccgaaacgccttgttgttaaggagacctcagtccaacgcagttgtgccatacatgaacacgaatcctgcgggttctcagcttgctcattgttcagtcttcctcacggaagattgccgtgagttgtctaatcaagactaaaaactcaggcacaattcgatagatctctccactagacgcattcatcacatgcacattcgtttgcaactccgtatcagcatgcaaagctcagaccgatcgggagagaaacgggccccgctttttgtctcagtgcacggaccgtacaactgactagctaccattgaaaaaaacagagaattgagattttgcctgcttgttcttttttcagaggttttaactgacactagattcaccgccgatgcctgcgacaactcaagtgactctagttacctgcgattgccggttgatcaaccgctggaagcgctcctgatgcgctgcggcatgcgccagtagatcgcatcaggtacatattccgagaaatagtgtgttttttaccttttcgtgcgtttatccccgaagtggaagaacgaagttcattcgggcgtgccggaagttaaagacttgcctccatgtccagctctattcactctgtcgtgattggatcgcacgtcgctcgctagcgcggccacgcaaacagaaacgaaagttttccttggtggtcgtctcaa

SEQ ID NO: 3436 - DNA, 5025 bp, Toxoplasma gondii
ctacccaaggttcgaaagcgtattactggacgtggtttgcgcttattcgcatgtgtcggcagtacactcttttttgagtaaaagcgcggaaacatggaaccgggtgttatatgacacgtcattaacttcagagaacatcttacccaagtccccggttcgtcggagagagtgacaggaggaagaacggtgctcgactggcggcatcgacggagagcttgcatgtctttgtattgggccagaaggcgtgttttttcatcagccgcgcaggacgctcgcgccgagtcgacgttcttaggagtccacgtcattttgacgaggttttgaggttccagaaacgttaagagaaatgggggttctcgaaacgtgtctggactcatgcagcggcctggcgctccgcttggtgttcctcttcaactgcctcgtcgactgttggctgaataagatagatgagaagaggacgacaccatttaatggcgcaaaaaagaacagccacggcaagagctgcaccaaacacaaacacgacggacaggtacggctgcaagaaccacagaacgactccgcccgaggccaagaagggaaacagggtccacagccaccgcaagatggctgcgtaatccattgaagactaatctgcagcgatggaaagcacagatgtggtagtcaattctggataccaatatacgaaaattctaccagaggaacaagactcgtgttgtgtcagcctcttgttcagatcgctcgctctagccaacgtcagtgccggaagtacgagcatttccggatcgttgagaggtccacagcagtctaattgaagaattcgagtttgacctacgtgttgcgcttcaggcaagctgtgtagatggttctcccgtgattctgaaaaacaggagcactcgggatcatgtaacgtggcgtgcaccgttctaatgtcctgtttctctgggtttacagttggtgggtgtccgcagtcagacttacagcacaaaacaatggagaaagcgcttatcaggtgagctcctaccgttgataatggatacgcatttatgtcgcggatgcgtaggagattttatactgctactgaacggcgaaaccaccaccaacgcctcaacacaggagttaacacgctggtcccctcttagtatctggagttcatagatgccacctaacagaacatgcagcagtttcagggtgaaatgactcaccgcgagcaggataaatgcctccttttcgttgaaaagtggcagtgagccgaaggatgacagaactcgaaggaccgtcgttttctcgtcgcagggtctgttcgtcgatgcgcgaaccagccgcgattcagcggcacacgaagacacaaagcctgcagtactgcgttttgtttacttcttcgagcgcctgtaagttggttttcaccatatcgactcacaaataaagtagagagaagtaataagctgggactttctcttgagacgagtgctcgttgcaggtggcctggccttcgatgaaactggcacaatgtggcaaagaagcaccggaacacacccgtcagacatgccagtctgtctgaaagtggccacaattaatcgtgcctagagagaaaaaaacagtgccgctccacgagaggacatatacattgctaaaggaaatctgtgtgcgacagagatgcttgtctgactggattcagcgtcccaaggtcggttttaatgcggaccgggcaatggaaagagttctgtcgtcaaatgagtagtcgtgtcttcaccactgcttctcccccgctctcttgtccctttcttgctaacctttccagaaaattcctcctcgaggaagcttagctaggtctatatgacagggacaccaagctcaacgatttctgggtctccttttagtgtgacgtttcttccacagaggggcagagacgtgcatagtttatcgctgtgccagtccttatacacagaggaatgatgcgacattccttgcgcgacttgagtaattacaccacttctgcaatagaaaaattccccctggtgaacaaagtcaacgaaaggcgaggagcatttgtatgtcatgcagtgtcttcgaagatatactctagaattcgtgcccacctacagctgcagtgaccgttgtgtttatccgctacagttgtttcagaaaatatatgaacaaaaacaagggcagaaatgtgacacaacgagaaccttagaatctcgtctctgtttttggcatgtggttagactggctgaggctgaatgctccgcggctaagttaatgaaggttgccttttttcttattgatcagaaacgcacgatgccacggcgcctgtatagcgtttccctggtgcgggaagggaaaaactcaacatacgaacaagcactaactttatggcgatgtttcgtgcgccgtggtacctcagccacacccactcgtgattctgacagcgcgctgcggactgaacagaagcgcacaaagtatcaaatttcccactctactatccgaacatgaaacttccaattctcaaacttcctgtattcacagcctgcactgtcagatcttcaaagcaagagcttgtttccagcgccgtgctagagactactacgccaaccctagagtcaccctagagcctgaccgtagaaagtgatgtgacgtggatcattgagccgcagcagagttacatggtgaagacagaatcgaaataggcaggccgattggccagagttgaccgtaccagcacgccgttttacgggtgtcgctgcgcagagattatactacgtgcatgtatgtatgcggatgtgctatcaagatgcgacaagagatttcccggtctcgcgttgttcctggacaaacgcaccaatggcttctgtcagcagttaagcctgtatgaaacaacctgttcgccagttggaaaaatggctgtacccgcatagtcctctttctcgtatgcacagggggcacgtcagtggggattccctggtactaaagttcctcgacagtcgtaatgagcaggtaaatcttcatcgattgttcaagcatatactttcatttagggctcgacgccaagaaagcgataactgctgcaaaaacgcttcttcagcctatgacagggcagatgattgaacatcaccttgcttcggtgcatgctatggggctgatccaactatcctggtatcacgtctgacagctagtgttcgaggttttcttcacgttgtcgaagcggaacatcgatatcactatttttgaagtcgcgttgaactatgaaatagatgcacacacgagcttgcgtgtcaagtcgcagtcatgcaatctgtccatctcatgtaagtcttttcactgttaactgcacagaacttacttgtaactgcactgccacgctaatcgccggtgcgcacgtactcggtcaagacatccaacttctcaggtcttactccttttcccaaatagttgataatgcaaagcaaagcaaaatgaattcgaacagaactcttgccttcgctgtactcatgctctccagtgacgaggaagcgcgctcccacccttgaatcacagtagccttgtcggtttcacttgacctttctgttgcttctcaagacttctaagatacactatcctagagtctgaccttagtggaatagcctgagagtcgcgcaggactgaagttccgccacttcaccctattaggattgagagttacgcaaaggagagacccaatccccattatctttgttacattaatacacggtgttcaattgattctatttctacggtaattatcatcttaactccagtgaatacacatccaaagattggataatttgtaattgcgacagcgcggctctccatgctgcttcaacttgacacccaaatctagtctttctcaagcgcaacctcattctagcgtacccgtcccccgtctcgtcagattctccttagatgccatacaggccgtctccatactcttaacgctttcgtcggtactaacgccgtgtgcgtttctatggcaaccacgagcacatcacaccgtcgtccactagcatcgaacactgctagcaggcacgtttatttttaggagaaaccggttcgtctgtgtttgtctccgtatcgctctcttcttaatcaatcttatctcctaagctgggacacacacttttcagtggcaacgttgtctcattccccaaggcagtcaggtatcgtgttaagtttgagattttctttcagtgacgtatgcgtgttgcgcatgcggtagaatctctaaaaaagcctgcctaagagcgtgttcagcgtttcgtggcaatatgcggtccattgaaaatcctcccaccttctcctgtattcttattcattcgttttttgcgtcgtgttcccttttcgccgcatgtgcatccctcgtccctcttaccgtttacgttttttccagtcttgccgcttcttcgcactgttgtcctcatagaccgagcaaccagtaactctcaagattgtgcatttgtttgccacttggtaacatgtttacttctcacttctttcctcgaagtaccagctgaactttctgccccccgactgcgttgtctgtggctttctcctctccccgtattgcagttgcggtgacttatgggtcatagggagaccgtgctcgtctttggttcagcagtgaaaaaagtttgatctgagtgcgattctcttgtatgcctgaacgttttcctctttatctctctttaaattttgtcgagcccttgcagcaacgcagtcgactcatcgcattgttttttttgacccagatatttcgtcttgcgcctcgctccacattcctttccgtttattcgcttcctacttcattctccaagggcaacttctgaaactggggtggcgagaactcttcaaaattgcacgtttctgcatggtacgtttcttccaacgagtaacagggtgtgaatcgtcgatctgcgccctcgcagccgacatctcgtttttctccggtctgtcgaggccaactgccacaattctgcccgaggtctctgctgagaaatgcaagtgcagacaaga

SEQ ID NO: 3437 - DNA, 2129 bp, Toxoplasma gondii
tttatcggaatgtctaaagcggacacacacgcacagaatcgcgcttacagcgaccgaaacgtttctcatgtttttcaacgtttcagcacttgaagaatttctcgagtcgcgctctgtgtccttctctcgcaccaggctctgtctcgcatctggtgcctcccaagagaagatcagttccttccttctcttcgtcgcctctcgacacacgctgtgcagctctcactaggttgcttcagttttcgcgcggcatcttttcaagtaagaagaaacttaagtggtggacgcaagtccgagggaccatgggaagtcgactgcaaatctgcagaacctggtcacagcgagaggttttacgttgaacgcgtctttcgtcacacatttgataagagtcgcgtattcgactctgaaaaacggcaggcaagaggtttacagacggaaaccagaagggtattgcagcggcccacagcgacctcccggccagtgcttgcgtgagcataagccttgtggctttcgcgtttttctcgcgcagaagcagaatggagagaagccacaaaaatccggtgttcagcgttttgcctgttttcaaagagagtgcgttcgttttcctgcagctccccactcaggtccagttctctgaagaattcctttctgcctcagtcagccagatccagaagctgcgagaatccgtggatttcctccattgttgcgcaagcagcttctttcgcagatcgtcgaagctctaaaatcgctcttgtcggaaggaaataactatgagagagcaaggctgcgctgcctccaggtcaggcgggcttgcggatgttgctcagcgcttcctctggctgaggcgattccaacaagagggagaatgttcctctgaaacgtcttcaccaacgatgacaagtcacttcgtccactgctgttttctgttgacaccggaacgtcggctctgaactttcgcagggaggaggaaagaggcactgcacgttctagaagaaactttttttcgtcgagaaaacatctaaatttcctcttcttcataagttccattctaggctcacttgttttctcttcctgctctcggttccttgtgaacttttgcgttcctcacacccccgacgagacacccttcagcagacgactcgtcgcgtttctctgctatgttttccccttcgtcgaagagtttcgaggacctgtgaaaggacagaagaagtccttgatgtttttctcgcgtccaaattcgctgtgtctgcgttctcgccgcgcggcattttgcctgcgttgcatgcgctctctgaaacgcggcatctttacctcgaggaagaaggaggcacaggaaagacacgacgcgaagaagctctctccgcgctctctgtgctttgtttcttgtgaagaaatctacatttttcaggaatcttgtcggtcgggagactcgttattggcggatcgacggagaggaagcccccaagtggcttggccggtgactgcagcgtttcgtcgagtctgtactgcacactgtctccgctgttgtcgtttcttctttttccaagaagagactgttttccctttcccccttctgtgccattttttcttcggcggccgttgccgtttccgcgggtcttctctctgctggatcttctcgtttgcctgcttctttcttggctgcagaagatcacctctcacatctttgtctcttcccagcggccggcgagagtctttcatctcgcgtcaacgtttctttgttccttcgcttgcatgcttcttccatcttctgtggcacctcgccgttttccggcgtccttctcacctgcctccctcttcgtgacctcttcgtctccgtctgtagttcctttcctctccgtttgtagttcctttcctctccgtctgtagttcctttcctctccgtttgtagttcctttcctctccgtttgtagttcctttcctctccgtttgtagtccctttcctctccgtttgtagttcctttcctctccgtttgtagtccctttcctctccgtttgtagttcctttctcctctctgtctcgcctgcctcctgccttccggtttctctccgcttctctcgctgttccccgctgtctctcctcgtgcgatgcttccttgacctgccttcgaaga

SEQ ID NO: 3438 - DNA, 786 bp, Toxoplasma gondii
accacaccactggattgcttgatgactaaaagtgtaaataggtaagacggtgtctttttgctccggtaggctaaccactgcttacaatcaacaaatctgaaaagtgtgtattaaaccttaagaggacatctttcttttaccatagtatcgtgtagtgatatgttcgtgctgcagagaagaaaccagcgctgacaccatgacgacgtgtgagccgcagcgctggtttcttctctgcagcacgaacatatcactacacgatactatggtaaaagaaagacgtcctcttaaggtttaatacacacttttcagatttgttgattgtaagcagtggttagcctaccggagcaaaaagacaccgtcctacctaacagggaggaaagggcacctatgacgtctgtttccgcagtggtatcagcaaactaatttacagggttgggcatggcagatagaaggcgctgatcctagcggagagtcaacacaccttaactcagtttcgtccaactcgacacgcacatgcgatagtgtccaaagcaggagatggcgcctgttagacgtgtacatttccagtgctccgggaaaggtctcacctggttgtcgtgccctaatcccacattccacagttgctgtcgtgtcacacttcagtcataacgactgtcgtacgacacacctgtatctggcggcatcctctgcatcgcgatcagcctctgagttgaatacccccgggttaccggacattagagtcgatttccaggcacaatcggcacttggcttgagcaagggtgggta

SEQ ID NO: 3439 - DNA, 2093 bp, Toxoplasma gondii
tctacatccatctctctgtgtctacctaccaaaatgcatttatttacgtatctgtatctatgtctatatccatttgtagatctatatatctctatatccatatatctacgtatccatatatctacatatccatgtatctacatatccgtatatctacatatccatatatatccatatccgtatatctacatatccaaatatatctccatatccatatatatctccatatccatatatatctccatatccatatatatctccatatccatatatatctgcatattcatatatctccatataaatgaacgcgggtgcctgccgcggaaatgagtacgcaagaaatgtcgaaggaagcgcagaaaccaagctacacagttgcagggacgtcgacgcatgcgccgagcggcagaggtcagtgtctagacgcatgcacagatctgggtgtgagtgcgtatgcgcgaatgcgggtgtaccgtcgagctctctgcagagctttttgcattcgtcttggagcttatgaaatgcttcgtggcggtagaggaggaagtagctgacgacctctgagaagagaccgacggcgaggcccagcacaaagatcaggagcgtctggctgaagtcgacgccccagagacctgcgcccgcaggagcagaggccatggcggctttcgcgtagaggctaggagacaaagagacgaggacgagcggaggcggcgactggcaggaagccagaggcgcagagaccccagtgggtgactcacgaggagacagggagacagggagaggcaagacggagaagaaaaagagtgcagagcgagtggagaacgaaggagagcagaggacagtgttcagagaagaagagcaacgctgcgttgttgtccgagtgccgaccagatggacgttgagaacacaggagagagaaagcctgagagagaagacgcgcgacagagacgtttaaaaacctcgcgccgagtctggcctgggaacagctcctgcgcccacgaaccttctcaagccgatggctttcaagtttctgaaggagtgcgagagacgattttgcgaagcgtcggcggctcggaagaaatgtctgttctgcttttttagcgtcgtttcgtttttcctttccccgagagagcattcacacagggagacctgcgcttggttgtcggacgcagggcctcggggaaaacagagaaaaaacagacacacaggaacgccgaatcttacacacacacaccacttgctcttttcaaggaaaaagcgaatctctcaacagagcatgccctgaattctccagctgtcgttcatcgggaagaagcgtccgtcggctgagtccaagtctttgcatgcagttcgatttctccgggggagaaaagggagaaaagatgcgctggcgcgatctgctgcgaagatgccgcagatttgtggtcgaattctttccaagaaaaaccactcgctctcttcattcaacttcctcttcgactcggagacgaggaccctcccaggctgtttcccgcctcccaggagatacagagttctccttctcctcgtcttctcttctttttctctctccggttcttcatcctttccttctgctctgcttctttcgcaccccactcatcctccgttctctctccactcttgttctctctccactcttgttctctctgcttcgtcttcgctgtccgcgctcctcggttctcctgagagagcttcccaaaaagctctggttgagtcctccccaaagcacagcctcgtcgctctctcggagaagcgtaaacgcgtcgctttcagttcttgttttcgtcctcgtggtttctcaaggctattcggcctctgcgtcgcgcaaacttgcttcgttccatgtcgttcgcctcaccctgggtctctcatcgtcctttcaattttccgtctccgatctcttcacttccacctcccttcttccctgctcttcttgacggaatcctgtttatctggggaaaaggactgcctcttttctctcctttctcgtctgagttcctgcgtcgcgcttttctccgcgggactggagatcttctgatctttttttctgtctgttccaatctccttcttccgca

SEQ ID NO: 3440 - DNA, 1765 bp, Toxoplasma gondii
ctctccgcgtcagagaaaggtcttctcgacgcatgcgtgctgaaaagccccaggaccccagaggactcgagtgtctctgcggcctcgaggcgaggaagtcgcagaggaagcgagaaggggacagagcagagtgttcccctgtgaagaaggaacggagaaaaaaggcacgacaagagggagagcgaagaaagcgacgcggtcagtcgaagggaaagagaaggaggaccggcgcaaaggtgtggcgctggaggctgaaaaggaactgaggaactgggtacgtcgtaaggaaggacggcgaacagaaaaaaggagacactccagtcagagatatgcagaaaaaacagaaaagagagacacacatggaaacgagtcaagggacaggcgtggaaagaagtcaacacaggaaacgatgaggaaactgacgagacacagagaccgtgacagaatcaacaacgacctccggccattctacagtcatcgctgcaaacagtgtatccacagagccccccccccccacccgcaatctcgtttgcccggcttccgcgtttgctacaggagctgcggcaggccagcacacccgagaagagagagagagagaagcgcgtggaagccggaatgtgacaacgaaacccgcgaggaccgacagcacagagaaacgcatgtggtagtgtctttttcaactcaggggctcgcctcctgtcaactaactgtcttgtcggtcgaaaggagcctcacatgcgattcggcgccggccggatgtcctgcggcatcttgttttctgggagagagaaacgggtgagaaaacggggggaaggcaaacgccaacttgtagagcagacgacgcgttcagaaccagggctgacgacagatgaacaagtatcccagtcgccgtgtgtcgcaggcgacgcttggccagcagcgattgtctttcggggacgaaaagcagtcagaaaagaggataaggcgtttcctaggacagagagagggaaatacaccttggcggagccgttgcttgctggcacggtcgccgtctacgcaaacacagctgggggccggagaggattttcgggaacagaaatagtgaacgagaatagacgaaggaacaagttaatagccgtttcaggtcctgagcaaccgctctgttttcgtcctcttttagcaaccctttcgttaggtaaagatgctcgacttctcgcggttctcccagccacgctcaaagagcggaaaagaaagcaatcgcagcaactgctgtttcttgacgctttacgattgtggttgcctcacattagctggccagcggtgtgcacagatacttactcgtctgcagatttttcgaaaaagtttcgtcgccgaatataagccgacgtcgttgcaatccgtttcaacgagtctctcttaagagccggtcgtcaggtgcgcagctcggaacgcgacagtctaaagacaatcgaggcggcggccgacaagacagaacgaggaacgaggtccagtgtccccatggcgtgttagacttcgagcgattcttgtctattcttttgaattattgaagccttttgcgacgtagaaacgaagtacggcatacttttcgggatgggcgaagctgtaccgctctggtccgatagtactacgcccgggactcgcagtgtgtgcaattttggcctcagctcgttccacttgtgtctgcagctgcagaacattgtgagtttgtctccgtagcgaaagcctctttcttcccttgccaagttactaaccactgtggacacga

SEQ ID NO: 3441 - DNA, 4505 bp, Toxoplasma gondii
aagtttcttgttaacttccgcaatagatatagtctttcccgaaacgtcgacggtgacggcagcggagacagaaggcacctttttttcgtcgcgcgggatgccatccatgtgaccacgggtagtgtccaagagactcgtcgctttcctcaggtgcttgatagctctcaactgcatatgctcaacaaaaaagggacaagcactggagtgctgaatacttcaagactcctgctcctggacgaggagtcactcacatccaggcctatcatctcgcacaggggctcttccagcgaagaggcagaatcagtgtgtttcgtgaatggaaccgcagctagttccagcgcaagattcttgtgaaagcttgaagaatccgcagttcagcaggttcttaggcagccaggaaaatggtcttgacccaccgacaacactgcctgccaaggtgtgcttgtgtcgtggtccgggctccacgcttgcaccggtgtcagtccaggctctctccttacacgcgagacaatgctcttcacgaaaaacaaagaatacgaaagtataccttctggagactcgctacacactgcgtctgcacaaccactagtcacattcacgcctgctgccattagttgaaaaacaagagcgcgattcacttacggtctgcttccacgccatatgcaagagcagcgggaaatggactgacggatcaatcatgccgtgaagcagggcctctttgtccgctgcaggcaatttctccaaaaacttctcctctgttgggtcttctggcggcttttgttgtgcaccccccgcttgaggcacaggagtcgcaatcgcaacaatcggctgcactgacggttcctcgtggtgctcgtggtgcttcgctgcatgcttgtgtccttcatgctcagcctttttgtgccccttttttttgtctccgtcatcttcctcgtcatcatcttcttcagcgtccgattgaagaaacgagaatgctgcgttcgatctgggtcgcaacgagcgaggtgtaagaggtgcgcgatcgaaactcatgaccctattttgattgtccgagttcctcatagagccccatccgtggacgagacttggaaaaaaaaggatagtaagagctagagaaatgcccagcaagttcatcgtgactgcaacgtggtttgccatgagagacattcgggtgctgggacccgagaacaacggcggcagatccaggcccgtgtggatcattcgaaaggggtcatcgaatatcgaaatttttcatgctgtcggacccaggattcccggttagtagtcgtgtaaaagacaaaacgtctcatcaaaggtccacattggggagtaattcttgagcccgctttgtcaggcgcggtaggatagaccttgaccccgttcaccgaacaaattcggccgaaggaactgtcgtcctatgacgaaaaaccgggccttttcgatttcttgagttggaccgtggcagcgaaagcacatttaacttcgccgaagcaatttttgcgtcggatgagtctttactatccaaaacgaggaaaccctcaagctcaattttagcaaggttcaatgtcacgtcaagacaccgagacgcatgacgtttcagccaagcgccgcaagtgagtagccagttccgcagtgcctctcgtttgttaaagccaataatcgtactagttggcaataaaaaacacatgcaaattcagaaactcatttccagcgaaagccacgtatttccgtgtcatgttcactcgctagcccgcgccctgttgtcggtcccacagcgcctggcttgctctaaccgccgcgcgcctgctagaatccacggaaacgtggcaggagctgttgccaccagcacaacgcccgattgtgatttagtaacacatgaacggctgacggccggccccagggttttgtagatggtcggcgaagaggccgccagcaaacgtgactctttcaaaagctttgttgtgtcgtgcgctcggcctctgtggtaaagcgaatacgtaacctgacaggtcctcagaagacacgtatcgcgcggacgaagttgtgtttccgtgttaaaaaatgagttcccttgtacacgtgtcatgcaccgcctccgtacacaggttgtgtcgcacacgaaaataagctgcagtttgtgacggctgggcactgacagacacgacgcagacaaggactctctctctccacatcgagtgcttttaccgtgtgtaacttcatttgatttctacagggaaatcaaaacgcggggagatgtgtcgcataagtccgcctctcgagtctctcgtttgcgcatattgaccgccaacaaacatggcgcaaaacgctgcgcgtgacattcgtttggctactggaattggtccttggaaatgcgtatttgtgtaacagagaggtgcgtcaaccagtatggattgggttcctttgtgaaggccggaaccgtaccaaactgcagcttccccccgctgatcgaaaatgatccaatttcacgagaacgcggaaaaaagatgtggatggaggtctccgttagtgtttgggaggttgcggttacaaaggaagacaaacatgtcagcaacttgaaaaatacaaggggatctactcaaaactaagttcgctcgtggcttgccccccaccaagggttttgtctgacatttccactgagcatccttgttttgaggcgagcgtctaccctctgcttggtcaaaggcaagaatgagactatcttttcaggttaatatggcgggcgtcagcaacagggaggaatcctgctaaacgagttatagaagacctcaaccgactcactttgtaggcaccgccacacttcaggcacaaccgatagactgcattggaatgtagcggtcagtcaccagacctctcgggagtgtaggggagcatgtgcgccagatgttccacgttgtcggggcaataataatacgctcttgaagtacggcggcaaccgagaatagaattgaacgatcgttgatctggcttgttttacttggacatcagcactgttactctcatgagttgcggcgacttcacgcctaaattctttccactggaggaattcgccacgcaccagcatgctgcttctgctgccttaaagacacattccccagcggttttgctgtaggtgtagtatatggattctggttaccacttatcaacagggagaggaaacttctgctgaggtgctagtatgacaaggaccatcgaacagggggtagtaacgtctgaaacttggaaacggtcccccatattgggatgtcgcggctaccggagggcggcactttgcacaaagataaactgtttcgtcttatgcacttgcagaaacgttatgtacaagttgcatattcttgtgattcagcactcatgcacatgacgaaggctcctaggctcttgaccagaaattcttgatttgtagctctgcttgtttggtgtaccgaaaggaatgggaacttctactggaccccaaccctaacggaaagacttcaggtaacccagtgctcaaacatcgagtggaacaccattgttgctaatttaaaactgaccagcacgactgggatacctgagcaaactaaaaagctgaattgcacaactcgttgccttcattgaggcggcaacgccgaatgggcttggagcgaaactcgtctgagctcttacgccacgttaaaaggtgcatactctatttcttctttgtaatacactcaccaggccagttcggaagttgaagtcacctctgcacagggcagctcacagggacggcgtaaggctgacacacgtaacgctacgaatcgtcgagactccacacgcatgcagcgacggaaccacgggcgctttgaacaagcggcacgcactgcaaaatcctgttttaggacacacagtgaatacccctgaagcttttgattttcgttcccgcatcattattcgtgacttctacaaaatctaggtgaacgctgcatacgccgtggacatttaaaagcgggaacgaatgctgcctggtgccggttttcccgcgcatgcgtggtgacagctgcttcgtattgaacaacagaaacaaaggcaatttcgacgaatcggaacaatcgtgaaactgtgcctcgagctcttttttatgcaaaaggctttctttgtgtcaaagactggctctgaacttcgcatatggggagggaacttcctgcttggcggcggcggaccagtgtcagagcgatactgaaacggtctctattggttgattgttgttgaatcttacggcatttcgccagataacctttttcgttttcttcaaatcgctgcaggaagtggcagtaggacaaagccatcaaagtgtcaagacactgcaagcaacgcacttgcagacttgtggcgagcagtgattctcaaggcggtgacacttaaactccaagactgtctggtaatctcatttttccatgtatttaaattcacagcacttcgtgcggagcttttcttcttgctttgggcgtcttctagagctttatccgtcacaa

SEQ ID NO: 3442 - DNA, 3280 bp, Toxoplasma gondii
cgacttgcccaaccgcgaatagggaactaagctgttcccttcagacgagtccaaatcctctagatctgtcatcagataacgcgacgcacccgcgccccggggctcgagtgtcagatctgccatcataggaccccgacgaagagcgcgggcgccgccgcgacaagccgggcgcgcgatgcctggcggttgggccacagaagagaagggcagcttttccaagaaaagcaaagacagaaaagccggggactaggaaagcggggactagagatgtggggactagagacgtgaggactagagatgtggggacagagaaggcgattgtgagaagggtacgcacgagcaaaatacgccaagaacaaaaccgaagtgaaattatcttaacgttgtatgttgttgaaattcaacacttttagctggacgtgtgcaggacacagaacgcgtgcaagggtggaactctgacgatcacgagagaagcatggccgaatgtgaaaaagcaggggcaaggtagtgaagcaagagggagagaagagagagcgcaaaggctgcagaggaacaaagaatccgacagtcgggggcgcacgctggccagcagggaaggcactgaatcgcgtgagacgcgaacaacacagtagaggtggaggaaacgagcgtctccccagaagtctcgaggcgcagaggggaaatatgacaggggtatgaacaagggaaaactgctgtcggagtcgaaatcggttcttgacacaaacgtgatcgtcagcgtggcggctgttagccgataccagccgcgcagttcgaaagcagagagaaacggtgtgaaggtcgcaaagcagctgcgctctggcccgaataccaaagttctttacagcatttgcgtgctacatgcccgtttacttcagagagcgaggaaacaaggaaaatacaacagcagggagaaaggaagtggcgcatccagttgtttcccaacggctcctgccacaaccacaggggagagtccagcaggctaaaattggaggcacagcctccaggagaaaaggtgttgacgcaattttagatagtagatagggaacaaactctctcgagacatttttaacccagcccacgtattacatccgacggtgaactagcgtacccaaatgaatcgtggtcaataaccagggagaaatgagccgacacggaggtgctgctacaatccgacacggaaaggactgaagttctgagtgttttcagttgactgtaaaaagcggcaaagagtgatggaataggagaacctgaggaaatcagagcaccgaagccttcgactcatctacgggcatgaaacggcgatcgagtggtacgtacggagtcgagggtagacagggacagacgagaggaaatctggtagacgccgggaacaagctaacggggaatggacaggtaagttccagtagacaggcggttccttcgatttggcggagcctcatgctagagagctgaaagggccagcgttgctgccgcaggacggagttatttttgacagacgagagaagccattgaacgctgagtaggtagaacgagtcggcaagggggcaggtggccgaaacagagaagggcaacatgcgctggcgtgttttgagagacgaaacaacaaacgccacggcaagcgaaagaggacaagggccgcttgctactggtgagataggacgggaaactggacaaatttgactacttccagcgttaaagtctccagagatcatggtagtccgcaagcggagtacacacaaaatcgttgtcacaagagaatggctatgcaactggtctctaaggtcgatacacacgcggattgaaagccgcgaaaggttgcctacgcgagcagtgaaattcacatccctctgactggaggtgtaagacaaattcaagcgactcggatttggtttaggatgcatcgaaacgtcagccatttgccgggccggaaagagtgcacctcatcttgagtcgcttgagtccacaggctgagcgaaagcggcgttaactttcgagcagggcggacaactgaagcggcaaagttcctccctcatactttatactctcatggatctacaaaacgaagtttcggaggaaaccgttcactgggaaaaagctgctgctggagacatggcatcgatcgcgaaccctcgtcttggctttgtggctagaagcgagccgggcatgcgttggcggagctaaccgctaacaaaacgcgtgcaggaaaaaacgaatgtcgccgataaagtctgaggtaaatccctgaggatcacccgagaacacttcccgcggccagcacacgaagaaaaaactcagacagaaactgaagaccgatgataccttgtggcacggaaccaagggcagagatatcgagaacctgaggcaccgctacaacaagctatcgaaaagagtcaacaaatgtggagcgaaacggaccgggtcctgcacaacagtacacctgtgaaataccctcgtttccccttcgagggttctgtcaacaaagaagtcgcgaattcgagctaggggtctcattcattctcctctatgaaaagcgattcccggtaaagcgagaattcatgtgggatcatcagacccgacgcgcagctgagcgagcggcgcacattctgcaattcagccgtaccggggggtacggaattcgagacaaaagcaatcctcctgtcatctcggcgtcgtaagacaggtctctgcactctgaaactgcttttcaagaaatggcacgagccgtctacaagaagagcacgggccaaattgtcacgctgtagtcggcattctagacttcagtcctgccctttgctaacccggtagtctcctgtcctcgctgtgggcatctctctcaggggcaaatccataaaatacgcgtagaacgtagccgatgtgaaaagcagacgcatatgaaaatgtccacactgcttactgcctctgcccccctgaaaacgtcttgcgatgccgccctctagattctcctcggttgctgcacacggggttaacagggcactcgcaaggatacagagtgtaacagccgtgaggaaacatgtcaccctatgttagcggcaacaaatggcgtggggcacttcgttttgcccagctggagagattgacatgaaactggaggctcgcttgatccacgtccaggtgcgtgtcgtaggcagagccgtgcttccaaaccccggcatgtgccgcttgcgattccggagtgcacagttcccgacgaaagagaagttctgacaggcgtattctcatcgcacgctgaaaggaaata

SEQ ID NO: 3443 - DNA, 4277 bp, Toxoplasma gondii
ttctgatggaaaaacaacaaagaccatcagattccgtacaaacacaaagtatgtctatatatatatatatatatatagttatagatatattgcgtctacgcagagcttcatatctattccaatgtatgtatttgtgtaggggaatgaaatgcgtttgtatgtgatggactatcgcgtttccacttggagagacgcatgtgggcacatggtttcttggcgcctcgtggctggcaagaaatcggcctctcgctgtgttggtgcggcttcaagagtgccaaatttgttcgtggtcagtgcatgcaaaggaaagaaaaaaaacaggacacctgcggacacaacagcgtctttctgtcgacgcagtcgacatcgaaaaatagacgtgcacttccctctgaagaaaggaaacattcctatagaatcaaacctgcagcttcctgagcgggtgacggcttccggatacactcgttcgcgtagagattgcagccaggtcgtgtgtttctttgtttgagcggactggcaattagccccatagggaacctcttcgaatgcttgcgaagaacgaagattgacgaaaggcaaagatcgactctttccacgacttcgactggtaagattcaagcgagaggaaggcctacacctggagattcttgggagctgctttcagattccccggttgtagaaaagtgcctgcagaattgtcaagcctcgtctgatggcatgtctgcacatgctcgcgtttccgattgtctgttcttttctgcccctcgatacaaaagaatttccgtcgggaaaccaacctttaggtcctgtgtgctagaaacgaagaccgtcggaggggtgtgtacgcctctgttttcgatgtcgacgccgccactgctggaccgaggttaaaacctctttaccgaaccgagagtgagcgtttccgtatgcacgcgtcggcgtgcgttggtgtgcgtcggtgctgcgatggttcttccaaagattttttacagagcaaggacggcagtgcacggcgtcgcggtttccgcttgtcttttcagcgtgcgttttttcatgaagtgaaggacgagcagcagaaggtacgtgactccggaaagagccgcgaggagcgtgagcatgcccatgaagccgctttctcccgacttcaccgagtagtcgaacatgggcgtggcaagaagcgacaggagaccgccgactgtgcaagtgaatccgatgagtttccccagatggcgctgcggaaatgtggcgccgacgtagaagtagatttggttggtcattagcgacatgttctgcatgaaaagaaatgcgatgacgtactcgagccagacggctttcccgggcatgaggagcgtgacgagagaaaggaggatgacaagcgtcccgcacgagttgaccagcgccatgcagagcaaaatcccgaatcgatctgcgatgtaccccgcaatcggcggaaaaacgaacacgaacccgatgataatgtggagaaacgtcaaggcgtcggggaccaggtcgtgcgacgcagtgttgaagtacacagcccgaatgagggtgatggtgaagtacggaacgagaggcaggtacagactggagaacaggtagttgctggtgaaggccaccgcctctctaatcgcttgcctaactttgtctcgccggcctctgtcgcacggctggccaaagaacgacgcaagtcgccgttcgtcggcgcctgcgttcgagttccccaacgtacccagctgccgcgggaagtccgcgctgccgcattccagcccgactaccggcgtttcttccaccgtttcgtctgtttcgtttcctctgagacacggcgcctctctggagaagagcgaggctgctcgcgcatccggcacggtctgctctggcaaggccggatcggaagggcgcggaatgtagcagcctgctggcgcgtcgtcgtggaagcgtttcggggaagaggaaagactaatcatcgacagggaacctgtgtccgttggaatcgcggccggccacgagtcaccttcctttccagccgggtgtttcaacgagtcgactgtctggtccgtcgtcacgggtgtccttgcggaggtttcgtcgctctctccctttccactttcgctatcccaggcgtttttcccgcgcggcttctgcgccgacctcgcatctgtggcatttcctgcgccgtcaacacagtgagagtccgccttgttttcttctttcaatttccgggggaagaaagatgcgcagagccgccaggtgttccgcgggatctctgtgcgacggctggtctgcacgggcatctgttgcaggttgtttgccggcactccatccgctttcccccccgcagtttcatcattctccactccggagcggccctcccagggcttccatggggtcacgaaagcagcaatgaggagcgcgggaccaaaggccgtgacggcgtagccgaccattatgtctcggtaggaaatgtggagggagctcgcgacagtctgcagcagcaccggtgtcatgtagctcacagaccgcatggcgacgaggactgcccgcacggtgttgcagtgcccagggaagagtgtgccgacgggaagagtcccgtagaaagccatgtcgatgccgagaccgaagaggaccattccgagttcgaaggcgcggaacgtttcgcttgcgaacgcgagaagcagccagccgagcgtcatcaggagcgacccgcccacagacgccaccttcggtccacccacgtccatcgcgagaccaccgaagaacgacatgccgtagtccgcgaccgtgcagagagtgaacagattcccgacgtgcaggcgctgctgcgcgcatgtctgcgttctggggtcgacaaatgccatgtgcgaggcgtctgtttcctgcggatcgcaaacccagcggtagacgccattatcgaagagcagctgacgaaacggtgcccagttcaggtacacggggccgacgaggaccgagtagcaacagagaagaacgagcaagtgccaccgcgtgagcgaaaagagcagccttccttggcgtttcagccagggcagacacgccaaggcgtcgcgggcacccgacgggaggggcggccgcggagggctgaaaagcggaccgactcgctgttttccactctgccctgaaaacgcgtctggagcttctcgcctcccatggtcttctaaggacgcgctggggacctctagtctcgtcttcaggaggacttctgcgtagggaaggtacatggcctcgtcttgctcgttggggatttctctttctggtgttttatcgcaaaagttctcttccctgacaggctcagttcgcatccctatgagagagctcaaaggtccttccccgctgggggtcagcggcctctctaccacgcctacgtctttcatgtgagtcacaatcccgttgttgaatgagctgcacagactctccgcaggctcgagagcctcgtccttcgcgtaggccacatgttcgtcttcgcgaaaagcaaaagcgacatgagacaatacgcccatttcttttgcagtcaactcctcgcgccaggcattccagtgtcccatgcgcctgcccttctactttcaacggaagcaagctcacgtggacaaacaaaccttttgcgtgtgtgtatgtatgtaacgggtgagacgagggcctttaagtccgtatagatgtgctgaaaccaataacgtggatcgttcgccacctcccttagaggaatccgtgcatatcaatgcaagcacatacgtgcatatatctatggggattcatgtgcctgtttgtttgtgtatgggttctctctctcttccaccgtgtggcctgtgtttcttggaaaagacggaacgaccgtgaaaagatatgttttccgggggtgtgtctgaggcggatctcccagcagtgtgtactcgacgggttagggcctggggctaggcgaacttgcttctttgaaggcaagctgccgagtgccccctctggtgatctgtttgaccaagggaagagcttgtgtcacgaaggattgtggagcctttgatctttcagccgctttcgtttgcacggggacatagtggaaagtcgaggagcgcggcggccctctgtcagataccaaaactcgcaaaagaagcagggagaaacgcggccgaggagaacggaagaactcctcgaagaactgggaagacgagaaagaaaaacgtagagagggtatacgcactgcagaggcgaacacgaacggacacacggacgcgccaaaaaggcaagagaagtgcgcgcgaaaaccgccaaagaga

SEQ ID NO: 3444 - DNA, 2323 bp, Toxoplasma gondii
tatctctgcgtatctgtgtccgtgtatgtatacttgagcgctgtcgtatatatgtataggtcatgtacatcgcacagctggcaccggagtccgggcaacgctgatccttgtttgcgagtcatcggcagagcgtgtgctcgacaaaaaacagaaaataccggttgccgcagttgcggcgagatggattgtgtacgtgccgtcactggcaaagggtgagaggcagtggtagcgatagagcggaactacagctccgcagatcttcgtagatggtttattcgcactagagaccgacaggtccctttatcaccgtctgtgaacgatttgttcagaagcaattgtcacctctgcttctgcgttgtgtccaaagtgaacttgaaaagtcgattgtaaaacatgccatgcagatgctggccctcgttgtgctaaaccctttttgtgattgtaattgtgtgaagcgcgagaaacgattcaacaaatcgaggcgaaacgttaataggagggacacggacagagactcagtacggcagtctgcaacgcggtagttcttttggtcgtttccttttaatgagacttcgttgcacacgcacgagaaattcacagccctgtcagcttgtgcaggagccttttacggccattaaaacagtattgaccaagaacgcctggtagtatgttttaaatagatcgactggcggcttccgtgaaggtgcaggttctgtataacgacagtgaacctggcatttggttcccctaggaccaatactggcaaataagagagttgcttgcatcgagtcgagacgatctgtcgcggggcagaaacctcgaatttactcgaaccaagcaacgctacagttacaggagcaatgatagcaatttgttttgcggaaacatgcccgttcccagtatttcgcttatgattggagaactaaatctggtagtaatcgaatcgctgtgcgggttctgtaaagtcttctctaccggataatgtttcactttgtgtttgtcagtgtttggctggtgttctgtgggaggtgttgattttgctgctactttgattccgaaaacgtttcaccgtgtgtgatacgctgctgccctcgattccgctggtggctacgggtacccaggccgaggcggaatttcttgggttgtgttcagcacaaaagtctcctttgggaggaacttcctgcaaaaggtcccacctgctgtaaaataacagaatgccgggcgttttcctgcaagctgcgcatattttaagtatgaccgtcaactaagtccttgacattgctgaaagtcgaggggttcgccctaggctggtcaggtgtgcttgtaatcacttcgcattagtgcgacatcctgatacaagacaacaatacgcgaagttgttttgtattaataccctgctattcagctgttggacgttttgattcgcgatgagatacgtaatatctgtgccgccatgacgaaagatgactgcagcacggacaaattgtgatttgttagggggctggcgtttgtcgctatcatcgtaggtactacagtctcattaaatgacacatcattcggtcatgatctgtgatgggtatttataatcgtcagttcaaaggggcatttctgccgcgagaaatgtggccgagaaaaggcacttgaagaaccccggttcatgaattaaaagtgtaactgctagtttggtttgccacacagccccggcgcgtttacgcgcgtgggggagaagagtcggagagtgtccagcgcgacaccgacgactagatagacttggcgggaaaacagcaatcaacatgggctgtcactttcccgctcatccgaagtctacgagcttatcggggacggcaaaagcacgcactgcaaaggttcattgcggagaaaaacgaaatacttaaatacatcacgactagtttttgttgggttctgacgtaacacaaacaaggtccatcgtccatcgaatttagatggaaaacagtatacatctcatcttcggtggtagtccatcgcttttgaaactaggcagatcataggcactggcagcgtccgaagttcctactctgataggttcaccgagtcttccagcctcatttctgctgcgactcacagcaaacgttaaatacctatgggattctttgtatgtggcgtggccgagtaagtataactttctgagagtcatactctggcttagtgaaaacctcgagacgtgacagttcagaagcagtccgaatgaaataggtactcgaaagggtacatcattttccgacggactctttcgggcgcttgcgttagaattcttcacagaaccattggtgacgaaacatga

SEQ ID NO: 3445 - DNA, 4137 bp, Toxoplasma gondii
ttgacttctacagtttctctgaggaactggaagccgctatggtttgcgagaaggtcgtagatgagaactcgcgtgcagacgtcctggagtgtgtggctgtcctcgccgttccggttcgcacctgtgagccaccgggcgccagcttggcctcccgccttacgattcacaaagaggaagacgaatcgggtctttcctcggcagggccactgagctgcgacttgcgtggcttctaccacagagacttttgtcgcgcctggggaaaacttggcgcgaatcttcggcttgggagcaaatcgcagttttcgctctctcgactcttcagtcggcttgtccgagacgttcacttcgccttcggcttccacagcccgcggcttcgtcttttctactgttggagcttcgacgagcttcccagacgcctctcgcggggatatcttgtcctctgcttcgtcggcgacgttggaacgaagcacttcagagagaggcgcagccttctctgccgttgaagccgccgtcgtgtccacctcgccgaggagattctggagaaacgcgggatcgacgaccgcaggttgttgttcgagactcgcgaggtcggcgtcaacaggggatccgtcggcatccccggtagctcctggactctggacagctcgtcggttgtccgtggggtgccatgaggaggacggagtggacgccgaagagacagcgacgagggagagcagctgcagaggcacgaggaggcgccgaagagacaaaggcaacgcccgcgacggcaggagcggcagagcgggtgcagcaagagcccccatggtctctgaggagaggggaaacggccaacgcggcgagatccaggtgcgtcgactccggaacggaccgcggggcggagtggtcacaggctttccagatctaccgcagcagtcccgctcgtagaaggacgagagggagaaggaagctactggtcctagcagtgcgtgcgacgccaggagcgcagcaaagacttcgagggctgcgagttgggccagaggaacgggcggcgttttcgagaagtgcgtcgtcgttcgcgggcctcaaaattgggcagaaaaaaactttcgcggactttcgaccccgcccgccagtcaaacagtcgagtgcgggagagaaaagaggagacagggaagaaagaggcgcggacaaaggtagagcggaaacgaaggaagggaaaacgggggaaaagtcagtcgggagctaaagcgagagccgacatctcgcgactcggtcggcgaagttggaccgcgcgcacacggggagtcgtggcaacgagacgagcctgccagaggagacaagacagacggatccagcctggcaaaaaagaggggcaaaaagccccaacggagagcggccgaaaagcagccgaactgcgcgccactcctgagagcacctctgagacaaaagggaggaaaatcgggcgacgcagagcgcgaatatagtgcaggagagagcggctccggccccgagttacgtcccaaagcaaagcacgtgcacgggaaagtctggaaaacccagagactcacaaaacacacctccgcaaaacgctggcgcacagacttcgagtacggctgactacatctcacgagagtctccgctctccaccgcgctgctgtgggccttgccgcctctcggcctcacaacctccctccgcttgtcggagtgcggcgcgtgcgcggaggaaactcgggcgcgaaagatcatgcgacgcggattcctcgtctcgacaagacctgcaagacgcgaagtcgcaccacagtccgtcggagaacgaacgccagacccttcctctttcgaatttcccttttttaatcttcggaggtgtgttgcaactcctacaacctgtggctctgataggggattccggaggcactctacgcagagccccgccccggctctcagtagcacgtttttgctcttcctgtcgctctggctacttaacagatctggcagttacgcggggaagtacgtagaccagatgctactttctacggttgttcatcggctgtccgtttttctgtgtggtatcgagaaagatagagaagcaggaggagcctccgactgatcgagcccgatccataatcgttcgtctcagatcgaaaaaaacagacaatatagtgccaaggatactgagtatgagtccagttatgagatacagataaccacgtgctgtatgactgctgcacaccgtcacggcactgaactcctaagatagatgcgagagttcaatttcaacatcctagggccaaaggtggaaagcatagccacacagacgcgcagaagacccgtttctctgacttgttgacgcacttgacttccatgactttgcatacggagagggtgattgtgcagccgatgtatatttaacaaggaacaaacagaaaacaaaccgaactgggtgaccttgctggcaacgagaacatgggaaatctcaagatgcgtcagcgaatttgtggacactttgcgttgccaaccacccattgaaaacggggaaccttgcctatcattccttggtctacacggcagaaatcattttcgcttacacaaaaatctccagaactggttcacgaggaacctacggtgcggcggaaccgatgaatccggatgaacgaaaaggatctcagaaaggaaagtctggggcggtagaggcacctctcactcgcgtcggcactggctgacggcttctgcctccggcccttctgttggtttctccctcttccggacgccagttcctgttggacggtgtgcagactaaacattcacgaagaaacacataggacacccggttacaagtggatctgcatgggagtcttccacaaagtggccgccagccatgcccatgcgcaatgcctcctgttagaattacacataaacccagacacatgcgcaggtgactcactccacgcgtttctctaatgagacacacatagtagtctgcgtaaatgaagacccacaggatcttcgtcgaatactttgtagggcttcttcgttcttccagagaaacttactcctttttagtcatgttgaagcgttgccactgcctgatcggatcggtgcaccgtcagcgtaagggagtaatcggttcagcgtccctcagcgagtctgatgtacgttaaggaagacctgcgatgttgcaaagggactcatcccctcgccgtccaattggctgctccgcatgactagtctctcgacacaacgtgcttcaaaaggcggtgctgaccgtggtgccctatcgaattcacacatgcggattcaccgtcacattctcagctcttctcacgtacttttcctcttactgtgtatgctactagcgtgcaactttcgcacgcatatatgcatcactggtatattgtagatgtgcacccaaacacacgaattcatgtacagcggtaatcgcaacaatatgcatactttttttcacattagcggctgcagattgatctgaactggtacgtgcggagtgacgttctcacagaacaaatgaaaacgcattcccagcctcacaccagttggcgaataacttcgctcgcctgcttagcaaggctgtttgtttgagcgtaacgacaccggagggaaaccgagatccacgccttgccggctccgctgctcctcactagtaggaaaatacgcagattcttgtcttctgattcacctccctgcgtactcgacagagtgaccgtcaaagtcgagatgtagaatggcgaagatttacgcacggcgctgcattgatttttgccgagacacgaacggttttccccggtgcccccgccttagccgcggggaacgcatttccacgcggacgttctgcagactgcagcttatcatatgggcaggctgggttccggagtagaggccgaatggaaaggggcagaaacgttcgatatttcgtcatccactacacctgcttgaacctcggtttatcgcgtgtaacattctgggaaccatttctcctgcggctccctacgaattgacgaagcccgagtttcggcgtctcgcaagactcacatgagactcgccagttgccccttcctcttgccatcttccgcgtcttctgtttgtctcgcttcttcatcgtcgatttaacgacctccgacctttcccgtctgttctaaacaa

SEQ ID NO: 3446 - DNA, 2785 bp, Toxoplasma gondii
aaaaagaatcagcaacacgagagacaagatgacgatctgccagaagaacgaatgcgcgcggttgatctcgcgaactgctcgaaaaatcagctggctgttcccaaacattgtcaagagagtggccggagtgcccagaggcggccccgtacccaccggaggcacagccacgaaccacgagggaggggtcgccgcgacattggacgattgagactgagaagaactttcgctgggtccagaacgagccgaaacagcggcgttgcggtgggcagctgcgtgcaggaacggcacccagtcaaagggtggaggcgagcgtacgcaaaggtacgaacaacagccttggccattgtcgagagccttcgcattcccgtacaggtccacagactgcacctgcagaaaagtaacacgacacgctctcgtcttttgcccggaaaaacgtcggagccgctcgtaacgcaaacggagttcttactcgatttgtgaagcacacacaacgttcacacagccactcggcttgcgctcctaactacgttaccttccgtacaacggatacatgacctgtcttttacgcacttgaaaacacgagaggctgacatcggggtgaaggctggtcgtgtggactgcaccacgctccacacataaagaactgatacatctagttgacggacgacattgctacaggacgaccaatcgaaatatccagtgaccgcctgactccagttgatgaatcaccttgctaaacaatgaacaataacacggcaaagccaggtccagcttcgccgcaagaaacacagcttcaccacttcccaaacacaaaccctcttccaacaaaccgtttttttgctttaatccccttccgacagcgcccccacttacctcaggattcagagcgaccgccggggtcatagacaccgggaggagaaccaaaggcacatcgctgccggaactcgagataaccctggcacccgttgcaggcggaacctgtacacatgttggcgactctggagttgattctgttgcagaattcccgggcacagttaccgtcccgttgtcctgcggccggtaataacgttcgttgccttccccctcgcgactttgaagcaacggctgcgccatggtgcaggccgcccggcaaactcttgctgacagccgaggaattcaaattcaacttggatcttcacgttgctagaggcgagcgggaaccggggaacaaagaacctcccggtgaatcccttttgagatttccagatccgcgccagacagtgtgcagaaactaatggttttctgaggtacttagcaggacggatctcgcgattctcttttcaagcagaaaaaacaccgcagcaacgaactccgttccgtgaagcaaaaagctcttcgcatgcgaacagccagacctccgcggaccgctgccgtgtttgatcaccccagcaggaggagcaggaggctgggaaaaggtagaagacgttcacggatttagaacctacaggcaccgttaagcgaagaaaagatgacgggaaggcgtaaatgactgttcggatcaacttccgcgacccgacacaaacagcgggaaggagagacaggaaacagagacgcctggctgcacacgagcgcatgtgcgttgcagacttacggagggagaaactcgaagattttctctagatcctgacgataaggaagccttttttgcgtccacaagtagaaatgaaggcgccaacatcgacgagacggaaaagttggcactgacgagtaaattcttttctaaaagccgcgcgagacaatgcgcaaaaagcccctggcaagagtctcttttgctctgaaagcacaagagagaactgcagcccagcagggcgcttacatgtttgcgcagggtttgacatttcagcacatgagtagaactgtagcaaccttaatcacagtgtgcacacacttgaagtttttgccgcctcatcaatctacctgatttgacgttttgctgatcagctcctccccgagctgcgttccgaaatctcggccatgaacaaagagccgccagccggctgcgccacctcaaccgacggtaaattcaggacgaagtcgcagggtaccgactgaaggcgtacctcgttcccctttctgattttgtactttatcgcgtttgtctcaactttgttttcccacgtgtcaagctgcttaattttctagtttgtgttgcagtttttctcacgcgcagagttcgagtgcaaacaaagcggacaaagcctgtctcgcgacaccgagaggttgacgccagtgagttgagggcgctcaggggattctgggactttcgaattccaccgctcgtggacggtgtgaagtccgctcttcttttccgaccatttcacccctctgtacatttgtcctgtcactcgtgtcaacttcggcgaccagagtttggccagtcacctcgctgctcgaccctcaaccgtcaacgccgtcgtgttcagtcctctgtggcagatagcaaattgggtgacagcttcctgcacaaatgtatgcagaaaaaacaaatactgactgcgccggcgacgtatctcgtcatcacacttgcacagacacgccgcagccgctccgctcgcgcggaggtttcggcacaccgcctgtccgcgtactgcggagtacacatgaccgttcacaaacccccccgtccttaagtgcactgaaagttcgattctcagcgagggtatacccacatcactgcgtcggttgttcactgacggtttggttcttaggaatctgtagttgagtttgaagcacagaggattcacga

SEQ ID NO: 3447 - DNA, 2313 bp, Toxoplasma gondii
tccgtgtgtacagtgacagatgtggaggatttgcatcggtggatgcgcaagtcgtgtctgctccacccgctttttgaggaggttcccctggcagatttgaaagacgacccgtgcattgcagcgattgaaagcgataccgaggaaggcatgaaggtacggcaaggtcttcttttcgagcttcgccgctactgctgggacagcaaattatgtacttgggcgagtgttatcaagcctttgcttccgaatagctttcatggagaaccagaaaaagttcgcgtgtttgactgtagcatgagattatcagtcgcggttttgtaggagacaagaatgtcggagatctgacatttgtcattgaagtgaacgccgagttacgacgcgtttctatgcaaaatcgtggcgtcaacacactggtatgaactggcacttcatcgcttcgtccgcacaaccgtcgactcgtcacttcgggtctcctgaacgagaggcgtgacgaggcacacaacggacaaaacacccacaaaatctgcgtcgcactcgtcgattttgcgttcaggtcaaacgcatggggcagccgtgttacacttgcgttttccggaggaaatccgacttgcctgtcgactaagaaccgcatgtcgagcgcttcgccacatcgcagtcaactttctcgttccacagcctgctcggatacggcgggggttcgcggccaagacgcaaaaggcgggaacctattgtctgaattgtttaaccgagtatcaacatagatgcagagagtgccggcacacatctttgggaactgcgaaaaagactgggcttcgtcggcgcctcacttcgcgtttcctgcatacagcttcctgtcgaggttatggcggggaagttcatgcttgcgcaaggcggtctggtcgaaggaccacacagactgaatcacgctggttggtggttgtctttttttttcggtggggggggggggagggacgacgcaaaaaactcaaagttgctgcggaaattctgcacatctctgcggctgaagtggcacaagcaaaacagctttacaggctctcctcagtgaaagaggctcaccgttaaagttgagattgtgcgaaagtcgcatgaatgctttgtctgtcacagcggcagaagagtctttcgaacctgacgcacctgttccggttacaccccgcaagcacagggaactaacactatattgattttgtgtatcatatccttgtcactagttgctgtcgtaccaggcaacattctgaagttccatcctgttgctacttctctaacaagatcttgaacgcaagaaaaatcacaagactcttctgaggtatatctaaacgctaaagattaggtgcctacacagttttgttgctatgcggagacttatggaggcagtgaacagctttgtagctatgaaacagaatcactacgaacgaatcagatgtccacatcccacaattcagtttctcgaaccctgtgtaactgtgtagacggtttctcgaccagtcgttcattctggtccatgcgcagtcataccatcctttttacgtttatggtaccatgtcgcacaccgatgttcccgacacggtggacatggtatttcacagtttccacgtcatgccggatcccactcaatgcagtcacgttttatgacactaaagtaacatggctgctctggaaacacttgttttgatttgatacttaaaggaatcatgcccaacaggtccttggcagcaccagcattccccgatggacaatcccgtggtttacatatcagctgcattgctcacgctccgtgatcgaccctgacagatctgatccctaagccgcaggtcaccctgttgaagctggaacctttcgtcccacattgtacagggagtactcgtgtgtgagacaggattatttataagcttattctatggaggagtgtacacagcgagttggagtacaggtttagattttgaaggtcgtcgttcaccagatccaagttctagcccatagatctattttcatgaagggtgcgaactagtcatatcggtgccaatccaattaaagttgttacaacgctgtgactgtgcacaggcgctgcttcttctttcttacggtcatctcactgcttccacactcgggagttgcgagtgtctcgaccagcttttcagagttcggatttgacgcccatacgatacccttctatctgaagctttgcgggcagcccttttctagtgttaagtggcgatactgtggttttttcacactgctttctcaactacggttagagctgatgattgggcgacggtcatccgcacttcactcagg

SEQ ID NO: 3448 - DNA, 3050 bp, Toxoplasma gondii
tgaaggaaccgaacttcttcgcagtttaaggtaaacgaacgtacacgttcgtataaaacgcaacgttttttctcgcgctccttcagccatctctcttctcccttccccctcctttccccctccgtcccccctccaccgcttcgcatccctctccatgagcgacgcggaacgccatctccctcccctccagctgcctcgcgggcatcctttcgtcgtccttctccttgtcgtccaccgctgtgtggttttcgcctcgagaaacggaacatcccggaccttacctaccgctcttctcctctacgtttctgtgcggtttcctcacccagtgtctcgccttctctgctgtcgtgcctttcctcctctctgcatgccgcgtcctcgtctccttctgtggcagaccagcagacgcgtctcagccaagcgagcggcctgagtgaatgcgtcaggttcggagaagcggacggggattcgctctcgccttcgagcgggtgcagctgcgccgtcgcctccgccgcgagcggatgaaatgccgaggaagagagaggcaggaagctcctctcggacttctcgcgagtcgcagatgtctcgtccatcgtcctttccaccgcagggtgaacgtactcactcacgctgccaagcaggtcttgcaacgcggtgtcctgactgtgcttccgaagcgaagaggacgaacggtccgcggctctgagggccgccagtttcgcgacccagtccatgccgtacggagacgcatccacgaggtcagcaagacaagcagcggcatcagtctcggctgctgcagctgctctgtcgacaaacgattttgcgtcgacagagcgacaagcagctcgccaccacggcgacatcagcagcgcggctgcgagtctcgcttcttgttcctgaccatttttgttttcgccgtcgccttcgagcggagaatcgtctgcggcaccctcgcccaggatcgccgctgagtctccgccagcctcccctggcttcgagtcctcattcgagtgtacgtacagcgcacgctcccagatgaggtgggcgtctgcgagcagcatcgctttgccggcgtccacgactctggtgaaaaaagcttctccattgccttctgggaggagttctgcgaggagccccagcagttcgacagggactcctgtctccgattcggctcgacaagaagacgacggaggagccagcgcgagaagatgggaggcgacggtgtcgtagacgagctctgcagcgacttcggcgttctgcccgaggcctacgccctctgtgacaagcgcgcagaaggctgcgaatggcgaggcatctccgccatcttcccctgtgagagaaagggcgttttggcctctttccgagccagtcttggctcggccgtcgggagcacccgagagaggccgagtcgacgagacagagagcgcaggctgtagagacacccgaagggccggctgcgtgaggacgtagtcgcggacgcgggacgagaatcggcgaggagagaaagcagaagaaatcgtctgaggggaaagcggaaacgcactcaggtccaccgaaagagaagagtgcgaggcgagaccgttgacagaaaccgcgggatgcagagcctgcggcgtcggagaagaggaggaagacgaagaagatgcagaagacgtagaagatgcagatattgcagaccaaggaggagaaggaagagggtcgaacgtttgaaggagcttgtttcgttccgctgcagctgtcgcagcgtttgagaagcgaggaccgttgtgaggtcgattcgtcgcctgtcgtggagtctgagaaagagaggcctcgccgtcttcagtgtctgctggagatctcgactgcgagagaaggtcggcggtgaaacgccggaagaaaagaggagaagacgctcgcgaacgggaagcgaaggcagccgaggagggagaggagggagaggacggagacgagggtggacggcgaggagggtacgtcatcttcagagaaaaaaatgcagacgcgcagatgagagaaaagggggacagaacgagggcagcacagacggaagccgagagaagagggagggagaggagagagtcagaggagagaatcagacgagagaatcagaggagaggcaaagagagaagaacagagcgaggagagacgaggaactaaggaagagaatacccctggggagacggaggagaacagacgtcgtggagttgggagaggaaatctttggaaggaagaagaaaactgaaggacgcagagatcgagaagaactcgggagaaaaagagagaacgaagtcagagtggtacacacaacgaagccgacgcagaagagaaagtccatgcgaaaagcgttcgctttgtcgcacagcgccgcggttacatcttctagggaaacgaggtagaagaaaaacaataggaggatcagaaagcagcgaagacaaggaactcaagagactcgaaaaaacagtcattttttctcttcttctcgaccaaagatagactgtctttcgacgcagcacacaaggtcttcttttcgtgagcactctctcctcggatatagcacacagcgtccgtgtctcgtctcgtcgagtgagttgagagtccttcctgttctcctccgtctctccactttctcggattcctgttgcttgttgttgtcgactgtttttctcgagtcttggcatcgtcgtcttagatgcgaaagggagaaagggatccctctgtggtgcgcgagacttttctcggtgtcttctcacggggccgggacaaagttcgtttttcctcgagaacttcgcctgttttcctgctctcttcttttaaattgtttcctccggcaaagcaacgctcttgtcgcgcaaatgctggcgtcagaggcgccctggacgcgcgacagcagctgaagcggtgttcgttccaaagcgttcgctgaaaaggactctgaggaagcaggaagagacctgaaacaaactcagcggctttttccccgagctgcttggagaaaccacaaatcaaagcgctcttgctgtgtccgtttctccgttgctctctcaacaaca

SEQ ID NO: 3449 - DNA, 906 bp, Toxoplasma gondii
ttggactggctcctgtccatttgctcatcctcagatccatctccttctccgtcgcattctgttctctcgtcttctttctctgacattctcatttcaattctctctctatacctcgataggcgccatcctgatgtttctttcctacgccgtcctctgcactgcttccattctcgcaccttctctcacttctttctctctgcatgtgtgcgtttctcattcgctctctgcgcatgcctatctatttcggtctccctctctttccctctctttctctctctgtgtatcgcgttccttctctgtgtgcgtctctctgcctccatcttctttgccagcgaggttacctgaggacagttccgtatgcaggagtgccgaaggacgcagtggacccgataatggtttctcccgcctgctcctcgaaggctccggcgcccttcagttcctcgatgaggtgcttaggcgactggatgcggagttgggcagaggccagctggccagagttccataagagagcgaagaggccgaggcagccgaggaagacgtgtcggagacagtacgcgcggtggggcaaagagacagggagacaaagcgcaaaagagggaagtgaagcgggagacgcggcgtgtcgtgcctctggccgcctgcctcgtctgcggctctggggggcagcagctagttggaggggaccaggaggtggcggcggcatcgctgaaagactgtgtgttgacatctgggaaacagtgaagacaggaacctgtgaagaatcttaccgacccctccgcagatccatacctacaccgtctcgggtgtttatccataaatgcagggatccggacagcgtttctggcccacaaaacgcaagaaagggacacgcctgcaggcactcggttctgtagagtctggaaaata

SEQ ID NO: 3450 - DNA, 2499 bp, Toxoplasma gondii
cttctgtggaggatccagacggaacggaatcagacaaaggagagaaagaagaagagagagaagaacctgaagcagaagaagacgaaggagaagaagagaacggagaagatgccagagaagcggaagaagaggagggacaggaaagacgccttgtgtcggtggagaagcattcttctcgggagagagccagacagttggaaggtcgcgaggcgtcacaaaaaagggatttttcgtcatttctgagcgcctcgtcagagggaggagaagcaactacgaaggcaacaacagaggcgcctttgccatttggctgcctgtcgcatccgaaagtggaagagaacagaccgagacagaggaaaagaggaaatagtctgggccaccctgttcgtgcgtgcgtcctgattaacccctgagatcttcgtgctttctccttctcctttctcgctttcttttgagcctgtggggaggtgtgagtccactgggagactgagggcggtctttcctctatctgttcacgagggccaggaaggcgcttggagactgactctggcgtggagaagctgccgttgcttctaacgccgttcgcaactgaaagggaacgataactgcggcttggggacagagcgaggaagcgcctgtgctgcgggcaccgccaccagtgaaccgcctgctcagcagccatgcatccctggtggccagacgctgctgttgcctgcctcctcctggcgtccgcttctctcttttgggggctcgttttcttcgctcgtttttcgccgccgcggaaatggagacagggagaggctgcctcatccatggttttgcagcggatttagagaaggcaagggaacacggacggatctcggaacccagccactgtcaacgaagtatcgacaatgtgcccagcaaagcgatgtcgacacatatgcacatgcaaataatacacatagatatgcacgaatatgcaattatgtacatgttttatacgcttgcacgccgtgcgcacggaccctgtgtaggtttctttcgagcggatgttccggcaggcctgtggggagaagtggagaaaagccgcgcctgtcaaacaaaaacgtctatgactgttcctggtgtccttgatgatgcacagagttcgacgtcggcgggaaagcctcttctcgactcgacagcaaattgcccagcgaggctgctgacatgcatctctgcccgctaaaatggataccggcgtgcgtgtttgcttacaggtgtttgcggaattcgccacaattcacacatttgaaggcaaagtgctaaattcaccggtttacatgtaccgtaagatttgcttgtcacgtcggggccagcagctcggcccagctcgcacgttcgccggctggaggggcagctaagcatgctcaccccgctacaaaagggacttgttcagtgagcctaaagtacctgtataacggagtttcaacggtgcagggcagaagcgaaaagctctagaaagcggtggactgtacggccaagttttcacttcttaaagtccgccgcatgcgcgtcacactgcggtgttctctctcgcaagacagttgaggagcgctgtgctgcctttgaactgagttcgcctccgtagtgtgcctccctacaacctgcgctgttgaccggctgtgttgcttcggggcatgagtacaccaggtttcccctcgaaagatgcctggctcggtgtttctgagagcaaaaacatatgtttcgtgcgtgagacacagagtaagcgtcgtgccaaggaagaatcgctctgttggctgtattaaacaaaaaatagaagggaaccctgctgtcgtcgccgcacgcgcgctagcgacgtcgctccagtgtacgtccccctcagagtgtcgtccaccgttttttgccaagactttccgtgcgcgttcgcggagttaacctctattgtgtggtagagcgtccagtttccacaaacggtttcgtcggacacttcggttgccggcaagagaaaggcgaagacacctgctatggggggaggaagacagattcttctcaacaaatctccgccgtagacaacgcgcccgcgcgccagcacctacggcgactccgtccctcctggatgggtgtggacgcgcgacccggattcctcccgcagcgcgttctctcgctggctgttcttcggtgacctcgcggattctcgacggaattcccggggctttctcgcctgtctattccgaagttgacaggtgtatgccgatgtctccacactgacagtttcactggaacgcaaccgcgtgtgtggcgcagagtttcgctcgttgttaatcgccaacctttgtaccgcagcgcgtttgctgctcgtcttggcggcaacacatagttcacggggcttcggagtgctctgtcccgccagacttttccattgtacctgtagagaaaaagcgcggcgcagaacggcttctcgcgatccacggattcaggaaaacgtttctgcgctttgcaaccgcgtcttctaaaaaa

SEQ ID NO: 3451 - DNA, 1348 bp, Toxoplasma gondii
agagagagaaagacagagagacgtatgacaaatacacagagaggatcatgcaacgaccggctcggcaagggatgccgcctgtgttgggtctcctacctcgctgaatgaggcactgtgagagatggtagatgtgcgtttcaattcctccgagagaagggaagaagaagtcactgaccatgcaaatgcatatctgtctccttcgtctccttgtcgaggcttgggcgttaccgccccctctcggcgcctccatcctcctggaagaagcctcgaacgcgcccaagttgaggcgatctacaggtacgtgagtctctgcatatggctatctgctgcagtcgagacaggctccagaatcctctgcatgcttctctcgactgtcgcatgcagataaatccgcgagcttgttcccagaaaaaggcatccgcaagcgtggagcaagtgaagagagaaacaggagacgaagaagagggtgaggaagacaaggcgagaaagcgaagaggaagaagagaccgacgagaagtgagagacaagagaggggaggggcgaaaggaggcagaaaggaggagactgacgagagcgaacaggcagaaggggacgaagaatgaaggaaagaaaacatgacactcgaaggcgacttgctgggcgagagagcgacgacgagatcgacgacgagatcgacgacgagagcgacgttttctctcgccaccggaggccgcggcaggaagagaccgggggagagccgtaggcagcggggactccgctaaacgacacagaagaaatgaaacgtgagactgtgtttgcttggaagcggaaagttgaaaagcacagcaaaaaagacggagagaggtcctcggtctggcgacttttttcgagcatgcatgcagccccggaaaaagccaacgcatgcccgtaggcgagcactcgtctccgcttttcgaaggccatccataagtcgcgtttcctttttttctctctctcactcgctttctcttcaccagtggagagagaggctcagccttgtctcttctcttcgcgcgtcttctctccctgcaggcgcggcgcgaggaaggtgacgcacacacaagacacaaacgcgagaaggtatctcgacctcgctccagcttcacctgaaaatggagaacgccgacatcgcaagggagaggagacagaggcgaagaggcgaattcagacgtcgagaaaggagacagagaagaagggcatgaacgaggcagactgacgaggcgaaggtccgtagggaggcctctgtcttgcgcgtctgctgctcctcataccctcttcggaggctgcttctgactcgcgagcaagttctcatcttagcttctccccaaga

SEQ ID NO: 3452 - DNA, 1524 bp, Toxoplasma gondii
cttttgttctttgatatggtcgaaagggcaaccctctttttcacgctaccacaaccgtgcagttgaagcagctcccgagttacagccttggtgacgtgtgcccgttgttggttgacaccagtggaaaggccgtcagcaacacgaaatcaatcttctaacaggagctggtgctgaagctgccgccatcaggttcacaaccagcctacaaccgtcagcattatcgagagcaaatatattcagagcgtcggttctgcgccaaacgccccccccctccctgactcagtgcgtgctcgatactgcaagcatggttctagcttgcttgaaactacgaaaaacgaacctctgtggagacatgcgataattgcagaagtcaacctacatagacacgacgtcgggatatcactggaaagcgctgtatgagcacaatagcttcgcttcgcctgcaacctcgcgcagtacaggttacataagaaacgtcgtgtgccttcagtttccagttaccgatacctctcttattcgccagttgccctcgatcagccttcagagcaatcttctacagaaaaaggcgacactctcaattcccttgctgtgctaccccacacagaacgttgtcgcacgacgtcaccacgctaaagttctgcaacaatgatccattgatggcacgaaaaaaaatccagcacattgtctgtatttactggcttccatgcttctgttcgcagaaatccgaccacactgtacaaaagcatcaacgatacacggagcacggaagaacactcctacggcgttaaacgattcgcaagagttcgcacccacgccaacaaattcacccaagctggaacaaacatgggtgacaaattgtttgtgcccggcacaacgacactgtcaatgacttctcgtgacacccgaaatctccttcggaaaggcgttataggagttacaaaaatacaatgccagcatatcaaacagcccctctcccggaatttctgtacgaccccttcgaacccctgcctgtcatgcgggaaccccgcgaattttatctgattacaaaacaggtttcaccaaaatacagcaaaggagtcgcacaacaaaccatggaacactgaaaccggcgagcattgcgagaggacaatcgccagcgccttgcggacgactttttgtgccgaaactgaagcagggagacccattatcccattagagacgacagtagaacgcagtcacaacggcgatttggggaacggcctactatgcgaaacatgatacttgtattctaatcaggtataaaaacgtggaacaggcgcgtgaagttttattctagagtttcgaaggtatagctaagccctcagcgtaacaacgtttgctgacgctcacctgtgtaaagctgcgtcgcatctgcgtgcccatggggtaacacgcaactgctgctaccaggaaagtgtcgctactgtgaaatcgctgcttgtttacctgctttccccctgctgacatttgtttcagacaggagagagagagaggtgtccactggga

SEQ ID NO: 3453 - DNA, 1601 bp, Toxoplasma gondii
atgaaacattggagacgaggcatcctgtttcgaggctcttcgtttcctttcagggaattctctgcctcagaagctgttcaagagaagacctagacttcatgaaaaaaagtttacgagacagcgagagagtgcagtggagagaaaggcttgaattgcatgggcgtcagtttttctgaaaagagggagaaataagcgaagttaacagcgagagtaggaacaggtgtgatcagctgcgcggcgagcgggagctctcaagaaaagctgtggttctcgttttcctttaaaggagatcgatcgcctctctgtgcgtttctcagcgagagaagacgaaaggctcatttgaatttcgcgtcaagaaatgtgaacattttctccggctcctgcgtttccgctccaagagaagcttgacgcttcacctgtctttttgccgagaacctctttgcatgaactggtttgtcaacgcgttgtttctaatttaaacgaatgttttggaacttcctgtgctccaaacggaggccgtatggcgagtcgaggcgggcaggcaatttcgagtgtcacaggcgcaaaccgtgacagcgaaaatgactccttctctctcttttgtgaagaaagtcatcttccctgtgggtccctcgcagtgcattaagagtccacaggagggtcggttgcggagaagaaagccaggaaaaacagagagacatcgacacagagaagagaagtcgactgcacagcttttctgctagtaggcgagaacaaaggagacgcttcctacacgaggccaaaaaaatttcgtttttctctcagcttcttcccagtgccctcttctcttgaaaaacaagagagaactcgctgagggcggaaagagagattcgagtgctcgcctttcagacatctgacaggcgacgacaaactggctctctcgccagaggaagcgggaaggctcgctttccggctggcttccatgcaggacgaatgactcggtgtttttttctgaggaacgaggatttctctcctgccctctgtccgcaggaaaacaggttctgctttcctcacgttccccgggactcaccaagctgcttcttgccttcacaggccaaaacgctttccaccgttctcagaaagaatgatgcgtcttgcccggactccgggtcgccgctttcaagcgaaaggtcacagttttttctctcgcgagaaacgctggacttttgtttccaggaaccacgagatttccttctctctctgctcaggctctgtccacagtcgaggcgaagtccggctggttccgcgccttcccgagttctcacggcagtgattcagagaccatacagacggtgtttcttctcgttgtcttgatgcatttacttgcacaaactataaatagattctacagaagtaaatgcatgaccactggaatacacgaaggtgtaggactgccactgaacctttgcagcgcggtgtcgcttttttttgtttgtcgctcgtcgtcgtcagtcgcgccgagaacctagactgaagatgccgctaactgacttcgtgacggtagagaggcaaccatcttggagagagggaaggcgcagaagaatcacggcaactgtgaaaaa

SEQ ID NO: 3454 - DNA, 2208 bp, Toxoplasma gondii
ttttgggagagcgaacgtttccacttggctgggccggacttcgacgcatgcacggccgtcttcgcgaacgttgcaggcaacgccctcctccagataaagcagctcggccccgcacagcagtcctctgccgcggcaagccgccgcccccgttgcagaagacgcagaagaggcagaagacgcagaagaggcagaagacgcagaggaagacaaagacgacgagccggaagaagagaaagaagaagctgcagccatgttgatgtgcagaaggcagcaggtccttcgagaggcgagaagaagacggagaggagcttggacgggggaagaagaatgggccgaagaacagaagagagaaagagaagaaaccgaagagagaaagcgacgaaggggggaagaagaaaggaagcgaggagaacgagagagaagcgttcgacgtcaagtgcgagtgatacaagtcatgaaaggcggcgcgtgaatttctagaaacaaatctgtcaacagctcttgatgtaagctggaaggagtcaccttgaaggctcggcatccacctccatttcgtcgaccccctcgctccgcctttctctttgaatttagtttcttccttgatttctctgttttcacgcggccttcttagcgcgcgtccttctccgtgtgttcctgatcttctcctgcgtccgttgcgttccttcgcttctcttcttctccgctctctctctcgtctctgctgcggctcagaggctgttgcgcgaggtgactccgtctgcagctcttcagagaaggcaacaggccgcctcgacggaagaggcgagggaagagggaagtcgagaaacggagctgcaggagaaggaagaggagttgtgaagcggcaagagaaagaagagagagaagagaaagagaagagtgaagagagaggaaaaagcagggcgttcagaagacgcaagacgcacacagagagcggtccacccaagaaaaactccgcaaggagacgaagacaaggaagacaaaggagaagagaagaaaggacaagaagaggaaacgacagatcctgtttagggaaagtcgagtcgcccctgcgtctccagtggaggaacagcgggaagtcgcctgcagacgcagaaagcagatttttgtcgacgactctcacctaagcaacagtgaagaaggcaagtttccttctttgttgaaggtctgaacaacgataggccgctccctttttctgcacgagctcttgtttcttgacgttcagcggtgagagtggaggaaaaaggagctggaggacgcccgcgtcgtcttcgacagctcgaagaaaaaaaagagacgcggacgtcagacactagccaacgagcgcgagaagcaaggggagaaccgaggcaacgacgctgccggagggaaatcgaagcgcaggcagatgcgaagaggcacgctgccgaatacactggagagccagacgagtcgacagcggcctttcgcttcttcagcctggaaacagaaaagttctcgtcgcggacagatgcttttgaggtgagcaaggaactcgtcttccgaccggaaagagtcaaaaatcacggaaagaaaaggaaaaggcgcggcttgtcactctcccccagcgcgaatcgcagaagactgcatgcagtcgcgctgaaaaaaatcgacttcggagacagatgcgggacaggaagaaaaacgagatcagacgcggtgtctcgcagaacgtcaacaagaggaaaagagacttgcgaaaggaaatgtttcttctgaagaggttctccctcgaatattgcctgccctgttcctctccctctcctcttctcgcctctcaagtccctgcgtcgcagtcaccgaccgcgttgagtccccaactgcactgtcgccgctcttttccctctccgcgaaatcgctctaaaacctccggcatttctttctttctgagtcttctcaacgagcttctgctctctcccgtttctccctcgctctgctagttctcctttatctcccctctgttttctcttcttgactcttcctcctcttctctctcgtttctttcacttccccttgttctctgccgccatcttcctcttctcgcgttctcgctcttcaactctggacctcttttccgtttgctctcagcttccttccccgtcgctggcctccgcctctcttctctctccctctcgtttccttctcgccggctgagagagttccttctcgcaa

SEQ ID NO: 3455 - DNA, 2762 bp, Toxoplasma gondii
gaaataagatgcccaccacacgaatgtacggttctgcatgtacgttgccgcgagttggaacgctggctcctcctgtgtatccgccgtatcgacactcgcgtgttcccctggatagggtccccaagtttcaaacgggtccaaaacaccgggggacgtcctgattgtctggaggtggcgggaaccgaaaaccgtctggcagcaggaattgcttccataaggtgataaagaaaagtggacaccaatcgggccctcgaaaagccgtgatctgtcccattcgctaagatcaacctcgtctgcctctgtggacggcttgcaatctcgcattgcttgtgcttttgtcgcgctgcaggatacccagtccagagaaggcctttcagcagcctggagcttcagtctctccatcctggctgccgctgccttcgacagaacatgctcccagggttcgccaaacccactgagagcagtcagagctgtaccaggccaccctcccaagatccactccgtatcgaatccgccctctccagaaaaccacgtttgatgcttagccagtgcatatgttcggtcgctgcgaccacggccaaaaaagctcgccgcgtctccacgagaattcagcaccgactgcaaccgtagtgcccgacagagtgcgaggattctcaccgcgaaatacaggtatacaaccaaaaggacgcagcaaatgaatgatgtggttgacaggcaggtacccacaactagcctcgtccacggagcgagaaactctgaaacgaatggggcgtgcattttcgctgaggcagcgagcgctgaaaaaaagtctttgttgctctccgcttggtttgataggttgctttcgtcggcggcaacctcaacgggctgctcggcggggacgaatctcctggtagcatttttgagggaggtacggtgctcggcctcgtaaaagccatacgccctttgtggtttcaaatgggcgccgccccccactgcggaaatctggtatacctgttcatgagcctcgtggttgctcccatctcgtgaagacttaccagagggccgactcgtctcagcagtcagctcgcgagcgccatgcaaggtgaggccttccttgttcggtgaggtgaaacggttcctaatcaaatgtgtcagcgtcttgcgcctttggttcccgacgtcttgatccaatactctcttcggatcgcctctagtagaaaccgattcactttcactcctgcccagcagcaagagagaggcctcggacccagctcgtctccgctgggggcctgaatgaacaccgtctacatgggtggcagtcggaggagcgtgatcttcagctgaagaactggtattgatagtttcttcaaaaaaactggttggacgcgactgacggacacggtaactcaacgaggccacgtcaaatgtggccccctctcgctgaggtattttccttgtgaattcagcaggtctcgcgagggcaagaggtccgggggtgaagacggatgataagaaagccagtagaagtgccagaaagatatgaaaaccaatccgtgtcaggagcgattgagtccctaggcctgtgctgcgaaacacgccgcggctgctaggttcttgctcactgcccggcgttcgagacaccatcatgaccgcgtagggagaccatcacgtctccgaaaagtgaacgacggccctcccgcaaatatgacacttttcttgtcaggttacggaaacggagcctctctgtttcctcgtgaaaagctctgccccacggagaagacaagcccagtcgaagctagcgtgggtgggtcacgtccatactagctgggcctgcgaatgagctccgcgtcggaggcggtgtcccggacaaacatatttcaaaggtcggaagataaccgcagctgacagggccgattgaagaactttcaaccaaacgtttgacacgagtgctgaacaaagaatgcagatggactcgggcgcagaaggaagaagagaaacagacacacgcacgcaggtcgcttcacgtagctgtcttgactcgccagacgagtgcgctcttcatcctcgcccgtaaacgcgatctccactccccccggttttttctgcatgtgtgcggcagaaatttgaggggggcgccacgcgaaagtcttgggacggaagatcttggacacatgtgacaaggtttttttgcggcggtcaacatctttccagaactgcggaacattctagaaaagggtttctctgccatgtgtgcgaagaaacctggtggtgaacatcagaatcgcggacgttgttccggccactcgctcttcacccattgctggcttcaccgcgcttcgatcgaaaaaaaaagtgacgagtagaaaccctgaagcggaatctgtgcttctttggtgtacggatacgggcggttgactcgcagtcgccacaggtgccagcgttgtgatcgtgttcgtaggcgggcggttgaggatgagacgcaacgggggcactgcatgagaggagggtgagagggtcggcaccaagagctccgtatatattttcgacggtcatcatggaaagtccgcaaagtgaagaaggggacagagaagggagcgggtgtctggacgggaaagaaacatttccgaagaatgtaaaaggtggtgacacaggggccgccattttgaagcccgccttccccagtgagtatgcattttacaggtcgctccatgaacgctatctgcttcacctcaatgatgacccattttcactcgaggcgtttctgacgcagcatttgaaga

SEQ ID NO: 3456 - DNA, 3230 bp, Toxoplasma gondii
ggagggttttgacatttctcgttcaggatgcagaaactgttcaggacgctgctgctgcagttcctcactcttgcgtcgttggtgttttgaggtttagttctggaaaacgggcattgaatctgacccgcagttcagccacgtgctgctgaagtcagacaattagtgttgagtttgattttttttgtatcaggggcgtttcggaagtgatgtctttcagtcgcctatataaatctagtaacgctggtcaaggtccttgaatctaggtggctcaccgaattcctacgatcagaccgaaggaggtcacttgtcttctgtgcagacacggattccattttgtgaaacgtagaactgcaatccttgcagggcgtctgcacgagaagacggcggggaaccctgtaagtggcattcgaaaacacacacaaacgcgtctttctgtagacgcatatccggttacgacgtaccacaggcatttcaacgtcaccgagagtgctggttctttcccttgtagctctcgccgtctacgcaaaaaacgtaggacagtcattcatctgctgagctaggggttgcaccgaaaactgcgtgtcaaagtggcacagcggttgaagccaacagtagaatgcacgtgaacataaaatcagctgcattcaagtggaataagttctgttaagtgagcatcatttcctctacagatttcagttgttttccgctcatattcccgcagcggctttctctgctcgctggccagcctgagcgagtctagatgcaaacagtaaaagtctgtcttaacagtgctgcgagtttgtgaagcgcctgcgtcgttcgtttcctgaaaacagaaaggacgttcatctttcacgtgtttcacttcttttggtgggcacggtaacagtagcactattcggtgattctacgtactctgcagatacgggttagactacaggtttagggcttgaaggtctttgcttcccaaaccgatgtactatcgtgttctgcatgaccacgtgaagtgcattaaatagcgtgagtggtcatctctgagacaagatggtttaaaagctttttattgagaaggtagatactacgagttaatctggtttagatcttggtggtctttgtttaccggatcaaaaccctatttgcatgaccatcatgtggggtaccacagcgaaacgaactggatggagaaagtacaccatatgaatcgcggattttgatgtcaacgaatttcgagttttgtctgcgaacgtagaatttggtcctttatccctgggaggagctcgataaaaaactgcacaaaccggataagttcgtgtgggacacgttttagtcactatctttgttttcgtatatcggacgaaaggaggttttgtggccaagatgtcgcaatgttttctgtcgcgtcgaaacgcttcgtctgtgtattggcgactcagctgcagttcggtctcggaaggaatgtggcgcatgagctccgaaacaactgtcagttcggggtgcggtttcagttcttgtcttttactaatttctttagcaagccaactagcccatacagaaagaccatcgaccgtaaccgcgccgcattatgcggcggttctggccgacacatggtgaatgcgtacgtgtgcctctcatgagaccacacgaaatccgtcagtttctctgctttcttgccagttatccacaagcaagacgcgtggcctctcaactccttccgttcattgtggtttttccgggcgctctcactgcacagctgtgggcgctcgttgtgtgccccctctcgccgttagtcagggggaccgcgatgtaccgaagtgcatctgttttcttggatctgtcctcttctcgtgtccttttctgtgttagcagcacttctccgcagcggcaagaactttccgttcatacttaagtcgctggccattcgccgcagacaggcttttgaaatactgacttcgtagtcactcaaccaggaggtggcttgggcacaaggaccagccaaggattgtgcccgccgcttcttgaagccctattttgcgagttcttcccctcttcctttacggaaaagaggtcttccccatccgatacagtgaggacattccttgttctgagtctcggaaagtgatggcaatttctgcattcgaggtgactagcggacggttggcggtgccttcttatcgcggtttgtgctgcgcgagtcttaccggctcgcggcggctgggcacggatatggcagaaaaccgcatttcgtccgcatcatacatgacaggttccatgttttctctgccgcgtatccttgcgtcctcatgattgcaatacgcgcgatgattcctcggaatggtgtcgacgcatcccgtcccgtgccgccgctctgttgtctgcctcggtccctgtcgagcatcgagctgtcgagcgtttttctccgatgcgttgcttgggcaaacagacacggtcaagttaccatgcacagaacgctccacacgtgagagcatggactgatgtagctggactttcaagaggaacgttgatgcgtcttccgcgagccaaggacgttgtgttgctttcctgagtttaaacccagagtcgacgtgtgaggggcgcgtaaacccagcagcgcctgcttgcccaaatcggtcgtcaaatgaaaaaaaaaatccaaatggcgaaacccggtgaataagtcagcgactgactgaacctgtttcgctgaagtcgaatccaggtgtatgtgcaccccctgcgttccttcgcaatttctcactgaatgaccatgccaccattgctcaagagaatgaggaccgctttgctcgcgggatggacatccaccttggcactttccgctaggtcgtttcatccgtatgtggttcgccgacggtgtctggcttcctaggaaaacggttttatgaccgtatatgcctatcaggctagctgtgtctgagtccacgggtggtttccgccttcggacccgaaaaattggttgacggtttcggtgaagaccaccgcgagaatcaagctgtttggatcaccggataactaccgtctttttgcgcttcgtgaattcgtggttctcgcctggcaaggcgataagcctgaatgttgagcaggggatcagctgtcgctccggcggccccccgcctgccgaggacttggtataacaagcaaaaggacatctccagcgaacctcacggcgttgttctctttcgttacaccggaagatcgcgcttaccatttcaaca

SEQ ID NO: 3457 - DNA, 2974 bp, Toxoplasma gondii
gttcccttgttgacgaggttgaaggagaacaagactcggctttcgtctccatagggatgaccacaacctttcgccgaggccttgcagctgcggtgtacgtacacctcgcgtctctcgcggagggtcggagccgccatggttcgcgctgactccctcccggttggagacggtggaaactccccgaggaaaggaagcagttcgactctgagttagctgccggaacccagcccccagaaggccagacagaagcagccgcagacgaaagcgggggcgaactggtgagggagaagtagatcgaaggaccgggggcagatacgcgtgcgacgaaactcgccgccgacgcaaaagcagagctccgttgggatgaagaagacggacgagacaggggagaccgagaagcttcgcataatctccagacagaaaaacgaacagaaggagcaaatccaggtggtcgacaactcgcgacggcttggccgcatgcaagtgactcgctggctagcagggcataccgcggacgacgaggagacagagagagtggcgaggcagagcacgaggcagtggggaaggactgggcagagaaggacagatcagagacaggagggcctcggtttacgtgcgacgacaagggagcagaagagttcggtgcttcagtccagaaaggcgacggctgagaagcgacgagtctcgaggaggcctgacaatgtgaggcataagaggcagacgacgaagagaagaaggacgcggacagaggacacactggctttaccgacgaagaaaacaaggctgccagagacaccccagaggagtggcttcgtgagaaactgtggccgccggcatctcgcagactcgaagcgctaccgaatgcggacgaagagattgctccgcaggcgcccgaccccgaagaagcagcaagacgacgaggagagactcgagagactggcgccatggctagacgcaaagaaaacagaaatacagtgggagtcccagtgtttacttgctgccacttgtaatcgagtgcaaatcaggcctggagtcatgcgcgcctctgctcatctgtacatacaccccaacctggctgcggtgtatgtccacctcaacttgattcgcctgtgctgttgatgccgacgcagtcccacttgcaaatacatctccctcgacacctgtcatcagcggcattccacgtgaacttgcgttctgagtcatgtacacctcacgaactgtcgagggtaccaaaacctgataaaaacatctgatcttgcttcaggcatgcgtccacccgcactgactgcgtcgaccaagttttttgaatggcttgtcgattcagtctgaactagcgcgctgaagaggtgtctctacacagtgggcgcgccacaggcgacgaagactgtttctcccattttctccaccaagcgaatgacggaggcgacgaaacttccaccggggacctgctgcttcacctccctgtctccgccgaggcgtccctcttgcccggcgctcttctgttcagagagtcaaattgcctgcatcgagatccgataaatgctgcagattcccctccccggcctcccttcttctgctctttggcgctgctctctcctctgcgccttctcctccggcagtgcagaagcactgcagaagaaaagaactatacctgtcgaagaagacggggcggaagaattttgtctgattgctctctttcttgtgggaagggtgtctgcgaggcagacgagagagtggggcgaaaaagggagaggaagaaaccaagaagccagcctacgagagagagaaacgaaacgaagaaaagtctcgactccgggcgagtcaatcccgttttcacctacgtctgcttcgcgcggagagacacaacgcgtgcaatcttgtcgcagcttgagtcgacagcggccaaggcgtcccctctgcagacgcgcatcgcgtaaaccttggcaatctgctcgtcctcgctctctctctcctgcccctcttcttcaaaaccagggagaaaaatgtcaagaaaattggaaaacgctgaagaagattcgcttttacctcagcagacgcacacgcaaccacgctggagaagctgtagacgcaggccgagagaggcgctgcagcgcggaactgcttgccttggccacggcactgggagaaagaagtaaccggttaccgagcttccgttttttattcctggagccatcttctctgcagactgagactgaaacgggtgtttttctaccgtactcggattctctggggtctgttatctcgcgccgggtctcctcggcgaacagcgaggtgtctctacacctcggcgccgagcagctgaagatgtgcgcgcgttcgcccgcccttcgtgtctccacactgttcgctgttctctctcttctttcgttgtttctcgttctgtcctggcgtcaacttcttcagtttcttcgtccgaggagcagatctcctacttgtttccacgatttctcttcttccacccaaccagtgtcagctgtttctgcgagggaaccgcggctaaggatacacctgagcgggtggcgagacaggggcctttgcacacgcggcggaaagtcgtcgcactcctggtttctctgttggttgccgttttttctgtgaagacgttctccggccctcttcttctttttccttcgtcttcccgcggttcctgcctaccttttttcgcgtctgcaagtcccaagagtaaagttagatctgagctcggcgcctgccacgaaaaataaaccgccgccgttggaaattcctcgagcttctcccaaacaaaagtctcgcagccttcgcccggacgttggagtcctggagtgtacatacaccggccggcgggtcgagtcctcgtctcggaaacctgcgggagcctcgcgagtcgctgtccccgccgctctgcgaggaagttctttctgcatctctttcctgactttctcgttggtttcttctgcttttgtcaacgccacca

SEQ ID NO: 3458 - DNA, 1617 bp, Toxoplasma gondii
ctttctatcctcgcagacgttctcttctctctgcgttcctcactttatctccccttgctcggcttctgctgttcccgtggtgggcaaggaatcctccgcgtatccggtgtattctccctcgcgggccgtccagagcctttctgtcggcaaccgactcgctctttctcccagagacgatacgcctcagagccgattccgtgtcgtcttctctctagagacggagacagtatgagtggggacaagctgtgctcgtgcctcctctcagatccacttttggaaaaaaaggaaaaggtgctggcagacagtgcagaagaaacccggcgagaaagaaagcgcgaatagggtctcgttctgagaagtcggggacccgaaggagacggttcctccgtctctgtgttttacatttccagcaaccaaatcagcgaaaacgcattcagcaagcctatacacattgcgcagttgtaaacctacatggcgtgctcgaatacacacgaagcctcgcagaaggtcattccctcaccaacacatgcatgtacacatttagagatgcatgtatatttatacatatgcatatgaatatgcggctaaagaaaaagtgcgatgcatgtaccgccgtgctcgggttcctgcactcgagaatctatgcattcatctccgcatttcatacggcgggggtccctggtggagcaacaggctgttaacatagttgggctgtatcgaggttctgcgggtcattcttccgtgaggcagccgaaccgcagacaacttcagctttaacatcaaagggcatgcagtctctgcttcgaacattcatttgtgtcacgggcgccaaaggctgtctgcggcgagggcgctgagcagccctggtcgcagtttgcattcgagggaaggtacgggagaaaaggtagcgcctgggggcagagcgacgaaggctggccctgatggccagagacaggtcagacacgcagaagcactgggaagcgcgcggcggggaagtcgctgttcaccgggtctccaaatcaacattgtcttttacggcggaagaaagaagcgattcaccgaagcgagccaaaaaaaggcttttcgagtcactggtgtgcaggtccggccgaccggaaagctcaggtgtatgtacacctgaactttcctggtgtctgtcgagccgaaatctcgggtgtacattcacctcatgtggcgtcgcctggcaagacaagaaggctcgcgggcagggcggaggcagaaaagagcctttcctgcggctaaaacagattcgccaagcgtcgtagaccggaagggccacgtttcgcgtccaactggcggtgcgtggaggcgctggacttttttcggcagtgaaaaccgacacgacgcacgcagcgggctcgccgctctcgaggggaccctctacgtacaaggcgcaggggggcggcattcgcggcgaaaagccgcagaaactggagttctgcgacgacaatcgcgggaggtttcggcagttggggtcgcgagacagtcgtaggaggagaacgaagaaagaatttcttgcgcgaggtcgttcgactcgccgtggctcgcgtgcggtcgttgcgggactggaagacagagagagagcaacacagaaga

SEQ ID NO: 3459 - DNA, 3746 bp, Toxoplasma gondii
caaccagcttggagatgcgcttccacgcaatcccggaacctcctgcgcggggtggaggtacagttcggaggtctcgctgctccttaaatcgcttggcagccgacccagtgttcggtccttttcttccaggagtagttctcgccgtccttcggtgcttttggtgttcgccccgattccatcttctttgcgggtgtcttcctcagaaactgacggacggggatacgcaagagacacagtttcgtcgtcatccagaatcgtcccgacagacacccgttgcccgcagacagggaagccgtcggtcgcgcatccagcttccgtctgcagaatagacgccgagaaaaaaacgctcgacacggcgtcctctccgtccccatccccccttcgcgttctctcctgacgtctctccagagtcctctccaggtccgtcaacatcctctgttttgcacactgctccttccccgcctctgggtgcgtctgaagcaccagcgctccgtgcggctcgcggcgcggcacgctgctgccgaagacctccgcgtttttcttctctgcctccttgcaaacaccgctcgccacagttatcgattcagttcctcgtctctcgagatggtggcggacgcttccgcctctctgaaggaacctggtttcttccctgaccaaccacgcctcgcggaccttggggtcctctgctgtggggcatccgcctgcggccttcgcgtgactcgccttctcgtcagagctgccgtcgccgaagagcgctttcccttttttctcgcgaacctctctgtcctgtggagaagccttcggcatgtgagcgggactgtcgtcgtttggttgtgtttgtgcctcgtctccatgcatcttttctgatctctgcagaagtccacgttcgtcacgacagctgtaactcacccccctgctgaactgctggagacaggtagaagaagtcggcggagaaggaagtttcacagagacgaacgtctcctccgcgagaaggtcagctgctgcaaacctgttgacagcgagacggtcagtccgagcagcgacgcccgctgcacattcctgatctgtgcttcttgcgtggaaagactcgcagcgacacccggagacgacggagtgtccggggtcttctgaccagggtgcatctgaagaaaatcgaggctgcgcatgcatgcccacgctcccgtcgagttttatctggattccgtcttcgccttcgcccgcgcagaaggaagatggtagaggaaacgcgacagcgacggatggggtgctcgaggtggagagggagctggagagacgacgctcacgggaagaaggcccgccggtgacatcacggcctggagagagtgtcttgtcaccggagaaatccgcattgttaagtgacaaagaacaaccgccatccaccctcggttcaccctgtccgggtggagttggcaagtccgacatgaccagcgttcaagtggatagaggcacagcgagatagatgaagagagagaggcaaagacagaaggagaaagagacactgagagaaagagaaagagagaggatactgtaagatggtgaggaaggagaaaaagctaggcaaacgggagaggcaagaaggacatgcagttctgctcgcggtggaaagcctcagagaaacagaaaagacccaccagagtatcgccaggaagccgcagtttctcgagagataggaactgaaaccttgtacgagggacaaggaagcagcttgaatcaattagagactgttagaggtgaagcgaaggtgaggaagaaggtctttctctgagaaaacggagcgcgagtgtaccattttttgccagaggttgcgtcaccagtaagcctatttgcacagaaaggaaaatcgactcatgtgaagcagagaagggggaatactgtttatctcagagcaccgaagggataagatagacgtggaaagagaaacgtaatgattttgacagtggcgttgacgacgaggcttctccgcgtggttcgttagtcagttgtccgtacaccggcgccagtttctgtttcgaacaggcgcagcagtccgtggactagacgggaaacgcgtagggttttcgaattcgactaacaggaacaactgagagctccgtgttgaggcgaacaacaagaagagacatgcaaaaaaacgtcaaaaatatgcgccagagcctccattgagtgacacgcaagatttgcgggcgccgtgacacccctcaaattgaccaaagcagcgacgcacacgggtttacggtgtacgccttccgaaattaaaactccgaaatcgatcccgtttatctccaaagactgcaggagcaatacacacaaggagcgacaaaaaagccgcgtttccctcggaagctagcgagtcggccgcgcaggtcacccaggcttcttgttgtctctcatgttttctgagcgaggaaaaatagagacttcctttctgccgactcggaggaatctcgaagattcagagagacactcagaagaggaagcaacgcaaatatctcttttctggagtatggaacaagaaggtagtctctatttagcgcgtccatcctccgcctttgtctcgtagatcgcacactggcgagacaagcgcaaaggtgactccaccctcggtcaagcgtttccgactttcctcagcgtcaacgaaagtggaggctctcccggctgtgacggacgccgatttccagggaaagaggaaaatcccaagagagtgagagaacgaaagttcgacttgcgcctgaatccgcgccgttgtgggcagccgagaaagttcagttctcccgtttcctttgtctcttgtttgagagacacgcagagagggaaaggacttggaaaaacaggaattcgagaggaatcaagccacgtggattcttaatccttccttccagggacggcccactctgtgaaggtgttacatctgttgattgtgtccgtcttcgttttcgatttctttatggtaactgttacacagatgcgtctggtggagaccgacgccgggtcgattcgtgatatgtgctttaggatttttgtgcagaaggcaaacatgtgtatctttgttgctgctcagagagatagaagtgcctctagaaaaggtcccgggaaggctgtgtgcggctgtctcctctgtcaagactctttggtccgtccatcgccttgtgtgtcggggacagaaaggagtcaacgcccttttaaacgttgaaatgcccggagttttcccctcttcgttgcaaatcaaatgccgtcttcgtcgtccttcccattggtgtctctctctctgcgggaagccgcgagcatcccttcgccgcccagttctgtgtccatcgcagccgttaagataaccgccctctcgtaggcatgtctttccctccgtcgtccccggagactccttcgggtgcattgtcgattcgtcagaatcgtgaactttggcgaaaaaactgaaaaatttagactaagactctatcttttcgtccgtggtgccttcgcggatcctctgtctccgtcgctcccactgcctccgacaatccccgtgtgtctcaagtctttctctctttctatcgtccctcgtctctgttcttgtttcactattcttgtctgcctcttcgtccttctttcttcgggggtgtttctcttttcgtgtttccatctcgcgtttgtctgtaactaccgccgttctctcagacgggagtcgttctcttcttgctccggtcgcacaacgcacatttttttggcgaacacaa

SEQ ID NO: 3460 - DNA, 2564 bp, Toxoplasma gondii
aaaaacacagactgactacgaaggcagcacgacaagaatgcacagatggagcttggggacggggtcaaaaaacaggctgcagaggaccgaccttcctcggctttttggatcgacaagaaaacaacaaacatatcacaacggccgcagctctcccatgtcaccgcagaccgcggagttggtatgctttacttctgcagttgctgttgccagagagacgaacgctgagatactgccatttcacaagtcgtcgcagcgattcaggtttgaagcaggcgcctccgctcctacagcgcgagtgaatctggaaacctgaagctgcgactgtgactccctctccatcttcgacagctgctttctaaacagctgacagcaactcgagttctttgcttgacgggaagcgaccactacctttcagaaatgtgctttcaacgcattctttccgaatccgtacagttcgcttcgcagtcgtcaagtcacgtcttccctaaacgtttctccacagctcgacgacactggtgcctgccgtcaaaaggaactgagagttgcggtgttagaccagcagataccactactcgaaagcacttgtctcgaattctcgtctgctctcgagcgagctgacagacagctacagatcgctagaaacctggcaagctctcgcgacaggtgagctttcccgcgctgctgttcgcaaagaagagtaggcagaggtgcgtcagctcgtttctctgcttttccactttgggactcggagtcaccagttcggacatctttgttttgtctgcgacttcgcttggccgcagcgtgggcttcccgacagagaacagccggttgacctgcccctgtgtcgaaacgcatctttgtgtccagtgcttgaagagcggctgctgctcctgagactcgcgcgccgtggtttcgcgcatacagtcgctgcctctcagagctgttcgcttccaaaacgcaatttcacggtgctttgtttcttctttttgttcgggaccgccgtccgcaccccgtcagcctgttcgcgagaaacgcctcgcgcaacctcggactggctgcacattcgcactgagatccgacggcttttccagctttcgtccttcacacaagtccctacggcagggttcacacatgaaacttgcggttcgatgcctcttcagtgtttgacgaaaaaaagagtgccgagtttcgaactcaggagcagctggggcgttttttctctccgttcgctcggtgcattgtgttcaccgccgctcgggtcgcaaggcttttcgagtgggattgctttctcgtcgtgctcgtgtgaacaaacgaaagcaatcgatggagcgcggcagcgatgcggctccggagccagttgctcttcgctcgattcttcgtttttcggggggtctgtcgatcacagcaacttgctttgtcgaagcatcccgtcagacagttgcttcgcgacgcgtcgcgcaaaagaccctgttctctctcaggacttcaaggaggagttcggagaattccactccccgaaaaaagaagaagttaggactcgacgccccagtgccttgagaacaagccatcgccagggcaggtccctccagctgcgacctctgtggggggatctctcgatggtcgtctttttcgccagccgcgttgactgcgcgcgcggggtcgcgggtgcttctcggtgtctgacgttcgacgtttttcttccgtgtcactgaagaagttccgagttccctctgcgttctgcacattcaactcttctttcgtccttctttcaaagaagagaagcgactctagcatgtctccttctcagccactctcactctctccctgcgagcgtctccccgaacgagcgaaaaacgccgcgttgtgcctcgcgcgtgtgtctcctcgactcttctctccccacttgcttgctgcgcgattccgctgcgcggctgctgttctccgtccctgctttcgcatctttgcttgtcttttttcgcggaggcgcgcatgcagttcttcgccggttctcccactctcgcccgctgattttctcgctcctcgctgcagctgcctgaacacacggcgcgaaattgatcactgcggaggcagcgtcgaggatctcgtggacagtgtgtgacgcgtccagttctcggctcgcgcgttcctctcttcgtcggtcgaattctcccgcaagaagaaaagccgttcggtcgacggcaaaacactgctaaaaatcgcaggaagaagcctctctcctccagctctctgcgcgactctccgcatccttcgtcttggaaatccgagcacacagctgacctgcacagcgaaaaagatctcgcgcttcgaactcatctcccgcttcatctccaagctcccgaaaagtctccgtcgtcttcagtctccgctcaccatcccggtcttccccgcgtttctctctcttcgtcttcggagactgcgctgtcccctccgcatcgcctctctcttttcggtcgtcgcttctggtccttctggtccttctggtccttctgttccttctgttccttcttcccccgcgatttttttgcttcttctcgttcgcgaaa

SEQ ID NO: 3461 - DNA, 1443 bp, Toxoplasma gondii
actgacaattcttcaggaaaacgcgccaggaaaatggattcagaggggcttagacaatgcagcgaaacgaatgcgtcttgtggactggtggaaaaagtcgatttctgtttgcagatacatgtaacacttgtctgagtctcatctccagtttagaaatacggacgcaagacccagacagtgaagacactcgatcgcttaccgtagaacttgattttgtcatacagctgttttcgcttcaccaggaagcgcttgcgtttctcatttttcttttggtgaagggcgacactgtcgagggaggtgatctcctcttctagacggctcacgacttccggcggcagttcctggaggcagcaatgaaaaaaaagactgtcttgaagttcggcaaacggaggtggaggcatgtagccgctaaacagctgcccacacctgtgtctctaggagaaatgagaggagttttgaggcagccaacgccactggtgttcctgttgcgcacctctcgcttcttctgcaagagtcgtcttagatctcgcgcctttgccttggctgtcttgttcctgactttcttatctgccgcgtcttgtttggtaactccattcacttttcccctgaagaactttccgcgtttcatgctgtcgctcggacctcgggggcccccgctagcaatttgaggatgacccatttgaaatcgcctcttttctgagattgaggaacgaaacctcctcaagccggtatcactagcaaaaggctttagccgactaatcgaactggaatgctgatggtctttgaatttcgatacgtccgggctctttcgagactggtccaacaccttgtgcatgcagactcggggttcgttgcagaaatgtgaagaggcaatggcgtgtgaacaactgcagcgcgcccctccgactgagtcaccttcgaacgataaaggccacgaggaaaatatggatagcgacacacgccaaatgcatcagaaactagggctgaaaaaggcgtcttgcacagtaagcggccgcgcattttcactgtttcgctgcatgtacttgtcgcatgcagaagcactcgacgacgttcagctcccttggcttcacacattctacggtagactgtacgctcgcaagtaggatctcggtattttttacctttgatcaataattaagtcaagcctttacagttgtgcagtccacttttcagaaatctggccatgcttccttctgaagtgagcctggggtaaactctcggcatcgggtatgcggcctgtgcgctgttcagccgggcagaagaacagcgtttgggccggtctttgacgatgctacacaactgtgtcattcgcgagtttcatatgcagtgtttcactcattcatggtgcctttcgtcgattttttttgagcttgcgtgtcagcaaagttgtgcccccaattcttcaatgcggtcgagctccaa

SEQ ID NO: 3462 - DNA, 4649 bp, Toxoplasma gondii
atttctccacacctctggataccttgatataacctgttagatgttggtaggacgccgcgtaggatattgaaatccaaaactgtcagctctcttaagaagcagtccaggcggctggtggtgtgcttgctgtagtcatcaagaacttgactgtcggtatttcataactggagccgccgactggaggtggtttctgttatcgtcccgcctgcgcagattggaagcaatgcgcactctagctcgtgatttctacaattgctctgaaacagtgctatcagggatcatttctgcacacagggaacacgaaagaaacagagaatacagctagttcgtggcaagtgtagcaggcatgccaaaagacctctaggttcgacgccgagcagcatccacgataaaatttactggtagattttttgtgttggtggaaacagctttctggcgcggtcgtgagtgtataattggcgtccaagatttccacgtcatactaccagccttctattctcacgtgaacacacgagaaaaaccagggaagtatcattcgcagatgttgtcacaccatgccctgttcgttagtctgtcagcggagacagcgatgggcgtgttacgccgagtttcaggatcctaggcgacagtatgctatatcaagatatattattgtttttcggaccagaagcgtatattcgaatcttacgtggcttctgcctctgttcccatttcaccagatgcgcttcagaaaagctgaagagagccgattttgtgtttaaaccgtgaatcaacatcacggtgcagcccttccgagctcatactcagatccaatttttgcaatggggagtctgcgaatgccggtctagcggttttctgaggacggacggacagtgaagcaaacgacttgtgagcttcacctggtctgcttctagcaacagaagtgttctgttagactgaaacgaaggtgtcgcttgtcccccgtttacttgcacatattatcgatagatatcagtgtccgtccctcggctccatgtttgcaacaccaaacccgcagggtgtcgggcgaagaaaaactccgttctcagccgggggttgttgcgccgcgtctttctgctttttggttttgcagacaataggaaacaagaaacttacttgcagcgataacactttctacgcacactgctacgcaggagccgggtggtggcgaatccatccctacggcagctctcttggaagcagctgctcccttgttgtcttgattttcttctctgttgcagtcagcatctaggtatgccacatttacctctctacagttttctaaaaaaacgcttgcctcactaggacaaaaacttttaatggtttgcggcatcttttgaaaacgtgctcgtgatgtgcatgcgtccgttcgagagaaacgttgcgacacggaggaagagtcctgtgcgcctttccagcttgtggttccgcattcagacagggtgagaaagtcgcttcctctcgtgcattgtttgaacttttccattgccgtctctttgtttgtcttttctgcgacctctgttaccatttcctagcctcgacttcgccatggatgttttccggtccttctggaaccggcggggtgcggccccggggggcgccgccaccagctcaggtcgtcccgcgggatgccgcgaggagaactcgtcggttttgctgcagtctctgaaggctaactctcagcagaaaaagggtgaaacgcctctgcagaatgtggccgctgcggactacgtgacgccccagaaatacctcgatgacccggacaaaattcccacctactacgtgttccagtctaacatggtgacagatgaggatctgttgccgggaatgctccgcaatttggaagtcgacaaacgcctgactttgccgacgcgtacgcacattcgctttcttattaccgccacagacgtcattcactcctgggctgtgcctgcgctaggcatcaaggctgacgccatcccgggtaggctgcagcgaatcaacactttcatccagagagaaggcgttttctatggacagtgctcagagctctgtggagcgctccacgggttcatgcccatcgtcatcgaagccgtgagccccgaaacctacgcggcgcatgcaaagaagtggtacaaagactgagaactggtattcaagtggcagctcggacactcgtgaacgaccaggccagaaagtgataatcggtcccacattccgcacaattgtgtcctgtcgtctctggttagagcacaaaactcttatgtggagtgagaaatgcgcgaggaaggagggcaagcccgcgaggacgtgggtgcacacgaccaggcaactcttgttgaaaaacagcattcaaagaaaaatcctccgatttcgcggtgaccattcgttctgtggtaaagtggccagattgagacggtgtggtgtctcatggagaagccctgcgggagggcttccaatgtctccagtccgtagcaagctatgatgggatgaccgcgacagctagtcacgagggttcaacctcctcagtggagtcttgaacaaagagagatcggaaaagatcagcaggaaacaacaaatagttgcatcgcaacgttgggatgaacggcttgcgaaaactgctacgacgtttcatagacgcgctttttccgggctctggaagtaacatgttctgcaaagcacgtgcaggattttcttcgcgtgtctcctttgctgttgaacgttgtctcggtccgtccggttcattgtttgcgtgcgctgcttatccacgtttctccttagtacacaaatatcgcgcatctgggaaatacctttgttgaagacactcaattacttctgccaatgtgatggcaagccctgaagaaggacggccatttgaggacacgtggtagactctcacatattcttcactacatttcttcacagcttggtatgtcaagtagcccaagtgtggtgcccagccaaacggcgttcttcccggtcgtctctgcgtcctccgactaccacataggaaatgcgaaacagtgacgcttgacacgacccgcagagcgtgtattctatcggggggatgctgtggcagaaaacagcgggagatcagctggctccgagcacccgtcagacgcttgagcacttcaggatgtctcgtagcgtgctaatttggataaattagagacttctgtagagctagatgctcaaattttgggggagttgtcggtgaggcgctaacactaaaccagaaggggtcgggatctactgcactgcggcggcggccgtcgcgtcgactgcatctgcactttacgacctggagtttggctcaaggccacaaacgaaaactgaaggacagctttgttgcttatgctcggacagtagtcttctcatttagagagaacaagcgttatcacacgcttcgagaccccgtttctcaccgtctacaaaaattcgggtaggtgtaccgggtttccgtgaaacacgtgatcaactagagaacagtgtgccgctctttacaaacacactgggtgcgcctaccagaaaatccggagccatcttctccgcttacgaacatctgaggcgtaacgtcccttcgctggcaaagcagttggaattattaatccgtatataacaccaagaacgcaaccaatgtggcatgctcaccgacatctcctgcgtggaaactctggacgtttccggtaggaaggctttcaaagagccttcgctggtgtcactgtacggtgcactgcgtacgagaaaggctactctgtccactttttcttccacttttagtgtattcctttcgacgaccataattgccttcctcttacggtcggttctcggacacccaggaacgacctgagcctaaaagcgccgaggctgactacgttattggtaacgctcaggcggagttagtacagcgcggccacgaatgttttcattccatcaaagaagtatgcttcttctttcggaattttcgtcacacatacgttcacggttctgaatctggtgaatatgaacttgaatttcggttcgcgaatgcacggatgacaaggggaaacgcagcgacagtccggatgacctgagttactcggatgaatagtagatgcacttgtgccccacatttccgaagtacaaacgaatttgcccagtacttcaaggtgggtgtaaaaatgattgttctgtcattgtgagtcctgtcaaaagcaagaaaaaccttcctggattttctagttaactggctgcgaacgctgttgttgcttgcttcgaatacaaacagataaaccgtctggcacagttaagcgatctgtagatttcgctcgcaacatgataatgaagaaggcaattgacacctgctattcgagcttttacgctcagttgacatcgttcactcactctcttggcacaaaacagtcggtataatacctcgccgtggtgccatactcggagcgaatcaatgtttcggcgaaacaaaaggaactttggggagtgcatgcagagaagttacttcagtgctgaaagcccttgtctgttcttgggccccacctggactttgtaaactattctttttgtggggtacaaaacaagcaagcgcccgcggagatttgaagtccttcctgggtcctgatatttttcagaaggtgcagaggcgaagagaagaaaaa

SEQ ID NO: 3463 - DNA, 4506 bp, Toxoplasma gondii
acacatcagtgtttctctcgacagccatcctttcttcatattcagaaccatacatctaaatatttatatatgcatatgtatataaatgtatatatatatatatatatacatacacctggattagagggacgacactgaacagatgtttgtctgttcaagagtgcgttctagcacgctttgggtgtctctacaatctcgagtttttgtcctgcgtaaaaaagagtttgaactttttgcgttccctgaccctgcgcattctatgacacaagaccttgggccgtccgtcacgacagagtggttttctgcgtgtcttcgaaggtcccttttctgcttttgctgccttcttttggtgcacacactgtaagggaactccgcagctgttactctttgaaggatttgaggaagtttgagtgttgtgtcttgatagagtgaacagttcttgcagtccggccagtgccgcgtcatctgtcagagggaactgggccttacgttctgcacatgaggcagagcaaagtgaagccgctttccgttgtcgagcaggtgtgccagttcttgtcgggtgttttcttcgtcgtcacagagagccgagtgtccgccgatgaggcgggtcgggtccgacaggaaggaaaggtctgcaacgtaggccattgtggaaaccactgagagcggaaaaggggaaaggtgctcttaagaacgaagcggagttgctcgaggcaatttctttgcgggaaccagcgaaaaaactgggtggaaagacggaagaacggacggcggatgagacgaatacacacatgcactgctcacgggaccgaccaccaaaaaacgcgggcagcagccagacagaaaaaaagtgacgaacgagcacagagagacgggggtagattcaagagaataacgggaagaagggagaggcagaagaggtagaccgagacgaccgcgtatcaaaggaaagacagagaagcgctaacagcacgctcgagagccagcggaagacttacgacagtccactctggtggcctttgcatgcccgaaggggtcgaatcgaggaaacgtttctacggccgagaaattgtctgtttaacagctgttcacttcggtggcaactgagttgcagagcagacgggaaggaaagcaaacggagagaaagcgagtccaaagtgcgatgtgtggacatgccttgagagactcgtggtacttttgtctgtgcctgaagggacgtgcatgcgcccggcgcacacacgcatagcggaggtgtcctgccatcaacaaaaatgttttttatgatatcctaagtctctttgaagcttacatggctgtgtacgctccgttgcacaaaccagtctccactccattctcgcccgaagacaaaggcaggcggtgaacgccggttccgcactcgcaacactctaggatggaaatgcatctttgtcttccccgaagtcaccgttcggtagatcgatgtgtcactggagaaatcactcttgccttgtagagagacatttacaagtggtgaggatattccttctccccgttttttcgagcattcgaacctgaaacgacgtgggtacaccccaacgcagttctgaaggggaagggattctcaacacggcacacatttttaatcgcgagagggatcgtgtgctttgtgtttcctctggttttgattcagtggagaggaactggcgtaaagcaataagcggcacggaccacagttcttgacacgcattctcgaactttgaaaagtagggtcgaaactacgccagtggctgccggtgcaagccgccgctacatgacgaggctcctgtcaccgtctcatctccagttcagaacaactctttagatccatggcatctccgaatgctcggacctcctttttacagctgcacacaattcattagtagtgtagactgcacacgcattcttcgcaattatggcaactgccactaagccgacatctcacacgttccacaagattcaacaaactactgtattgcgtttgagaggatatactcaaaaacacatcggtattcttcatgtataaagtggcacacgtttctttccgtgaattgccagaaatggtctacatcgtcaaggtgccatcgatgccgtaacgttcgctggcgcctgaggatgcgaagggcaataacgtcaccgatatagcggtttacagtttcttcaaacaagctggaaaaagagctgcagaacatacagaagacttcaactgtgaccgtcccaccactggctagtttcttgagctttagagcttgatgcacttttctcgttaggtacaaccttgcccacttttttcgtcacgttaaaaaaagatagccgcacagagcagtatcgattgcagtggcctgagattctaacttcgtcgactcgaaatgggaaccgtccgatcggcgtcgtatattaaggtggattgtaaaacaatagggcacatacacttccatcggggagatgctaacaaacgtttttcctccatagttttcgtcacaggatttgtgtcaagtctctcatacacggcgcggtatccattttcagtgtgccaaccaaattcttcctctgattcagagttcccctttttcagacactcggccctgttgttggtttcacacccagctgctctagcaattttctttttctcctgtggtatacttccaaaaggtgcttgcagaacataaaacacagtgcaggttgttggctgctcgtgaggccctgctccgacttcagaaacccacgtgcaatgaagcgctagtctatcaactcctttcttccaaagaagcaatgtttcagtggataatatggatcgtgtgaagatagaatatgtgtcagtgcctccaagatttctgctgaattgttgaccgccttcttcgttgctacacggatctaaaaaaagctttatcagccttgagcagcgaacacaatcgattcttccgttgaattccagaggtttgttggtggtatgcgcaaactacacacgattagtgtttcggtcagattcgaatggactgacacattacatttcgaatctctgtgttactagaagtctgccccctatgaaaaggtgcaaaggacaccaaacattgaagaaacacaggcagctcctgcacatcgggaaactcactttgcttcccgtcatttcgcaaagaaaataagcgaacgtttcatatgtttgtctgtccggtcgaccctatagagaagttgcgtatcctgcactcattgaattgaagcaccactgaaacctgtgcgcccaactttgagaaatcgaaaaaagtgaagcgataaccctgttaagattcgcaggttccagtttgcatacgaccacaaactccgtggcccaggagctttttttaattcgcggcaccaagagcttgcgggtgttgtgcaagccgctgacagtcgagttttaggatgcggccacacagagaacgcgacgtcgtttccttctctcaaagagttaagtacaacgaaacttggtacccgttttcttcatttgaatctgttgaaaaaacgaggcaggctctgttactttgcatctgttcctcgccgctacgcccggaccagctgttcttctttacgatactgtgatctgtcaaggacttgcattttctcgacattctgaatcggagaactgcaagggagcacttgaaatctaaaactggctgtagttctcagcaactgcatggatcaaccagtcactctggttcgttgaacatctacctaaattccaggtcagatattctagcttcgaatcgtttgtgacaaactgtagccgttcggctcgtggtcgagggtccgacaacaaacccaacagtccttgaaaatgttcttttcactttcatgtcatttccccccttgtatatttccttgatttcctcggacactgatcatcaccggagtgccgtagattttgccagaaagtcattcgcatctccggtctcgcactgcggttggaagtccagactcagcaagtttaccgaagaaacatttcgtctagagccagaagaagctcgtatatccgttcttggccctgaatcgactgaacaaacatgatatatactttgtgcacacgcccgcattaaccgatacagagccgccgtcggtttcgctctccaaactgttactggccaccaaatgcacatttgtgtcaatgcatgctgggcgcttctgtttcctggcgatctggaaaacggtggaagcggaaaggtctacccacacactccgattttagctccgtgaccgctttcgttcaacagactggttccactttcgacagctgacctagaggcttctgcgacagcccctagctttgtaaaggctcctgagagtaccgctttcggtatcagagcaataatttaaccaccagccgtgaagaactgttcagtgtttagttgtgacaaggacaccctagtccaaagaaatccaccaagctggtgctcgtaccctatacctgcatatgaggccttgatttctggcaagacacttcttcagcggaaaacaaaa

SEQ ID NO: 3464 - DNA, 1423 bp, Toxoplasma gondii
gtgggtgcggtgagaggcatgttactcttgcatgaaagaaagaaaatccagacgtgttgatagtagaattcaaagagtccatgttactgtgcgctgtgttgtcgttgccaatgcactgttttgagaaactctctctgcgtcaacacaacgtgtacccttaaaagcagtttcatctttggtgagggacgccgtgtgcggttttttttgtcagtcggaatctgaaacgatgaccgcaggtggtcttcccttttaccacggaagccaatgggaccctgagacaaatactggtttttgttagatctgatatagagaagttccactctgttgagctctagaggaagagagtaacagctgtgtcctcgaaaacacgtttttcctacaggagactcagtacaatcacaccactgaatgatcagactgtcaagctggagaggcctccgcgttgtctttcctgtacacttcctgtccctcgttgcgtggcgaggtagggaagcaacctgtgctagtatcgagagcaccaagttccaagtcgaactttcaaaaggctatcgacacaacacagagcacgtctgcgttggctgctcattgtttgccaagcaaatacactttcctgtctttttaccgttctaggtctgaaccgccgcaggaaggagctgaaaaaaaaacagaatccgagtcgggtgcacgatacaacgacgttaggcactgtggtcatttcttcggtcttgtttccaaaagaagtcatagctgcgccttcagtgtggcagctcttcaacgaaacatcagccaagttttttttcgtctgtcctcattttgttcctcggggaatctgctcgtcgtgttccccggatcaccagcaactacagcggtgtttggtaccagccgatttaaaatcgtcttcggtggtttatagaaacttcccaatgcgggtcaagtcccgggccgaagctctattccacttcagggtgttcccgttttttttccggcataacagtcgagagaaagggctttctggaacccccgtgttttcgtttgtgcacttcaacaatccattttcaaacagaacaagaagatctttgtatcccctgcatgcagttctacgttttttcggctgccgtccgaaatgcttgaggggcaaccaagagtcgctgacgaagtgttccgttggtttggaatctcgcagctgtttatctgttttacataaccctgacgcatagcgtatctgtttgttatgtatgtgccttcttttgcacgaacgttctggaataacctgcatttggatgacggaaagcatcccttgtgtttcccctacaccgttgacgcgttctcagatcgaaggtgtttcgtgctcgttgtacggaatttctagccgccaaaaagagagcctcgctttgagagaaacgaagcctcctgtcggcagcca

SEQ ID NO: 3465 - DNA, 1328 bp, Toxoplasma gondii
acgcctatctataattgcttcgttgaagccttagcatcctgctgtgccgcagactgacactcccggtagaattcccgtggtcaccccatataagcggttttctcgtcagagttcatttcttcactgacttgacattacatgtacaggcgtttgacgtcttagacagtgcgtttccacgcacacagtccacttcttatgccagctgcagtgtgcctaagaaaccggcgctgtatctcgttcaaaggcggcagccttacacgccagcatggaccaccaaactgtggcatcgagaggaaaccgggtaacatccgtattacgggttttatatacctgagagtgatacattataggctgccacgaaagcaccatcacgtggagaatgacggctcttgataatgctgaaggtctctcccatacgcaaaacaaatggctggtctggaaacctggtgtgaggctatacgccgtccacactgtgctagcgccgtgtgccacgatacagtggcagacctgtgccacggtcacgagaggaaacggtcccccatccgatattgacttcgtgaagaaagtgagtaggaagtcaaatcacagaagtggcctgcgctctatacgaggtgcgtacgaaaaaagaagttctacaggtctacaaggagaaaaatatgctggggtccggttcgaaagtgaatcctccacatatcgtacaaccctaaaacagccactcccggagggattcgcgctggaattgaccatttttggcctgtagatggcagacgttaatttttgactggaggagtgaaaaaaccttcgcgagccggtggagggcagcgtagaaagatgcatgcagaagagccagcgtcggaacagggggtaagtcagagccaacttcctcgacaacttcaggagtactgctgcgagcctggtgaggaatttgcgtctcgccgacggtgaacgctacagggaagcaaaaatttcgacgagcgaaactggggaactgacctgttgttactagatggcgacaatgaaccgaacgtaaaaagcccagtcacgccgtcggttcacgcgtgtccgtttcttgtctctgtcgggccccgcgggtgcatgcgcaaccgctccgggcaagacacacgtttccattgttgctggtgttttgcgacgatttcaccagaatcatcgatccatggagggcactgtgtctttgtatgcttgaggccattcagacgactttttttttattttgtggggcgggttcgagtacactcactgtcgtcctcccctaccttctttcgacgctgtctagtttcatcgcgctgtgtctccgtcgtgtgcggcga

SEQ ID NO: 3466 - DNA, 3948 bp, Toxoplasma gondii
gaaagacaggtaaacaacaattaccgtagagctttctccactcttggccttcctcgtcccagccataagcggcgccagaggagacgaactcggctgcctctcgaaagaggatctcgtcctccaaattccccctcttccctcgactggaaatcatctttgaaagcacagtcttcacgagctggacgttctcctgtcttcgatctctccttctcctgctctctctatgtgtaaactacatctctccacctttgtctccctctctttagctctttctcctcctctctctctgtacgtcgttttctttgtctcttctcctcttcctcttgttttctgttcctatatctctttgtcgcctgtccttccagctagacgttggaagacaaatgctgcggcatgcaatgaagcggccagtcacgaggatcgagagaagctgtccatcagagggagagaagacgacgtcgaggacggagtgcataagagaaaattgtgtttctgagagcttgggtgcaatgaggacgagcgagtgaccagctggaagaggcgcagagcaatggtgctgcatcgcaggaaagagcggacgaacggcaagacgaagagaagaaacgaacgcgagaaaaggacaacgaggaaagagacacgaggagaaggaaaaggaaaacaagaaagtgagcgagtcgaaaattgggaagaacgaccggacgggaggggcgaaatttgcgagaagaacgaggaaactgcgagaaacgcaaacaatgacggagccgggattcgtgaggggaggcgaattttctctgtgcaattctccgcgaagcaaatccttgaagaaagagtgaagctgaatccccgaaagttagagaagaaagacgaccagccagacgcaagaggacaagacaaggaaacactcgcttgcctggaacgcgacttttggggggtcgccagtgcatgccaatttcgcgtcctccgcagcgttcggctttacaacgcccggcgttcggcttccccctgctcaacaagagttttttcagcgcgagagttgaaagtatttttctcgctttctgaaggagggacttcagcacccgcatttagaaggtctctttcactcccttcgctctcgtcctgcgtccgttgctcagcggtctcgctaaccaacggggagagacactgcaagcggatgttcgtccacttgagacaatcattccgagtcacagagaaaccgagacgtctccagatgcgaagctccaatctttctgtcactgggaggtctcatgcttgcaggagtgtgacgaagaggcgcaggagctctttgggttcctggaacggcggccagcctgcaagatcatctgcactgctagttcgtcattccagaagtgacgataacgcatgaggaacggaagcgaattcgccgtctgcttttgtgttagtgtcgcgatcgatagcagactccacgcagcagttcttccggaaatcctcttcctcagactcgaagggcaagccgcggaaacgcaagcagaaatggagaggaggaggaaacatatcacaaagaaaatgggtaaaatcaaggaatgaggctcagcgaggcgatccgttttcctcggagatccttggcaaacgtttgttgcgtcagaattctccctcgattcgcgagtgcgtgcggcagggagacgggtgcatttccgggagagggaaaacggcagaaaacaacgaagctctttcagttttcctgcgttggtcctggaaagagcctttcgtaactcgcagaaaacagggaacaaaggcttgcgagcaggcaagtcgaaggactttcgtcttcaacgcgaacaaagaagatccacgtttcagtgtcatcatcggttccaggctcgacagagtctcaagtctgttgcttgtttcacacggggtgttcggactccagtccgtatgtcctcatctctcacttgtgaccaagaggagatcactaaacaacgtctcacgcgtagagtctatatgtaagccttcatgttgtcgcgagtttaactaaggggcgcggcgcagaagctgcgttctcgccgtattctccgtgtgtttctctcagtacaagcactgaggagagtccgcgagacttgcggtcgcaacgaaaagcagttcctgctgccaccagtggaacaattgtagtcagacacggtacgttcaacacggcccgcaattgtgaaagtctctgctcggactccgtggaaaaaaagccaaggtagaagcctgccgtggacagttgtgccgtctagctgtcaagggcgtcggtctccaggtgacatttttcgaaacaataattgtgaggggtccctaggagacctgccgagtcttgacactcaccctgagacacatttcgaacgtgagattccgatttccagctatggcaagaggtaactcgagatcccctccgcgtccacggacagaagctagacgtttgcgcagaaatctggaacttccgctttgaaagcgagtcacacctccacagccgacactcgggcgcccgagacactctgttttcagtggcagttcttcgcgaactcggaacaccgcccttttcacgtgggcagtccacttcactctcccgagcagaaaagtattgacgaaccaaggatcaccacaagttcacatgcactgaatttgtcagcgccgtcaattctctgcagtagagcagcagtcggcgtccactacagcgaaaatgtcgacgactacgtgtcgtttcgttgtttctatcgcttctactgcggacgcacaacggacagtttctgcagagggcttctttgcttccagaagtcttccgctgcattccccagacaacgcttgtgaagagtcgtgaaggaaaggtatcaaaacgggtcttcagacacacagaggacagacctcggcagcaaaagctttctcttgcactgaagaggcgtctctgcgttgtacttccccggtctcgaaaagacagtgcagcagctgcgaagttcaggagcaataaaggacacagaatgccgctcttcttgaccaagacgcgctagagattgcctcttgggcagaggaatagcacgacctacaccagcaagtatcacaaatatacgcgacagactgcagtgtcctctttgagtcgggaaaactctgattctctgtttttaaagctcttggcttggcgcctgaaaatactcttcttgtctgagatcccatcagagacatcttcccggtattgtcgaggcatctttcaaaaatccgcaaacatctcttctgagattcaaaggccccggtctgccgtggtgcctgcgtcctttgaaaactcgaggcactttcagctggcagaaaagttttcgtcttgacgttccgtcagctcgatgtgttgtttacggcggtcgtggggggcaggaggcgacacagaggccaggccgctctttcgaatgagagacagaagaggaaaggtagacagtggacacaaacacagagacaacgcaccgcgagaaaccggaaagactaatccccgagcgtgagtccatcctcccctttttccgttccgttcccatttctgcattggcttcgacgcgaggtgtttctctccaaaaaatgcgaggtcgttcgtgacctctgatcttcgagttcggtgccttctcctcgctgcgtttccgtctccacttctttcggcacctcttgtgtgcatctcacaactggagtctgtccgtatcgtacccgcgttctctcgattagttgttcgtccagcggtttccagtccgacgaaaaagactcttctgaatgtcaagaaactttacgaaattgctagtcgcagttcgagagttcagatcgtctcgcatggtgccgcggttgcacaccacacttccgttctttccacttgtgaaactctctttcgtcgacactctgcaaaaaaccagattccggcgtcgccgcaaacgagacagctgcgacttgcgcctcggaaca

SEQ ID NO: 3467 - DNA, 1527 bp, Toxoplasma gondii
tctgatatgtgggttgctacggtctgtataccagttcgtgcacttacgcctacgtatatatgtagaatatgcgtgtgcatgcggggtactggttggtgtgcgagtggcaaggctcgtgcttgtgtgtggcgagtacgcgtgtttcaagtagcctcggcagtggcctcagtattttcaggtatcatcttgtgtccaaatgctgtccactgaagattccgtttcgggtctcgatagggcttctagtaccatgcgccgtccttggcaaaccggactgtctgacccagaggatagagaatacaggcttctgaaactgttcactttagacacccttatgctaccacaacagcaacgcacaaccgaattctctcagtttcccgggaaatgcatcggcctcttactatggaaaactgaagagaaagctttaaaactgtatgtgacgaacgacctggaaatacatagcgctccttggtcgaatttgaggagagacagcaatattttctgaaatcgctagaagagcagttgtacgagtgtattaactacgtgtccgcccgtgtagagatacacccggagttaggggtgggcttttcttgacggctaacggaatcagttaacccactctcacgttgaagcgtgagagtatttctttgaattcaccgacgctgttgagccgtttactacgtgcacatgtagttgcggtaatacatgcacatactacgtttgcaatatgtgtagcacaggcgtcccatatagcatatcgaaatgcgagcttcttttgaacttggctggtgttcaactaacaaaaggatgagagtaacgtattttttttctctccaaactcttccaggtgtgtccgccaggccagccttgtcctatgtagattctggtcagacgccctcgactgcgctccgtgacacgagtatgtacaggaacatgatggcgatgagctacgcaagtcgtgcaaacgcttctcgagttcgtttttctcctactcaaacaatgttctgtgcgaagacaaggtgcaagagcgaggagaacgattgttgttctactacaccttcaatgtcacgtagacggtggacggcccgccttagcatcaagcggcccggaacacccgtgcacgacgcatatttgaaaatggtacacaaactatagcttttgtgacccttttcttttccacgctactgaggaaaaatcgagaggatgtcctccaaacgatgagcaatttctcaactcttttctcgcagttgcgcagtctgtgagacgtctcgatgccgccatcgtgagaaaacgtcacagagcaagcgagaaaactcgccgcacggtgtgcgcatctctcttgtttctagcatgaacttttgtgccttagacggcgccagttttctttttcattgcctctcgttctcctgttccttgcgtgattttctcctgctgtgttccaacgagcgtgtcgatatttctgtcgtccttggtaccgcattctcggccgttgtgtcccacttcccggtccggttccctcacaagcgaaga

SEQ ID NO: 3468 - DNA, 2576 bp, Toxoplasma gondii
gagacaacgacctctctcctgttaccgtctatattactagcgtctagcaagtgtcatgttggaccgactcgttgcgaaagaacagagcaagatgcttgcaagtccttccttctcgacgtcatcaggagggcaactgtcggcagcgcccaacagcaggccttaaatggtcatgcgccaagcctgtgtgtaactagcattttcgtctaacaccgatgtactctcagactctttccattcgctcggagcttcaggccgaaagatacatatatatatatatatatgcacatgtataggtacatatggatgcatgagttagatctagtggcgtcgctgtcgcttgctcaggagttgtggaccaattttcaaggaatgcaaagttcttgtttgacgttcctaagaaattcgtctcttgctttcgtggatacaagccacataatcagagagtgagacgtcttcactgctggaccggcgagtggtgcggcgaccttttagaaagtgttttgaaaaaaacaaatggacacgaagatccttcttcgcgtctggtgcttattgtggacgcatctccgtcgatttacgcgtccgatttttcgcgtctgtcctcatagacacccagcgagacgcaaggcgcctcgtaagagatctccaccaatgaggggtgcggtcttcgactagacacatggacgtcgacaaaagtacgttttgacgcatcaatcgtgtggggtgcatgtgccgcatttgctgatgtctgcagagaaacaagccaagaagagttgtggcttcaacttctttgcactcccttgtcctaccaagtgtttgtcagcacctgcttctgcgattctgtgtgtacaagtgagagctactcaactgctgattttcctctttgcgtcggactcggcggtcgacgggaaccgtcgttgcgtgagtttgacctggtgaacataaaggaagactcgcatgccctttggtcgcgagaggcccatccccttttgaagcgacaaaggtgtctctggtcctgtaattggtcatgatctcgtcgggatggctttcttcaacgccttctttcttcatttcacacccgctgttctcttttcctcctttctgggggtcctatgcatgtgtgtcacggcggtcgccagcggggagtggagggacccgatgcagcgcgcggacgccagaggcggtttcttgtcttgtccgagaggaaagaaaaagcgcatctttctgtaatacacgttttgccagctccggcggctcatgaagggggacttgcttctgcgtttcagcgttctttcagggcgcaaagaagctccgttgtgtgctaccgagtcgcattctcttcaagaggagtgagctcgatggacggcacacagtctagccaccctcggagctcgatcgacagagtcacgtcttgcggtcagtcgccagctgttttctctttcgcctctttttccccatgcttgttccccttttttcgcttccattctttctcacgtgtcacggttttcctgtacctttcagaagtagctgacatattggaaagacgacagaaaggtgaagcgatacgttttctggtggtagcctcgcagcacaaggtcctcgcgtttctttgtgtcttgtctctcctcttgaaatgtccgcaaagtttctcttctgctaaacacacctagcttaaggcgttgttaggctcgaggacggcaaagcgttttgcggattctttgagttcttgtcaacttcgtcttgttcgcacgtattcagtacccgcttctcgcgtgagatccgcgacccgcgacctttagcgcatttgaaaggcgttcttcttctttttcttctcacgtggacgctgtcggttttttgtttcttcttccaccttttcaagtattcgataaggtagcctgtctgcaacctgagtcttgcgcccttctcaactgttctgtcttccgccgtctatacacgcttcccgctgcgagtttcccgtcctccgctcctgcagtttttcgcttgcgccccgccttcagtctgattccttctttttctcttgtcttcggttgtcgtattccctcccttttctgccgtattcttcttcaatcctgcagctgactcagtcgcatcttcctcgcgacccattttggcaaacaagctccctcgtcgctctttcacgccctttccttctcttcagaggagacttttcatgcttctccctctcctttgtccacccttccgctcttctttctgtcaaactcctccctcttcagcttttcttcggacctcctttctctgacagtcggtctggcctcagcccccctctcgctttcgccttcatctctcagtcgacattcccgattggcgttgcgccgttctctaaaagagtgaagcgtctcttcttcttctttctgttttccacctctgtcgaacgcagctgcgttctctggtccctctcttcctctcttctctctttctctcttctctcttctctctcgtctcttctctctcctctctctctggcccgctgcatgtcggggacgctggtcgtcgctctctgcgcggctgagctcttcgtgcgcggcgaagcctcgcca

SEQ ID NO: 3469 - DNA, 3619 bp, Toxoplasma gondii
tgtaactggtctgtgaccatcctgttatcttgttgcgcgtgacaaaccttgcgcgttcctcgctaaacgccttctcagcttttctttttttggcgcaaagtccgtccacgcacctgccccccttgtcgtgtctcactttgctctgggcgagtctgaaaggagttgctgtgcactatcgagcacttctttgcgaaacagagagtgaagctgactgcgggtgccactaaccgcgtaggcctagggtagactgcgatggcacatgggagttggtcgtccgcgacaccgaactcgagtaaattcgctttccggtcaaagttctgtagtcagcacgtgccccagacattcggcgtggcactcagctttctaaagcacctctatgtataaatcaaaccaggagtagactgagagatacagcgtctgttcttcacaccatgctaacacactagaacttggttcccgtaatccaaggcattcaaagtgggcggccggctttgttcccaaagactagacgcgtttaattgcttcgccgcagtggaggcgtaacgcacgaaattgtggaactgaggcgcatgcaggaaaaaaccacggaaatcgatggctcacagcgtagtcttgactcccagggaaaaggtggtttgagcagaccaagaattcatagtgccggaagtgaagcgaatcatcggtggctgtttcacccttcagacaggaacgtacctgggtgcgtttacgtgcaacgggaatgtgtggttcagtgcgttacagagatattcgcaagtcttgaattccggggacgacaatgtgccggagcagtcggggcagtcttcatgttaccactacttccggacttccagaaatggagattcgcgagaaaaaaaggtgttcaggcacaacggtacccgccggcagagtgacaaaaacacaggtttgtgaataatttgccgcctttccatccgagttgttcgctccggcccatgacccctttgttccactttaggcttagagctgctccatttgtccagaaggatgcatactcctctccttgagatacaatgtggaaggctctttggcaaaatccgagccgaggaaaaggcgaaatcaaagtttgcggcgattctccgcctcgacacagagagcatcaatttcgcctgccagtaagacaactacacaattctgcgaaaataatcgcttcttactgacgcttttccaaggagcctttcttcatccgtggctgacctcaagaaaaacgaatgcgactgtgctttttcatcagtttgctgatctgctgtttcgaagagaacgttctctaccttatgtgggtgggaaagttagcagtagaccctgtggcatcgttccaacgtaattttctctggacccctcacaacacccgtttcagagcgatgtagacctctaacggaaatgggtttcgtggtcgacgcggaaattctattccgtcggcggaagtcgcgccaaatcggtttgttaatgacgtaacccggtagatggcaaagacaagagcagtcgtgacagcaaagcgaatgctgatccatccgctgctgcatttatatatatatatatatatatatatatatataggataaccagttagtgaagtcgtaatagaacacacttcctgctggtgcagaatcaaggcaagacacctctgtgtgcgcgactttctgtatgtggtttgatggttacttgtttggcaacgaacttgttacgtgctgtattcttgtgacgaacaggaacaaggcgaataagaacaagcgaattgtgcctcactctgtcgttgcactcagtctcataactgggagagacggttgagggtttcgaaccggacacaccgttaggcacgatgcagaataacaagattgtgtgcttgaggaacatgcatatttggaggttccgtggactttcaagacagttttgaaaagtgaacagggaagtaaaggacgaaattgcgccgttcgcagaacgtggcacactggtgtcctgtccatgcgtgtcaaaagtgccctattcccaaagcaccattttctctcttgttttacaggctttccaccacgatgaaaagcaaagagctggaacaacgcaagtcaaaggaaagcctcttttgtaccggggcttgagtgagtgtcgcgtcccaccctcctgtggcttcgtgcgcgttctgagttgagatagtacagaacgaaactggtgctggacctagtttctcttcaaaatatttaagctagccgttaggcagaagctgagagatgctcaaagttttgctgaagagaatggcgaatctgttccccgtcgtttcgctcatgttaaccgaggactagcggataagggcacgcggaccacttgtgcatgggaaaacgggacttttcgggtaaaataaattgtttaccgaatacacttcacaaatacaacaccattatcgggaacgccaataataaaagctggcaacaagaaaagccatggatccagtaaggtgaccggcatctttacgggttttgataagtgttgccgagtcgcattccttaatccgagtctatccgggcagtcgtcgctcccgttatcgtgcagacggcggcggatcagcgctctttgagccagttctcaaggaatgaatgatctttactgtttcttaagtatttcactagctgggaaggagtgtcagtaccagtgagaggccgtgtgatgaatgtgtttgccacgagcgcttggattcaacacctcgtcccgcctgtttgtgtgtcgcaggatgccctgacccttctcttcgcgaaagcaacgttattagcttgtctctatctacgaaggaaaagaagttttcttcgtctcacctgcaaaagatctctgacgcgggtcattgtgaagtatcatttttgaaacgaccgggtgctgtgggtcatccctgtgaagttttgaaccttcgagttccagatcacaactttttcttggatttgaccggcgatatgagcaatgccacagttttttacatcccggaacaaatgaaaagtctacgtgacattctgttgttacgtgtggatacattcgcatgtaacggcacacctatatatgcatatatatatatatatatatatatatatatcgatttatggggccctgcatagattccgatgctcccatgcgtgtgtgtgtgtgtatgcgattcaaaattgataacaccgacatggttattctgcccttttcgcctgcttccaacactcggagttcacgagcagaactcacgtttctcttgatttgttaacatgttcaagtcggagttctccccactccagtttctttcctttggaaaagaccactagttgacccgtcctaccattcagtaccctatttttcttcatttggacggtgaacagttttctctttcctgtttcgacttggactctccgccgctgtcgcggttcaggatgacacccgacatatctgttcgtcttcactcttttcccgatacagccacgcggaaagtttttcagcacacaacttttcttctctctgagtacagttgaggctcgattaactcgaagcttcttttggaaacccgtttcccatgaaatgctcacaccagcagcccactctggttattggacgtaagcggcga

SEQ ID NO: 3470 - DNA, 3263 bp, Toxoplasma gondii
gtagacacggtaaagttcctgtccgtcgttgtccgtcttgtatgtggactgagacgcggtgccagcaagtccctggggctggttttccttctgagcggagtcgctgtcggaaatcccccgtcccgcagctgcagcagcgccgctcgcatcggacgaggaaatggcggccgcgatgtcaccaagcgtcacatcagcgaaggcggcagagcgcgaaggacgccaggaagctgttttgctcccgatgctctttcgagtgtctctgcggttcttcgacaaaggagaggcgagagtcgcagacgagagccgcaccgcgccggttgagttcgcgcgcggattttccgcgtttccgcaagacctatgaagcgccgcatcatcgccggggtcggctgcggcgtcgctgtcttcgacactgtcttctgtcccggaggagagaagaaggcggcgaatgacgctctgaggcacagcggctctgcagtcggcgagagggcaacgcagaatggccgcgcctggggaggcgtcctcgcgcgcagaggtactggagagcacttgacagttctgaagagaaaacgtcacgtactggcgaaagcaaacagtgtgaagacgatgggggcttgcgtcttgaccaggtcgggcgtcgtctggggtgtctgcgagagagttctccggccgcgaggtggctgtgaacggcgcggcgctcgcgcctgcggaacgcttggagaagcagccgagagctatgcaagagtccgtggcgagcatcggctctaggcaaatgctgcagcgctcagaaggcggcgcagcctcgtggccagccggcgggtgcctcctctctgaagggaacgagggcgagtctgcaactccaggcgactgcgcctcgccttcggtctctcccggggagctggccacctggcgcagaacgtcgccgaacgcttgcaggaggccgcgcgcgctccggagagcgggtaggttttttcgactgggccgcgtcaaaggattttgacgaaacagacctttgcgttccatgacgaggcgagagcgcgtgaactcgaagcaacaaatgacgaaaatgccgcacggcgcgctcaggcgacgctcgagacgctgcggggtacggaagtgcctaggggaaacaggcccaaaaggtcgcagcaaaaaggcgcggagaaaggcactcctgatggttcgccgtcgacgaaagagaaaacgccaaaacctaagagacggtgcaagggagttcattcgaagttctgccggacacaaaccgcggactccgctcggcggaacatgctgcggcactccgttcgagacggcgacaatttggcggtggctcccgcggtgtgtccaggaagtggagatgaaaccactgcttcttcctggatttcagtcgatttgagttcgcagacgctctacgcgatccatcggcggtaaaccacgagtcttcaaaaagcgacgacccgcgtttgagcgcagaaagcagaaagcctcgactgcaggccgcatataggtctcgacatcgggcagaaccaacagcgggcagcgccctactcagaggtttgtcagaagatgcacatggaaatgtcgaggcgaaacggaagaccttttccaacgaaaatccagtagcaaacaggaaatggcactttgaggagagacacacacacgaaaaaccacaaaccgacatggacaaaggcgtcgagggtgcagacagcagcgcacgcaccgcttcagcacacctctccagcaacagaagctcgcgtttacctagcgaaaaagcaatcggaagtgttgtgagtgcacccggtagcaacggaacgaaagacaacgacaaagcggaaaagacacgcacacgattgtgagtgccctgcatgcgcgctgtgtttccctgtcgcgttcgtctcactggctcacgacgacgaggaacgcctggcttttcaacagggattccgtgttcacatcctccatcacagacaacaatcgttcgttgttcttctggcgtttcacacaaaagtgagagtttcggagaaggcgctttcctccttgagaaggcggaactgcgcaacatccggccctctgaagcatagtgaagacaccaagagccgagcagatgcgctcacgcgccgccaacgggtcgtctctgccatgactagatgaaaaagctcgtgcgatagactagccagtgctgatatttagtcttgtgcaaaacaactgaaagtctcatcaacatcacttgacagggtctccccagagagtctccgtttcatgccacaggatttgccgaagaagccaacgagtggccaccctcggtcagcgagcatcgactggctacctgcaaccagctgcgccagttcgtcgccaagagaaaatgccttaccgctagcgctgtgacggtgttctcttgctgaatcttttgtaagttacgtagagtgaagatttgagcttccacttggagaaacggctccgcgttcggatgttctagcccactgcggttgtgcaccgggagtgtagcgcagatttcgtgcggcacgggttccgtgcgaccgttgacacggccatgcatttcttttcagttcgcctgggcgaactgtctcgtagttctagcatgttcttcacgttggcagggaacgttccagattttctttccagtgcgacgtgtaaaagggctttccgttgctagtctgccaagtgcaacactttcggtttttttccgatcagccgcgcctgtccatttgaggcggaagcgacctccacttgcaggcttttgccctgcgtcttgttcaacgcgctcttcgcgttccacgggagttccaagttttcgtgcgttgtttgacctggtgcatccagcaagaaaaaccctggacgctctccgttcaattctttgcgtgaatacaggggctggcgtatggcgtggacacccagtgctcgctacccagcgccgattgttttttagtttgagccaccaaggaggagaacggaagggtaattcgacttctcaggctcgtgtcttgtcaaagagctgccgaaagggaaagtggtaggccgcgagcatctcctacggtcgacgccacagtgttcgtctgtcagtattcagctgtgtttatttggttccactcgcaggtaaaacggagctctctgccggggtttttccgggaactccgtgacgttgctggtgcgaaacactttcttctgcgcatgtgtgcgttgaagggatctgcagaaagacaaaacccgtacgggcctccgtcaggcgaggtgcagagagcaagtcacga

SEQ ID NO: 3471 - DNA, 2713 bp, Toxoplasma gondii
gaatccacagtgccagacacctctccggtcttaggtcagaaagacgagcacgacgattatgttacatgctacgtccggctgcgttcgcaaagaggaaggcagtcggcgcggatcccagaaaggacgatccgcttcctcggctccgtatgtggaacagagggttctatatactcttgccactgagacgtccccgacggaagactgtagcgaccctccgggaaacctcttgctgtcgtgctttgagtgaatcgatttcgacccagtgatggaagtggatgtgatgtgggtctggagatgcgctatagatcaggcctttcagggttaaccaaccaaggacagatgaaaccaagacgctccgcacaagttcttcctgcttgcctctctcggcacccttcgagcgtggcgttgcggagatccacctacaaggacgccgaatgaacagcgtacccgcaagacgaaggagacggcggatgcgaacacggcaagaaaagccaagagtgccgactaaaaccggcaaaggcgcaaactgccaccaaacagatagatgggcagcacccgtttgaaaacggacgggggggggggggcaggcacaattgaggttagaccctcactcagtctgtagctgccacgttccaaccgttttgggaacgggatgtcccgtgtctgccactcggggaaaatgatatatcctgttttcttccgacgacgaactgctggaatcgtcgggccacacaggacggggggaaacggtgccggtcaggtgagacgcatgactttgatggaaaaatagtgtctgaagagcataccaagagtaagggaagtagtgagatggtgggggaacgaggataagaaaactcgcccgcgtcgggaatatccaccagaaaaaacgagcctggacaccccgttcatgaactgcacagaacaggttgcaacaggcagatgcgcgcacgcaaagcgcccatatcgtttctagttattctccctctttcctccgcacaaatcaaaccacaactcgttcgtctgggtagacgcactcggagcgttttgggaaacctgcagctccagcagcagcttcagagcgggaagtccaggcaaaagaaaaatacgtcccgcatggcaatgccctcctgcgtgaggggacgccgcaaccgggtcacaaaactcccctgaaacttcccctgtgtctcctgtgggcaatacgacgtctggtgagcggtttttaaccgcttcgtcccaacagaattattcgaatgaaggccaacaaaaacgaaaacgcaacacccccgcgccttcgccgttgaaagacgccgcagccgggaggactgtagtcacagcgagatggggctgtgctgttgacggcaccggtctactgaacgccgcccccggtcccgctggagcagggcaccgtttttcccggaatgtatgtttggaaagtgtactgaaaaaataagggagagccgcctggcgggatacgaatcacttgctacggagtgattttatagttcggtcctgtgtaaatcccgatgctagagaagtgcttccttatttcgtgtcgattgcgtaggactcggaggctttacacgtcaggtaacgctacagcagtggtgacggaaaagaagagtggtactgcctactaaccgatccggactgtgaaaacggacgtgatgagtggggacgccgccggctgagactggcctcgcacccgcgaccaggcgcgaggcttccgttcccgttccacgagtcaaccttttacggacggccgtactcggaaaccggattcgtggaagcctggtacccttacttcttgcacgcagtataccccggctggtaatgggttaagctacactggctgccacaccattagactgtgctatggcgatgaagccttcgtttcgtgtcgggaacgtcatgtgttaaagtggcggaggaattaggtggggcaaggggggtccaaagcgatggtagtagtacaccattggtcaagggattatccagtagacacacagagtgccacactgttgtgaggcgaagcagctgtgggaaaacagaaacaaccgcacagcattttaaacaaggatccgtttatcacgtaataaaatgtcatagggagcgagatcaaacgcggcgtgctcgctcaaaaagggagagagagtgaaaggtcttgtcaccttcagcgggcggcgaagtgaacgcactgccgacgtgtgcagttctgcgcgcattctcaccacgaagtattcttgccttggagttctcccgatcggaaagagaatcatctgaatcgataatgcacaagcatagaaacaaagcagctcccgggagcatattagtttcgtctgctgagtgccagcaggtgagaacgccggaagcaaccctaaaaaagcagtggctcactgcgcgggtacctctggcggcgatatattcctgcgtggacactgtttcgttgattcgctccaagcagatcttgcaactatgcaaggtttactagaagtgtggaaagagaaggaaggagcgttcaaatgttgtcatagcatgggcgggacgccgccatatccggtcgctgtgctgcttgtcaacagcgtagtcgttcgtccaagcttgggtcagcgtgctgcatctcagtgacggagggttttcccgatgtatgcctcgttctggaaatcacacctttttcagttgccgtgagatgctgtgtgacatcttcaagaaggga

SEQ ID NO: 3472 - DNA, 2466 bp, Toxoplasma gondii
actgcaggcaaaggctgtgtctgactttggttctgtaacactgtcgcggtggtgcaatacgtgccgacgtagaggcaccggatgcttgtcaacctgttggaagtactgcgggttcgattgtcgaggcctgaaagacagaatgaccgacgagttgttatgtgaattttgtcgagagcgctggggggataggcgttatctgcaagagtgccagccgtgtgtttaccctttgccaagcaacaagaatcacacgcatgcggataaagaggagccacggaacgacccaccttcggcttcgttccgcgacttgaagcctcacattttgcctcggccttcctccagttttttcattcccggagagccagaggagttcgagctcgacagcggcagagattacatgcctgctacctggcggttttgacgttcatttgctgtggaggtcgcctcgacctcatctagaacacagattcgtcgaatttgacgatttagtattctccaagactgggaaacgctacttcctactctggactcgaagattctggaagacaggcacgcggcatcatgcccgccaaatatgagtgacacagtcacccaggtccacacccgcacccaacagaagcttactacgaataccagagaaaccacaagtcagcgcagcattgtgtggacttcataaggcggccggctacggctactgcagagtagctcaccatcattcagagggcagacatacgagtaatccacatgccacctttggtaaccaacacagagcgcttcacacattcgacaacccccatcggacatccccattgaggctgtgacagactcttctggttcctcagctactgcgcttctacaggtgtctcgacgatcgacccttctgtaagtgagattgactttctttcattcatgttacagtttctgtccggtatttgtgctggatcgcgggaagctgttgattgaagccggtttgcgacgacagttcccccctgtgcatcaacagtcgtttccataatgatccgccaaaggtgagaactcaggacttgtgacacatatacgctgtggtgtcgagtataacaactgaactcgcgatttgaagtagacagattctagcgggaagcaccccgtgcggagtcgcgacgtcccccgcagaaattctgtgttgtgctttcagctgaatttttcagtgtagcgccagatattcgcctcgatctttctgagcaaatggacaccatgtcaaggacttcagtggcaattctcctccattcatagtccggtgctcactgcagtaaatgcattgctgcggaaaaagcgagagcagcgtggcactgggcctgaccgaagaatcgtcaacccctaacagagaatacttcttctgctgcaccatccaggattgacacaccttagagttccggcctttttgcgaagaacctctctaaagtgaggcggcttccggtagaaaccccagaaaagaatacagacactttctcgcgcaagcaagggcctgggcgacgctggcggagggcgccgactgctgcaccgcggaccattactctgtgtaaaccagaaacgaactagaggggtccttctaagcgtgatttcacacatactcgccggtggatttgctgtgtttggtgatgtaagggatgcgtataatggtgtcgctgcacgaggaaagagaataggttaaacaccgaaaactcgagagtaacaccaggctcgcgcttttgaacgactctcgcagacagcgcctttttctagctgtgcatgtggccgcgccctcacgcagaaaacagttcttagacacagctctttgcgttttctgtgccgtttccctttcagagatccctctttcttccgtttcttctggtacgatgcgtcgaagcaaccgagtcttatgaggttcaccctgtcgagaatttccttccacacacgcaggacttctgcggaggcggcttcttgggatcggccagaataccgcttaccatttctctcgacctcgtgtgtctctgaagctgtttctgctttgctgtgcttctctgtttccttctcttcgcggtcccttcttccccgtctcctttgactttttgcccgctggctctttcgcgcttcaaacgggagcgcgccgactttgcggccgggcactcggtcgccgaagaaagagctgcgggcgccagcggcgttcttctctctcccttcttctagaggggaaaccgccacactctccaaactgcatttccgcccctttctgttttttttctggggctgcagctgccgccacggaccagtcgctgcagggattcttagaccgacgctcgtctgcggaatctacctcctctcctcctcttgaaaccactcacccagttgtcagccaggaaggcgtggttctcagcgcctctgctgtttgcggcagggcgaaatcgacgcgcgccaaacgcgactcttccctttcaccggacacttcagcca

SEQ ID NO: 3473 - DNA, 3089 bp, Toxoplasma gondii
cttcgttcagagctgcaggtgccttgcaggcaagttccctttctcccttcttctcgcagcaccaggctagctcggcccagaacgtagaggagctcctgtgcgctcagcgaggcggctgtcagcgaaaaaatttgagagtcctcaatcggaggaaacaggaaagaatccgcagaattcgctgaagaagagagagtggattcctgtgaggttcgtttgtgcttgtctttgaaagttgagctcagagcaaagactttgactggtggagagagctcgcgaggtcgttttcggcgactctctcggtcgcagaacggcgtcgcttctcctgcttcgccgccatacgctcttcttctcgcgcgcccctcacgaagactgtcggcgtcgtcgttccttcggtcttcaccctcccttcgcgcggcgtttgtcagcgcttggacgctctccgtagtaaactcgaggaaggcgtcgccagggatctccggcgaggcaggcgaccatgcgaagtcgaagagtgcgttcgtgtctgacgcctgcagagcgggcgagtcggagaaacgaggcgcagacaggcagagactcccgcgtctcgcgccttccccctgagcctcttgggtgctcgcaggggatgagcggcaacaggcagagcctctgtccagcgagacgagagttcctccgtctgccgacccccctgcctcacgtcgggaggcgcgtggagagacagaggcgcagaaatggcagagggaatacgacaaatgagagtagaacactggagatgcaggacaggaagaagagaagggagacgagggagagacagaaaaaagcgaaaacgaaggcgacggagcacgaggaaaagaggaaggagaaaagggagagacaggagagagtagagagacagaagagacagacgacgagaagggtgtgcttgagggtctagagggaagagctaaagcgttgggccgcagcgatttgcggcaaagagagcaagaccgactgaaggtggacggaggagaaaggagacgcggagaggagacagcgggaggcgagcgactggcggggggaaaacgagaaaaagaacgaggaggaaatcgagcagaggacgagacagagataggcgtgagagatgcgggaggacgggagtgccagcgaagcgcagacattgtggaagaacgtgagtcgagagagagagagaatttacagcgcgcgatcttacggcaaacaaaaccctgcggcggcaggggcaggaattgacgaaccgtggatatacagcaaaaacctcgccgagatcgactcaaaggcgagtcaaagagaaaaaaggagagcttctcagtgggtgtttcctcgacaacgaccccctgtggctttttcgaagcgaaagaggcgcgtcaaactcgagcttccctcactcaatcgcgggtcaggcgcgaggagccgccttcttcggagagccaagcagagaggaagaagttgccgctttccttctttgtaaagacttccctccacatttctcaccagagaacatgtcaagaaggacgcagccacccaggcttcagcaacagcccaaagttcgcgtttcaagacgcccccgtcttgaaagctcctctgtggcgagcccacgacgtatgtatacagcgcctctggctcttcgccgtctgggacgggatctaccgcaggagcgcggcgggcggaaaagggtctacagaaagagaatttatacgcctttccaagacacacaagtgcgtgtgatgacttcttttgcttcttctctgtttaccaccctcgctgcgtatcgcctgggtcgggaaaaggagctggcaacgctgcgatctaccggcagcgccgtgtcgcccgtggtgtaacccgcgtgattatcgcaagttttcttagtctctgttcgctccacttttcgcggattcgcccccgtttacgagctttgcttgacgtttactctcctcttccgctcatcttcgttttcaaaatctgttttctccaggtgtcaccacggtaagagcagcttgaggggcctaggttgacggaacggggggctacacctcgcgctccgcacggaacgcaggcgcgtctgcagccgtgtctgcggaaggtgcaggcgatttctgcgttgcattttagaggcaatgcaaaggatctgacgtattttaccgagtgtgtttcgtcctaccccacttctcagtataactgcgtgacatacgtatcagtgcgtggatcaactagaaaggatcaaagtggaaaggagtgctgctgcggcggtgcctggcacaggaagaggcagacaggtgggcgcgtttggtgctcggaacgagtgtgaggatttggcgaaatataaaacgggctcaaggaaaaagccgaagttttataaaggaaataacccaaagaaaactgtgttaacggattgaagctcgttcaagaaggtcctcctggagctgcgcggaacctcgccagtttgccggccttctcatcatcaactggatcgcctccagctgtttcgcacacggtatccttttgaaggggtcttcctattcggagacgctagactaagatgtgctcgcctggcccagatccactaccctccgttgtgcatttttagtcaggagttactcacactaagccgtttgtcgcatgccagcgcgggtatagggcctctttcgatttccgagtatttggtgctctccacctgggagatggtttcatttcagcgacgaaccaagctggcgcggaattcaggctgtttaacgttttccttgcagccattcttcatttaaaccatacagtgtttagttcgtgtcgagtctgtgcggcaagatccgggagaaaagccacaaaaaccttacaagggtgacaagcggcacttgctgagcgtctttcgatacgcgtcgcactcccggacccaggcccccccccctcgtgcttgggtggaccaggagttcctggcgacacagcgcaccacttaggatttatctgagaaaagcttactttttcagtaacgcttcgtgtgaagattcaggtttccacggaacttggccatttgacttgtttctgttcgagacttcacgagggagcttgcttttttgacgaga

SEQ ID NO: 3474 - DNA, 2376 bp, Toxoplasma gondii
gtaaacatacatctgacgagaacatgtgtgccagtgctgccgcagttcctcgggactgccacgttagccagtattgcggcatcgcatatcggtatgtcactccttcaagttacaaaacacccgaatttgtcagttgaacaacttggatccccatcatgtcggtggctcgcggagactcatcaggttgttggatcttgcagctctcattttgcttaaacgacatgtttctgctcaaacatgtctgcaaaatccctctccgctgtcgcccggtccagaatgattttcgttagttctgtcactgaactgcttccctgttggaaaatccgatacagccctccagtgccaatctcattatgatttttttacgcagttcctcgcactgacgaagagctgtgtcatattaacaccagcgaatgggacctgtttggtgaaaacccgtttcgggcgataagagactgcacaaggatctgaagttgtttctctgaacgatgcaggggcggccataggccaagcgattccgtaaaacaatattgtgaataacttttggcgaccccttaatagcagtactatggtttctccgcattcgcacattaaaaatggatcaccaaacaggtaagcatatagctgtgctaccttacagctagagaacaagggctgttccgggaattgaacccgggacctctcgcaccctaagcgagaatcataccactagactaaacagccgcattatatggcgacacatcgtcggttgcactctgcacgacaatgccaacggctaaagcacacggaaatctccgacaaatatgctggcgtccagtgctcggcatctatgtaggcaacaattcacttgatgtcttttgaagagtttcagcgggttgcggggttgtagtcaattggggccctgccagagccggaaattttctgacattccaacacaaaacacactattcagcgcctcacatgagggatccgaacccggtctgcataccttcactgggtactgaatggtctgatgtgttccctcctattattcatgctggcaacacagcgtgactgtctagggtgtctctggcaaaagcttttccatcagcgtgactttctgcatgaaatgcaagactgtcgagactgccgctgccgagcgaacatccacagaaaacccgttgctcgtggaagcgattcgtctgtgcatctgctagtactcacgcgcgatttcagaacttcgacgcctgtcggatctggagaagcgtctgaattctgtctgtgtctggaagtctaacattctgaggcgcttcctcctgagttttagaagagaaaatagtcaaagcatgtgttcaatgcttcgcacttgacccctgaaggcaatcggcccggagacacggcgaactccagcgggttatttccagtgccgatgtgtcttctcgctattacgggatggtatttgttttgagagtgaggattacagcaaatgatgcatgaggggacccgtctgcattcttgtagtggatgtcggtctgctatacattccagcctcagtgtgtgggctgcactggcatggttaaaacatgcgcgcatgcaccggtgcaaaagaaagataaaacctgcagtgtagaaaatgccagcaagtccattaagaagtcacgcgcctgaaacggaatgaaacatttggtgcaatatgctacacacaagctaatgaggctgacactgtgatggtgctgactgatctgaggagagtctcaagaacgcatgcagatgcaggaaaatgctggttaagatcatcaagtgcggcaacgcgcaacgaaccaatccgaaacaataataggcacgttgcatcatgttaagagtcatcttgtctgtctaagagaactaggacccggatgccgaatatgtgttgcattgaccaccctcgaatgcctctggaagcctcccttcgtctttgcttgtcgatagatgcagctccgccgagcacgtgtcctagatcagacctttgacgtgactactcttgtgagcaagtgatgtacgacattccatatttatgtttgctgtgtaggatacaggaacacgtctgttcgggagcacggcaccatagcggatatgtgtatatcattttccttatcacagcgtcctggaaggctgaaggtacggggctcgttggactgcagcttcgtttccattgagcgtgtctttctttactctcgatttcttttctttaagcatgaagtccttttgtccgcagctgcgcagacgcctctcatttcgtttcatcgccaaggttcaccgtgtcctgcaagtatttgtcaccggcgtggctgccgaacggcgagcgtccgttttttcccctctttaattttctagaacaatgttttcatcggccagcga

SEQ ID NO: 3475 - DNA, 3461 bp, Toxoplasma gondii
gattctggcggctagaagttcaagacacgaagtaaatgaaacgacagtccttttatttggatccgttcctgtttacacatacacccgggtgcgaggtgaatgtttcttttccactcttaccgtgttcggactgtggaggaacatgtctctgactgcaagcacgaaggcttgccagtcagaaaggagcaccatgttgcagacgagcgtcgaagagagtctgcaggcgaactcgtctcttcttctcgctgaactgcatgcacaccagtcacgccgagaggagaggtctcggcagaggccagaggaaaggagagaggccgcggcgggggaagcacagagagaggaaacaagaccgagagaaagaagtccgtcagacgcctggagaggggaaatgggaagggtgtacgcgcacccgaaaacgagaaacagagaagcagcgagggaaactccagtcttctttcctctttctcgttccgggagtggacagaggatctggagttcgtcgaagaacggagaacgagaaacgaaagaagtgtggagcagctctcgggtgtctgtgctgacttggaggctgacgttgttttctcggagctggtcgagaacttctcggacgacagagaggagtgccaacgagacggaagagaagggagaatccagcagcaagaagcagatgaattgtggaagagaacggagcgttgctccttgaagaaagcagtgctttggggcgttgacttcgtgtcaaaggaaatcccgaaggagcaacttgggcgccgttaaatgagaaaaagactgtcgcaagaaagaggtttctacagatttaaaaggtgatacgacgtaacaaagaacagccgctcggatgtgtgaccgcggaaaaacgagaccaagagcaccttgtgcatgcagtggaaaaaagcgaggggtgtctgtcgcaggaaagattagacgagtctgaaaatctcgaaggaactggtccaggaggacagcgagtttccgaaagacggagacagcacaactggcacacttcgtctctcgcctctctcggggtgtttctacacaaccaacaggggagggagggagctttcctgagcaagcaaacaaaccaggaaaagcagaaggaagcgggaaaaatggaaagtgatgtctagtccagcagaaacgccgaatacagcaaaagaatcaaagtgttcatctgacaaatactggggggcaaaggctgcatgcatttccgctgctgactttgcggcagaaatcgacacacccacgacgagttgggggagaaaccgtccagctgggaactttcttggtgatttcgattgcctttccttcagagttgtctttgcttcagattcgcgtggcttgagatggacttgtcttcgccctgcaaaattcgctgtcgaggctggacggtctctctgaagcgcagttggtggaaatcacaagcattggctttgtattgggggcaaacatgctgtcgttgaaaggctttcggtgttccattttgagagtttccggaggacttgtttccgcaggaaaaaacaaaggcgtcggggacactgcaggaaatccgataggcgcattcgcactgcacacgggacagccactctgtgctaattgccggattttcactttttaacgcactcacctcttcgacagaaagccacacaaaaccttttgctaacgaaattcgagccagcagctgcagacaggaactgagaaaaagcacaacgtgcagaactgcctcggtgccgcggcactcgaggatcgtggcgggagtgagagaagtgagaaagagggttccgcgaagaagcctgggaatggaattgccttcaaatgcgttcgttgccgttttcgttctctgctgcatcgaggcgtctacaccgcacacacgacctcgattcatggcatgtggatgcagggaggcgaatgtaaaggcgtttaccaagcaagactcttcggtgggccagaaacacacactgaaagcccagtgttctcgcagtaaacgacagaggacaggcgcgatcccgcagtccacgtcaagagcagaataatgcggttgtgtaggccgtacagctgaacatcacgagaaaccgacaccaacgtaacgcccttcacgtcatgaccgaggcgtacgctttctggattactgttgcctatcgtttaacaactacaagaggaaaacactgtcaggggattctgctctggtttcgagcttgaaaggcgttgtttatcggatccgagagcacgtcgttcaacgctctgtagggaagtgtttagcgtttagggggggggtttgcgaggacaccgagcctggttcctcccattcgctggcagataaagtccagttctgcctcaactgaggactcacgtacatgtcaaccgtagaccgcacagactgaaatgtggtggacgagggaatctcgctggagggttgctgatttttacaaggagtcttggcaccttgagcccgacccgtgtgtggaaacaaaatatcgaggacagcggtttgtttgtgaacgcgacgcacacgtggtaatcaagggagtatctggcttaacatggggattcaagcaagtacagaatgtccgaggatctctgctgtttccccatgcccgtaggataccgagtttccttgggtcagcttttcccgggtcgcagcggaaagtttttggattgctttactttctgtgacaaagtgcagcgcctttttccgtgtcctcgtctttcctgatctatacgcatgttggcttttgatcaggcacagtttacccgaggaactgcaatttgaatctgtgaggagaatcggaggcacaattgaacatcacctctggatggaccgtcgaggctcttgacgcgcctcagtctgagttttaccgagtcctccgtctacactctctgtatcgtaggaacgcatccctactcgaattttacattctcactccgtggtatcggccttgattcgcattcagtagtcgcccatatgcacaggggtgttcctctagttctgaaggaagcagaagaacggatgaccgaggttaccgttatgtgctatgcagtgtcacacgagatgaactctagaactggcgttcgctcactacagtccggtaacttctggtgaaaaaacggctatcctttaggttagacagtcttcttcacgcgcttcgtacgctgttgtgcagcagtgggcaaccatgtgtaccgagtcgatcagcacttgatccactcggatgacagcattgcccttttcccctggggaccaaaaaacgtttttggatgaaaaactggagtcatctctgaagatggaggcgatgtgtgtctgtctgcctcgcttcatccagttttgaccattcctttgtgctcaagagccgtctttccctttcagaaatcgttttcgtttttgcgcgagtcctcgtgcgctcctcgagtctgcgttttgccaggtttttctaaaggtgaaaaggtgaaaa

SEQ ID NO: 3476 - DNA, 4816 bp, Toxoplasma gondii
ggacgaagatgcagatgagtagcgagagggagtaaaaagggaattcgaagaagaaatgagagaaaagaggtccggcgcagtctcgcacttgggactgctgggcgttgccacatggaaagacatcttgaaaggtacacgaagaaaaaagaaacgcgaaaacgggactaagaaaatactaagaccacatgggggcacgtgagcaggaacaggttcgtgaaagaaagaaatgtagacagtttgaaagaagaaacccgcccccccggctagagggaacgagaatggggatgctttctgtcacgacgcttgcggttcaggactcacaaaaagacccaagaaaacagcaaaactgtgatttcagtaatggaacgaaaacgggttgccttcctgtaggacaaatacacacgcggtactgtacaccgttatgtggaatacatacactcagatggagaataccgaaatgctctcggagatgcctctcttctctattctctgagagtctggggcgtcgacgactgccagggagaagctctcgcaaggggtgagcagagtggggtaagtgcgcaagtgtgtctatctgggatgtacaaaataatcactatgcgcaagcgtattgagacgggcataaacagcttccgcacacgtcctagaagaatgccgaaaattgccccttccacttagtagcaagtctagtggatgcggtgtcttgctctttctgagcaaaacaagtacctttccccatcccctttacggttccgtttccacgctaacagctggtgaaaagaaacaggcaattgctagtgcactgcgtcgaccctccacgctcgttcctctgttgcccggagaaacgagactggagacacaggcgcgagagattccaggtgtcgttgacatgaggggaaacagaaagacgcatagcgtcttctcaatcgatccgcataggtgttgaggggagaagcagacaaaacgcctccaacggggcaacagacacgctcaaaacagaggcaaactgagaaccaagtattgcacgacgcgttcagtctccgtttctgcagctggaagaagagaaggaatgactttcgtatcccccagcctcagatacatgcacccttgacaaaacatcactttcatgtggcaagggaagatacgtgttttccgctgtcttcttcccctgttcgcttcttcctgtccatctgcccatgaaatgccgaaccgaaaaaccatgaaataaaacaaacaggtacgggaagaatggcaagcttcacgacgagcgagacggggccaatgacggcagggtagagcaaaagcactcagttaagcagacacacgataatcttgcctgtcctcggtctcagagagtgacccacggactcgcgggcacctaaatcaacttcttcggtagctacaaaacttctgtccccccactctaaacacttctcccctgcagacgcttttgctggctcgatcgctctcttcgtgtcacgcgaacaaaagatttacgtttctcgtctcgagcctgttgagcactgcgaaacgaggagcctggctgcggctctcacgcatcgcagacaagagtcacgcctcggacgtgcatctctccggtttcccgagagcgaaacttcttgcttgtcacaaactgcctccctaatcgaatcgtatatgcgcccctcggctgtgaaattcgcacgaaaaaaggcaaaagtgatccaccccgagaaggctcgtgatggcaaaaaggtgaaaatggtgtcacgcaggaaggcgcttgacagtccttgaccagaagagaaagacgaaaaaggcggcagacgtgtgaggatctcaaaaaacatggagaaaggggaaacataatactcacaatagatattggcttcttcagaaacctctagctttcgaacagccatcccttgaccagacctcacgctattggcgcgttgacccgtgccaacacggggctctcaccctctcttcttgattcgaagtttatcgtctcttctccagtttttcggttgcacggaaaaagcacatccttacttcgagtctcttcctcgatgtatctgctagccttctagctgcttcggcccaacgcaagccaacacgctctttcgtgcgaggtccagcgaatgtgctcacagcaagaaataccgccgttttgacacgaaaaaagcgaaaaccagtccttctcctcagcttgtttcatagcaatccactcggggactcttaccacttcatcctctctcctcctgtcttcctgcgctgagaagaactctaccccccaacattggaaacctaggagatgcacacatcgcttggcggatttagcttacacgagacgcactgatttcctttgtactatgcgtgccttgggcgtctggcgcactagagaattccctcttcgtcggctactggaacaccaatttcgcgaaaacgactgggttaaaccgggaatgagacagagatcccgtttcctgaagtcgtgttgaaatcgtctctaaaggcatctagccatagagcgcactctctgtgtcgttgaagaggctgaatattctgggttttccgccttccaaccggcgcacaaagccaaaggtttgatgcatgctcacaaaacgcagcccaattgactcacgccacgttatgggtgttcctggaaacgagaaatcttttgctcagaaaagcgcccaaacctacagtgggtgggcgctacagccttgctttgcggacagtctaacttcgtcccactacgggtcgcagctgaactacgtatttccaaagaaaatcacgaacaccttgacagcaaaaacgtgcttctgaacagagataaagctgatcgagaccacccgggtccagcttaaacccaaccgatgtgtgcgaatgccaagagatcctttgtgctataacagacgggcctgcttcgtgaacgcccttctccaacgcttcgatcaagcatttatctccctccccgtttccggttctaagccattttatgcatcctgtaacgggatgatcgtaagcggctagacaaggtcgctacaagagaaatctgtttgcttccagcgcgaattggactccttgtcagtgcacttctacgggaatatggggccgcggtgtccaggcctgttgtactcttcgtttctcaaatgcgacctccgatctcaccgagctcaagcgtagcgcttttacctttttaaaacacccagatcgtgttgaggaggcgagcaaatgactttacaaaaagagcgcagtcaaagaaagctcgtgaacggcgtttcttgacatcttaggtgatctttgctgccctggtctagtgtttgttggtattcgaacgtatcgaggaggtttgaaccggctgcagctgagtcttttacgtttcacttttttcacagacttcaacgccctgacactcgaacgagggcaacaagggagaaggcagccgacttcagcgcgcttcccgtgccggtcgcgaaagcgctgcttgtgtgcatttgaaaagccggtttctcttctacaaacagtgtgcccgaatggagacacacgtacgtgccgtggtcttccttcaggttgctgctttccttcttttcgcttcttcccacacactcgcgcaggttgccggtctcagcgaacggtgctgcccgtcgatagagttttgataacacgatgtaagcgacacaacgacaggttgtgtggcacacaccagttgcggctgagagtcgaggagaagtaggttttgtaacacaggcgtttcttgggagtgcatgcgagaaaagtgcgatgtgcgtgtcgggtcagcgtgtggaggctagtgggaaggcgaatttgcggtggaggcgagaggggctacgcctctctgtctctgcggcggctttgtctcctgcgggtcctcctttttctcaagcgtactctggcgccccggagcagtcgcgcttttttgttttttctgtggtccttctccgccgtccatttttctccgttttcgctctctcgcactcgttggtttctcgccgcagtgcgggcagagctccggcgcgctcggaacgaagacagaggaggaaggcgtgagctttctcgtttttctcgattttctggtttgttttgtggaggacgcgtgtcgactcactctggcggatcccccggttttctctgcggcacaaacgccccgttccttccccctcagagaacggccgcacttccctccgttttttgcgcaggtcgcgaactccccacgccgcctcttgtgcaaggtgaccactgtggagaaagcgtgttttttgctccttaaattcttcccgtctttctcagacttcttttccttctcgtcatcttccgttctccacactttttcgtttccccaaccctccgccggtcccccgcctcgccggcgttggtcctccgccgcctcttgctacgtgtctccactttgtcagcatttttctggcggctaaaaattcacaaaattccccgtcttcccactttctctctaagcaaactcttgccaccgttctgcgcgcttgtgtccccggttgtttcactcccctggactgtgttgtgtcgattctccacgtccgagtggacctctggacctcgaaagggacccagcgtttcccctgcgagtcttccgtcgcatgcttcacgaaaaaagcgttgcgactttgaaaccgtgcgttcctcgacactttgagtgctccacacgtttcgccatctctcgcggaaaaggattcgccgcgcgactctctcctgtttgccgcactccgcatttgcgctctcttgcgcgttcgttctgcctgaaaccttccgccttttctcggttcaaagagcgggaaaa

SEQ ID NO: 3477 - DNA, 4054 bp, Toxoplasma gondii
tatgctggttcctcaaactgcagtgaaatgaggctgtttcgcgttttccgcttgtttgtttgctaaatgcagactcaggaagacttggacgacatcaacgtcttgccggagttcttgaactagattctctttcgcctctttcaagcgcgaagatgtttttcgaagaaaagtctcttatcgaagaatccagtgcgcgaaagtcgctattcgactgactttgctggacacgctgctccttcgcttggtttttgtggtcgatatgcaatagctaagacaaagggaaagcgaaacggccgtcaacctcaaaacgagccgtctgcgcgtcgagtttcacagtctttgtgtcctcagccaggagggagtacgtggcatctttcgcggggcaatcgattttctccttgtgtcaacaagctgcactggcatattcggtgtcgcgggagttttctctgttttacccgccatacttcgagggaacctttgttttcgttggagcctcatatcgaagatttttctcttatgtataaacgtggcctgattcaacgtattaattgcagggtatagtcgttctctttagcgagcttattgtgcgaatcgaacggcggaaaacaacgccgttggtagtcccgcggtttgatagggggtacacccagcacgtctctcaagccaaagcttctcagatatggccaagaaaagcacagtcccgttaaacacacaacccactctccggagcaaaagtgccacataaagtgctgaaagcccgattcagacgagatgcgactgtggatgtctgagtaatgtctagcgacgaaggaacttccacttttgctcgactaccggtgcagagtcctgcccacagtgggtttggctgaatgcgacgagatgaaaatgaactgggaatacgaaacaccggagcaacgaaagggtgacagtcctctgtttgtgcccggagaagcctctgacacgacagtccgtacattgacaggaactgattcacgcagaaaggaattacaggagccagatgacacatggtgtgaggcttaatgagattataaaattgtggtctcggagcacaattttaccagctgaagaaggagtggaccctttacaagcagggactgacgaagttgtcgccatccatgtctgacggctcactgccagtacccagtgacctacttctccaatattcttttaggctcgacatcgacggcgtcgctcaaactgaatctcaaaaagagttcgtttttgtgccatgcgacgttttcttccggagtcttgctccgccgtattcgtttggagcacaagaaacacagggacagagctcgacgagtcgtgccttgcagtttggagagtggcgggctcccgactccggcgtgaaggaagagacagatgacagacccactacttcgcgcctgtctctcatttttacatccttttttcacggcgaactcctgtgcatgggctgcattcatccccagaaatgcatttggtttgcccttccaatctagtcaaaaccggtttttcccagtgtggccgtctccaccactcccgccggcgtgttatttttttcatttcaagagcttctcgagttttcttctctgcgtttctaaaactctccaaaatgtgttacgaagtaaaatgtacacactgtggaaagcggacgtggtaagtgcgtgtctgcacggaaattcacgcagtctgaaaacagcttccaacaaactctgcatgctgattactgcgcgagtgtgcagtttcaccatgacaatcaaactggtctgacgaagagaatccattgcaacggcttctcgtggtatttgttggtgacaaggctttcgtgtcctttacatcctcatacgttttgtgccacgcagcatgaacaattatgtattaagtgtgtaccactgattgtggaaggctgccgagaaggtgtgagcccgcaggcaaggaatcttggaagagcctactcgtttcccttgaatccaggtagcctgtatgaattacagcggcattctacgtatcgcgcacttcactggtaataatgccacacctacttgtcgagctcatctctgacagtacaacggcttctggtcgtcacgatagcgagttggttttctgttaggtcttctgtttctcgtttttactaggtatctacctctgtgtggcgtttcgatgtctaagctagagctatgattcttgtgttggtgaatgcggtgtggcattcttttctcatgacgaccccccaggcgtgctggccgtgcgtcctgttcacttgatggtacagacggatttgtcgctgcttcgacgcgaaaaagtggtttttcaggtttcgaatgttacaacgctgtgagcacgtgtgaattatgtgtactttgtttgttgacgtatcctacgtcaggcaggggtgcggcaagcacatcgactctgtcatgaagcccataccggtacaggagcagtgcgcgtgcaagccgcgatcccaggatgagttcgataaatgccggtaatctcaatagggtggatgcctaaagagcgtctcgtagctggagaatcagctggcatgctcgcagtgagacttcatttcttcggtgtgtcggaatgggaaagtcaaagaaagggacgtcacacgatcatccagaaggaacgggcaggctggcaagcgacgccatatttcagaaaaggcggcagttgaatatgacagtacgtgccttgtctatcgaaaatgcgcatatctaaagtggcggaataaacaatctatgcatgcggcatataaggcaggtccacacctccactgcacctgtaaccgcctatttcattgtacgcgcagattttctagaacggctctcaggggatgctagagaagatgtgagtggtgtggctactgccatggccttgttgtgtgtgtccatccgatgaacctgtgagagaaactttgttggaaggacacccacgggacagcagcgtggagtttacagtccgcaacaacggagcgaaagtgtatctgtcagtcaggggaagatccgttgtcggagacgtgcctacagaagctgtatcgtcaaagataatagacggcaagggtatacagatctgaaacagtttccgtcgtggttcattatcagtggacgccgatgtcgctgccaacggtttgtaacatgtgtgaaagccgatgatttgcgcattgtggaccgtcgcgcctagcagactctcccaggttaaactgccacgcaccgatggaaggtttacggctgttttacggaacacgcaggcactgttttggcgaaaactgtcaccattgcggttttcatattgcgagagatatgacccgcccgtgctctagcgtcagcagtcgctggcatctaaacaatcatggttagagacttcaactagaacacgagtgtcagatattgatttcgcagtagtttcgatgctgctctttcacattgggtaaccgcacagtggcggttgtgtaatccggacagatccaacgagggggccgtgatatgcacgtattgtagttataccggcagagcgacacatgatggaggggtttccacacacacttactaggcatcactcagaagcgcacagtggtttttctgacccttcagttttcgcactgttggtgactccatcgaagatggacagcaggatggccgccgactgctgcactgtggctgttgggggcacccaggtatcataacaggttcaaggtttcaaacgtgcgaatagtgtgcaatagataaactgtacgcaaaacggtgcaccggatgcgtgtagctctgtattcctcattttgtccatctccgaaaacgtcttgacacaggctgttgacgtcgttgctcgctgaaaggattttcaacatgacgaccctgctcgaaacgaccgacacggctgtcgatctgtggcaatcttcatcacgactatcccgtatcagtcggtctgttcatacatgtttctaccaatttgtagtgccaacctaagcgcgtcaacattccattttatttttgttcgtctccgtaaccaaatccaggtctccgcactgtcgccgttgatcacatcaaaa

SEQ ID NO: 3478 - DNA, 2015 bp, Toxoplasma gondii
gaagaacaaagcagaagagatcaacagcgataaggacgagcgcagcacagagcgcctttcccatgcactctccccacaccgggttcacggtgcctgtctgccaaagtctgttttccttccctctcaagaaaataaagcgcgctcaaacatgcatcgacgagtccgcacacaagcgtacgtacactcctaaacacacggacgtcccctgaatgccacgcaggaatatatatatatatatatatgtataaatctatatatatatatatatatatatatatgcagatctatatgcatatctttataaaggtgtacgtgtgaagatgtctacggaaacgtatgcgtatttgcccagtttgccgttgttcgcccttctcgtcagcggtctctgagatcggctccggccgcgtacccattgatgttcatgcgtggagcgttgatcgggacaaagaagcactcgcgtccgcttcctggaacctcgaagagaacagcctctgtggagtgagggaggaaaacgcagaggaaaaggacgacacagaggaaagaggcgctctttccggccgcaggtttctcgacagccgcccgcctgaggtgagaccagaacccagaactgcctgttgttcggccaggcgccatcttcgcgtgcataaagaaaaatggaaaaggagagagcaaaagaggaacaggagctacgaacaaaaacaaaggttttcacagaaaatttgcggagccgccagacaagagacaggcggtgagccgagagaggaacctgggcagatacttggcggcgacggcggagggaaagagagagacggaagagaagacgcaaacggagggtggaccgaagtgaaaaacagagaaagcaaagagaaaaaggcggaaaggagaggaaaagaggaagaaaacgcacaggatagacacggttgcgagctgcgggcggcagtcgtcggtctctgagaacagaagacaaagcaaacgcgccgttgcgttcttttcgcgaccagtcgaaaacggagtggagagaccgtagaagacgggagagggaagtggcacggcgaaaaagacatgaaaaagaggcgacagtgtcggcgccggcaagacaaggaagcgccgaaaccagaaatcaaaaggcgctgcagaaagtcaggggaaaacgaggaccgagtgtacacactgcggtgcactttgtatcacgcaattagagaagtctacgcgccgagtgcgaaaagaaaaagactggctaccggcgttccagccgcggagggggacttgcctggcaaaacagcaggcctcttcgaaaatcggactatacttcgtctcactctgcgcatgcagcttgaccgcctctccacgttcgcgctgcgctcgctgcgctgtgacttgatgcgcttttctgccagtcaagaaatgcatctgaaggtttctcgcggctgcggtcgactggcctgagctcgaaaagaaaaaagcaagggtcgagcggaaaacgaggttgcccgtcctgccaaacctccgcgttggcgtgtctcgcggataccctctcacaggcactcgctttgctgtaaatacgcctcaagccgcgcccttggggacctttgaggtccccacaggaaccgagttcgagttcgagcgagtttctcaggcgctgggccgcatgtcctctcttttccagttcgcgaccttctccgtcggacgccgccctcaattctccgacttcctgggcgtttttctccgcgcccagccgcctttccaaccaagaccgcggatcccgcgggcagcgccggcggtcctggaggtgtatgtacaccgcagaaccgctaatacttctgattggtggcggagacacccgctggcgctagggaaggtgtcgaagtcactgccttttttcgcggagtgatccatttcatcgaagaaacacccggactctcgacttcgactcgtctgaatcttcttgtcttcgtcgcctctttccgccctcgcctttcgtttttttccacttcttcccaacaacttcggcacga

SEQ ID NO: 3479 - DNA, 2589 bp, Toxoplasma gondii
cgtagattgtccggctgttcccttactatcgtctcgtattacctttttctctgcctcacgatgagctctactgggatctcaacgaaaaaagtggacctcccgtgagtgatgcacagcagtgaggcgaatgaacataggctccgtgttttacgacacacttgagcctagcggatattgggtttgtgtttagttgattgctgtgcacggcgtcaccactttcctgatcgccgcaacatgttctgagagacttcgctgcgttgtctgtctatgggacgtgttaggtctcagtcagtccactcgattttgtatttttagcgaaactaccgatatgaactagccggagtttcactggttgaaggagttggcaagaaatctacagcgtatgaaatctagacaccggagtcgctgctaacttcgggtttctgtcgaaactcgtgtatcctattcacagaagatgcgggacaagaaccgagttcccccagaacactctcgacgcggttgacatcttgagtgacatcaactacgggtctactgtcgactttgtttcctcaagtagaccgcctgttagagtggaaacagtaaaacactagcataagaactgtacagatgacacaccgagaacctacgatatagttgttaccttctaaacaaggccccatgaatttctagtgtgaagaggaggcttctttgcgctaccaagtgcagcatgtatagccccagaagtagagtttaaactacataggaatcgcgtattatctacatgttcatactcggcgtgacaagcgttcatccagtaactaaattggttctaggtgaacaagaatccgatccgtgtgacccgtgcaaactaacatcaggaaggcgaccatgaaaccgagcatgaatgcatttctcgttttcattgagggatgttcgccggcagaaatctggtagatgtgagaccgggacgttgacgaggtcaccagccaggaagaagtggaaaagtaaaattttctttgattttggggagttctgcgtttgtggtgtttgccagcgagtgaccatgcgactcagaagtatcgtcaaagcaatgtttccacgtgtttggccgctgggacaagtgatttctgcctgggcttctgaatcctatcgactcggcacccgatgagtcaaactcacttcccctccaaagagactacgggaaattttgggggcgaagaagtcttgcgatcgctttccagaaaaatcaggtgtttttcagcaacctcgtttcttctactgtatgcgacgtgacccctcggcctgaggcactggttcggggtgttcctggacgcgacacttcttctggaacaaaagttgggtacctctccctctcgaaaaacggaaaattctgatttataccggaactgacaaacctctgtctactgagggttttcgtccccgctttccaactggttctttatccggagaaggcgtccttcctcagtcttcgaagccttgacagtctcaggcacaaggtctcttagcgttggtccgcgggaaccccccctgtctcgctttttgccaaggcgaagagagtttttctgctatgtagtcttttgaggagaaggatgtgcttccttggactgtttccgttgtatttttccgaaaggcattacagacaaaagtcaaatcgcagctatgattcgtttctcgctccgacgcgtttgacgcccgtctacggtctccccgtcttccgattttacggtctgtcgcgtgcgttctgaacgctgcctcggaaacttcttgcaaagggattgaaattttgcgggccgctggcctcatttcgcttcttttccagaaccactgaaggctgctggcttctcagaggggattagctgcgtgctgtggataaagcgtccgtgtgtttttggctgtttgtctctcgcgttctgcccgggacaagaacaagggaaaagactctcctttgtgtgtctgcaaattcccgcagtccgcgttgcccttccgaagaagtacttcgctatcgttctttttttttggtgattttgctgtgtctttcgttcttttttgcgaggcagcgtccatagaggtaagctggatttcctgcccgcagagccgctggcgtggaaaaaaaagcgaaatagcggcgattctgaagagcgaagactgccggagcgggagtttttgatgtgtcagcgaagaggctttcttccgcgtggcgcccgttgtatgcgtcgagcgtttggctgcggcacgtggacttccccaggacgacatttttttttcgcgccttttgcctctctcgacgagaagatgccgtggtacgtgtccgtttcttgaatgtggatttgtcagtttctcgcaatccttttataatttgttttcgtctcgcaagttgcagtgcgacgggacgtttcgtgttgtctttcacttcccacttggaggaagcttcttcgactgaagaaagccgtttttctctccgtcaacggcacgaacctctttgaacgagcgtcgatgcgtgcgtgtaaaggccccgcaaagaggagctctcgcagtggagaaaaaacgctgggcgagtcagggctcccagcgaaaaggatggggagcgaa

SEQ ID NO: 3480 - DNA, 2969 bp, Toxoplasma gondii
gaaagttgttgaggtagtctttcctagcgcattggaagcgagcttgcgagactgcacaggatccgctgtgctcgcaggccacaccgcgaagagtacagggagggagatgcagacagacctatgcgacaagctcgcgaggcgtgaacaaactctggaaaattatgtcctcataagtcgttttttgagggcactcgcgaagaaggagaacgacgagtttttccggcgtctgcacaccatgttccaggctcacgtcgctggctgcacgagcagcccggcgccctcaggggttctgcatgaaagcccgaggccgtctgcaagtgttattctttctgtggatttacctaatggcaggttacctcttaacggtgaaagtgctgaactcagcgccgacacggcgccctctttcgaggctgaggaccggtcagagatccagcagagagggacggtagaacgcgagacaacgcagactaagcaaagcacatctggcgccgatagtggagttgcgaaagggctggagccgacccaatacactgcgggatcggatgcaaccgcgccggtgtcagcaccttgttcgccgaggtgtcactctgcatgtggagggctgccggaaatgcgtagaggaagccctagaggaaatcagaatatgggtgaacgctcgcatgtggaaccgatgttgtcaggaaaacacggtaagctctccggagcgcaggtagatgtgggagatggaaaaacgagggcgaggaacgacccatctggagtgagcgtgacgaaaaatacgagtggcggctgtcataagaatggaaccggcagccagtcacgactccgagagcctacagtgacggaggtactccgcgtcttaggctggattctcgatattgacgacgaacaagagggcatgcggccgaaactctaaaccccgccaacgcactgagtgcattattgtctgtgtgtgtgaggagctggcgggcggctttgcgaacatattctactcttctattggggcgaatgacgcatttagttcgagggcgctgtttgtttcgcttactggacgttggtgacacatctagtgtaactggacccacgtcagggatctttaccagtcaggtgtgtacggccacaaacatccactgtgtgcatgtctatgtatttccagaggtgtgcactgtcagtccatgacgggaaggggaggggaggcggaaattatcaagtgtgttccgagtttgtaacaccgacccttgctttcaaagaggagcatatcgtgtgaaacagattacttgcctctcttccctcacgtacttgggcgtgtagatccgcactgtccatcctgcaggtgtggcaccatcagtcattgctggcggttgacagctgcagatcagggcgacaccataacgtgtgtgcaacgctatttaataatgtgcgggtggtgatctctttcatgttcttgtgtccaagaggtggtctcccaaactgtccgacaaagtcaaattgaacccagtactgacgacgagctgtacggcctagctgtcttcgctatgtcacaagcagaaccactgcgacccaatagcttaaggtgtcctgtagtttactggtgatcaatttctacttgaaatgaaaaagtgtgacaccaaaacacaggcagtggcaggcatgtgtaacaataaagtgggaagcaaaagaaatgcttctggttcgggccagcacaactcctgaagctgccgacgacatcttggtcacaccaggcgcagctgactaggccatagacgtcgttgctgttagttccctagagagttgagataaaatagcgtactgaggaacctgacagcgtgtttttttataaactactggaggctttatcatacccactttgcctgtcattttgaatggtatgtacggctctcggagatgtgtatcccgccggcagtcggataaactgcagaaacggtcgcccgcctgagaccactgaaggcgtcgttgttgttgctttctggcatcgtacgacggagaaaaaacactttatcagcagatggtcggtcacgtctctaaacaaaacagtggcggccactaaaacgccggtcgttaccttggaccagaaggagtgtttgcggccccaaaatgcatatatgaccgtcctacagcacatctgtggtgcttctccttgagcatcgcgaactggcgcctcgtcagcgaagctgccagattgcatcaagtgacctacagattcgagcccaagtttaaagtctcggcgttttgccgtttgggtagctgccgcaccacgatggcagccgcgaaaaccgtactctcctaggcttgcagaaaccaagcgcgggactggaccagggcgacacttgctcctggaacgattgcgcggcgaaaccatgtcaccggatttagcgacgccgtcgctatctcccgtctctaaaggaatcgcacccccctgttctaagccagtgggttcgtcgcttaggaagttgcttgagagtagtcaggaatatgcaagttgatgtttttctgtgacctcttcctgtgagacttcggcgagtttccattaagggagggcatacttctccttgagtggttgtcgtttcgtcgacaacgtgggtgtcggcagagacaggctcagcctcattcagcgaaccactttcggcttttcacactaccggtcaaagtggcaggctcgtggaaggactggccctctcaaaccgatgatatagcatatgcgtagcagatgtcgttgtggcttcatgtactaagtgaccgtgcattgaaaacagctatttgcaaagcttacgcacagggcccaggatactggcccctatcgagtgcctgccagtttgaaacttttgcttttctagtggtggatgcactatacccggtttattcgactgcatgcatccggtgggtccattcaagacgatctttttggtaacaatttctactggataaggtgatatccgcaatctgctacacga

SEQ ID NO: 3481 - DNA, 3401 bp, Toxoplasma gondii
ggagtctgtggccactctaggtcgctggaaactgttggagaagaaagggaaccgacacaagaaggcgaaagaggactagaaaaaggagaaggtgaacaacaagtggaagagggaaggaaatgttgcagcggggagactggtgaagacgagattgagggagatgaagacgacaagagcagggacgttcgtgtcgcagttgttttccgtccccctaccaaaggcaaatcgtggttttctcttgcctcttcatcccggtatcagggaaggtgccaggtgtcggcacacccggcgccgccttgtctctcctcccgtcatcgaagaacaactttccatcgatcaaaatgtcgcaagtgttcacgcagaaagtccctagatgcatctgcgaccgatccttcttcaactctgatcacgccgtctccttccttttgtgagtcttctcttccttctctctccttgcctctgtcttcagctcttgctgtgcgttctcgactctcggacttggtgagctcctgtcaaccgttttctgcttgtgaaaagaatcttccaaggtctctcgcaatgcggtctgcagacatgttgtttgggtcgttggcaaagaaggaaaaagagcgacttccactctcttcgtctccggccaatggaaacaggcagaagagacaagggagacacggcaacagcgaagcgcaagagcgcgagggcagcgaagagaacgagagtgacgaaggaagaaagcaactctggaaaaacgaagtgcagccgaagcaggcgtggaaggtgaagaaggtggagggagcggccgagcaaacgaacacgagaagtgaacagacgaagagcggcaaagaaggattctgcgttgtcgcaagaaggttccaaaagaaaagagatctttctctcggcggcactcaggctcacgattcgtctgctgtcgaccacgggaggacgtcgcgaaaacgcgttccgcgtacctctcttgtctcacgcgtgtttcaggaagatgcagcattcacatgtgcctctgtttcgcacagaacgaaaggcaagatccccgattcgtttaaagcggagaaggaattaaacgtttctctccgtgtccctgtacttccgccggccgtttttttgccagcgtttcttcgaggtccagagacagccagaggagcaaacgagagaaagacggagagcaggaacgaattgggagtctgaaggtgtttctcggtgtccgtgaatcaagcttacattcctgtcggtagaaacaacggcgcttgaaggagaatgtaagaggtccgcgcgaaagtaaagaaacagtcgacgcactgcatgggttcttcactggcgtcttgtcatcagagcagagacccatttttctctgcgttgtttcttttgttccactgcacacaatcactgagtttatggataaagtagcattccccgttttcttctgaatgagagtccggctttttccattccaggcgaagaggttgtgtactttcaaccgttatttctgtaatacccgcaggtacacacttttccgttaaactataacagcagttactagccttctctccgctagtgtggttgcacaggaccagatggcaggccctgaaggctgtaagcagtcactctttgcttggagatcttcactgcaaataactgtttactagagcgcttgttagagtcattgaaaaagtgtccttttggcggcgttgctctttctgcgtctctgcgacagtgttccagagatctggtacgtccgtttttctgcgatctatcatgggtgaggaagttccagagaccctctcgttttcagtgaatttctgtgaagtgtaactacccatttacccacattggcatctgcttctttaaacacgcttgtcttcgtttcacgttggtgatcgacctcccaaaccatggaggagaaacaccgaaaacacatttctttgctacatcatcatttcgaccactgattcacgcactttctcggcctcgagtgaaactgcaaacgcaaacctcgcttatcgacactggacaacagtctcgctccacgtacgagctgtcagcgtttctatttgatttcacgggggttcccttgcctccaaagaagacagtgagaaacgtgccaccgtagaaaagccaacagacgaacagcctacgagcaggtctctctcatgttgcgtcgttcaaaaagggaagtgaatgccggcccgccgcaaaattcccccacgaaaagctccagcgtctagcgcgggtattcgataggaacaccataaatcctagctcctgctgaatgccagaagaacgcccgaaccgactcatactaaatgagcaaagacaaatggataggggaactcttgatcgagttgtcttcttgttcgtacatctacgggcggggcagcggtacagccgccagtatgagccccgcaaattaccttctgttgtgctttgaacaagcatctaactggtaaggcactccaaagaagaagtccttgtgtagtttgttgcaaaagcgtgacagaaacgcagaaaattccaggaaatacccataccgtatgtttcgtgaggggttcgtcattgacaaactacattcgacttcgcactgcctttgcttttccgtgattccgcttcccattcttccaatagtggagcgggtttcgaaagtgaaataaaaagcagcgatatacatgagaagaggaccatgatcgacgcaacggttgctcgtatgattttcacgtaccggtacatgtgtgcatgcatttccagctgttttctcccatgaggagagcaaactgacgctcggtgtcgcagtctcagcagggaaaagcgaccttcagcgaccgaacggggaaaccgaaataagcaaaggggtgccgtttcgtcctttccttgccgtatgggagtggaggcatcccatgtatacgaaagaggtgattccggacgctgtcgaaactggaggtttgccggtcagacttgttgacttttgttccgtcggcgaattttctttcccagttgtggaacgtcatcgcgctattcgtttctcccggttcctcatgtaatttttcttggttctttaccgcctcccttgtgaatcacactgcttctcggccttgacagctgctgctcgagtgtacgtccactgaaagttagtcgtccgttcgccgcgatatttttgcctggcactgccggaactgccagtctcctgcagcctctcgcgctactttctttcttcacgtccccgtcttcgcttccttacgtgttatggattaaatccagggagattctctctgcgttttgccgtcgtttctctggagtcttcgcgagagaggcagcgcgtttcctccggccctgccacaccattttaattgcaaaacgaaacgatcgcctgcaccgctctcttatgcttccgtaaa

SEQ ID NO: 3482 - DNA, 4411 bp, Toxoplasma gondii
ctctggagcaactccatcattcgctcctggaacctcgcggactcgtcgccctgagaagctggggctccaccaggcgctccacccggggcctgcagacccggggcgctgtagtacgaaggctgtaaggaaggcgaagacccaaagccgtaccctggagccccgggagccccggccgcccgtgcgtacggcgcgtactggccgtggtccggggcagggtacccaggggtcgcgtagtgacccggggggctgccggcccccggggtgccaggtggcgggtacgggctcgagggtgggtaggcccccgaggcctgggggtaccccggcatctggcccgggtacccctgagccaggtggcgctgggtctcgtcccagtatccttcgccctgcggggcccctgtctggccctctggccagtaccctgcctccccggcgaatccctggggaaccccctgggggtagtgcccagcactggggacgccggatccgtacggagtcccgggggcgacagctccgccgtacccttggccgtacggcgccgggtaccctagcacggcttgcccaggggcgcccgagtatccgtacgccccgagggaccccgaagcgtcgtagggcgtcccgggcgccgagaactgtggcgcgcgcgggtctacgccgtaggaagaggcgtcgtacgccgcctcttggggagggtacctgggggcctcactgtcttctcggaacccaggagctgcgccgttgtacaggggcggcggggcaacgctgaagaagcggtttctatgcagaagagcgttgcatacggaagggaaccaaacacaggaacgcatgtcccccaaagcgagaggcccggaacccgtggctgcatcgtagggcaagccggagcccgcgggcagctttccacagggcgagaaaagcaggggcgcagacgcgaagggccgcccggaggccgaaggcggcagcgagaaagcaggcgcggggacagcagagacagcgggaccagccgcggcgttcgccgccagctttcgccttgtcgccttcgagaggcttgacggggcgatggggactcgcatggccgaggaagtggggagcagagaccgagacggaagagacgaagcgcaaggaagattcgagaggggcttccaacaaaacgatgcagagatctcgtctggacgcgcgcggtgaagaggagaggagaaacgcgatttctcggagaaaaggaaaaaggcagtctcgcagacagcgcggtggtggtgagcaaagcaggcaggcggtgccgggcaggcgacagggacgagacacacaagagccgagtcgcgaggttttcgcgcaaggcggggggaaagaggacaagagaaagaaggcaaaagaacttgtggcagaccaacgacgttggatcgacatagcgagtggccgctggccctctctcgactgcatgcacggaagcttcggcggccgcgcgcgacagcgacaacctacgcacacccgagacacgcacgaaatccgttgtgtcttatgaaaggcagaaaatgaaactctgacgctgtatgaaaaatgccagcgactcctcggtcttattgacttcgaaaagagagaaatgcccgcgcaaaaacgggagtgacaaccgggttccccgttctccagagcgagagcaagccctgcgagagttcggaaggccgccgacataggagagccacgaaacagtggggggaaatatatcttcgagcacattctgcggcgtttgtaaagtcattccatccgaaaccggtggcacgattgtctctgttttccatctctcatcgatctacgatcttcaggagatgcgagctgtgaatgcccgtatggtaaatcgccacttatgcttcaaagggtagtcagtgagtgggtttttctctcatccgaaaggactgtcgctttccagacagagaccaaacttcttcccgctgtttttcccctcctggcgatttcataaccgccgcaatttctccattgcaaccccattccctcgcccccataccactagcgacagcagtctcgtgatagatcgagagattcggggctgttttgtgctacaaagaggaaagccacaagctgaaaagaaagtggggtgaagaaatatgacaccgaaaaggatatctgtctcgattcagctgtcgttttactgtaggcgtcccagccaggtttaggaggtcagagtttaaccgggagccggtggacttaaacatgcaaagccgagtgtcgacttcgatgcacagacgggcacaatgactccaacaatacttgggttccaggaagaggataggccttacgaggacacaagaattggttcctgtccgatgctgcctacagcacaaggggaaaaaacggtctaagggaagaagctaacgatcgaaaccacctgttttcttcttatagacaagttttcctattccacgaaatttacgcaaaaagtacacaagcaactccaagagcgcgcaggctttttaccagtcgatctggtggttcagaactcgctttcacaagaactatgcggcctgttgtttcctcgtaccactaggttccgtttttttcgtaactcgaagtatctgtttggaacttcgcagtggtctggggctgacagtgtctccccgatgtattgaaattgctcgttcagggttctcactccggaggctccttcaccgtccatgttgacgttggagcatcactccggacactgacgtcgttgtcagcgtgtgaagtggtgtcccggttcgacagagttgcttgggtgctaaagaagtggagcgaatgtgtgaggacacggtactttcattccacacggaaggctgctccgccttcagctcttcactgcagctctcgcgtctctagaggctttctgtcccgatgtacaaagtctctctgtgtacaaccatctttatttcacgcgacatttctcgtatttcctaaagacatggttcaggagtcgttgcttctttcgtacaggacggaacatacatggcaatgaacttctcaaagcagagatccttcaagaaattcaggttgcgttcttagggcactgtcactcacttgcagtctcagtacgggcagataattacgaccaagagaatgtcagtgttccattcagaacggacatcgggctggaacccgcaaggccgcgtcgtcaaaggggaaagagctgcttatgtgactttttgaactgcgttctgtcttgcgcgaatgtgtgaataacgaacaagtgaatatccgtcgtaccttgtgtttgacctgtctgcacacctgaagcaggatttcgaaatttccccggaagtcaccagtaaactgtgtggttctgggtgaaagcggggcggcagtttgcaagatctaggaaaaagactagggtaagttcacgaggctgcattttcttttttcacagacccaaccgaaactggcacaaggcagggataaccgtgtgtggtagtgtattctttccttgcctctctctaacgttctgtttcatcttggtgaagaatttccttgcacgcggatccctctcttccgcctctcctctataaaacctagacttcttgtccgctcgtgggtgctctgtactgggtggagtcttttgatgatatcattgctcgtctggctctgtttctgctcgatgtgctacgaaactaaaggaaagaaacttttgccgtaaagagcacatttctgagaagatctattccccacggaggtgagaagagagtttgcccgtgccttccgtctgttccgtttttaaacctggcattagtttcagcttgttttcctgcactctgcggttctgcttccccagaatcagagaagagaattcctttactagaaagagacggaacgattgagtgatcttctttgtcagatgctgacaatatttcgatgaagtacaagcgaaggcgtggaagtttacttccacccgcagctgtggtgtgcagagtagcttgctggtgcacgcgatgtgtggctccgacgcttttggagtttgaatgtggtggactttcagaggcaagtgggcgtagaaaaatgtttaacatgtttcctgagattataagtgaagaatttggtgtcttctttcccagcacaaaagcgttcctgtctggcgttccctgttcctggcgtcgcttttgactcgttttgtctcccgtctcgtcctccctggtacagctggccacgagcagtgtgacccccctcgcgttcctctttttttctcgtttttttctctgttgttctgctcgtctgcacgtttgtgtttcattccagtttctcgctgcttcctcacgcgattccctgtatttcgtggctgagatcgccaatcttctgttcgcttcaggatgctcgcctgaatccctcagtgctttctcgccttgtttccgcctctgtctcgtcttaaattacacgcgca

SEQ ID NO: 3483 - DNA, 2294 bp, Toxoplasma gondii
cctctccagaagtgtaaatgtgtaatgcaaagaacccgatgatcccaaaattgacaaggatttcgatttacccttatttttgaagtgtcatccgtccaaggaactccggcgctctctctcagcacgcgaaagcaatggttcacaagttaaaatactttattctgatcacgcctgttaaagttacctgggcagaatacgtatgttgtgattcaattatattttttcggcgcgttagcgcttttctcctcgccagagagtagtgacggcttttggaggggccttcacgattccccccaataggaggaaacacactacgatgtatgacgcacacgtgtacttgaacacgagttcatgcggttgggctgtcgaggaggtctacactgcggtaggaatccacaggcattactccaagcacacgcagcaactgtttaactggtcaaaaaacagtcttccgcagctttatttatgcgcttcagtcgatcgaatcaagtttggccgtcagcttcggctacgcacagcgatggtttctgcttcagcgaagaagttgacgcagtcgaatggtggttgtgaactaaggcttctggcagttccattcctgaactgatcactgatgattgatcactgcgaagcagctttgattatttagtgatcatctttaatgccgcggccagtgcacggatcaaactgagcctctccggcttcattcaagccccttacgagtgacccacctggagtcatcgatgtggttcagcggtcatgatagcaatattcctcgctcttgacccctcactacaaagaaacagattctcaggtttcagattcttcaggctcccaaaactccagctgaatgtcgttgtccatgcgtttacaggcggttcgccacttatttggcctaattggttacaacaccttctaatgtatataaattgaaaattggacttgaaagctcccaaaaagagcttgtttggggatggagatagctcaagatgggagggagcgcctcgggtgtccatttacgtaggaaaagaatctgtgcccgggggcgtagcggtgggtgaattcgcgctctgtaagccgctgtcttttttgtactgtaatgggttttttgagcgcagccgcacccctgtaagtgtttctctttcttcgagtagtctgtgagctcgaagactaatgatgtggcggatatttgaaatgcgttcggaaatatcgcacctcgtgtatggcgcaagtgagggtgcttgtgtttcatcccgctcttttgaaactcatctttgggcaggttttctttccctgttgttatattcttctaagattggggacgaaactcatgaaaagagccaagtgtcagtggagggcgtctgtcggctctagatcacggatttcgttcccggctcaaattttgcgttaaagctcttcccgtgttcgtttcttgtctataattaactcgcgtgattcgcagaaagtggttatttttcctatatcaggtggatatctccacgcaaaaacaactggtcagcgtgttttgttgcctcgcaagccgactgggtgattagaacatgcaggaagcggagggaaatgtctcgtgtttcagcacaggtctgatgacgtgtgtcgtctctcttggtttgggattagcctttcctcttgaatggctgaacgaagactgtcttctgacttttttcgccacctattaaggtgcgtaaaggagcaccggagcttcttgttatggattactcccgcgccttcctccacgcgtcttgcctcacctctcatgattgtaaacctctcgatcactcggatcagtgctgaatgacttgtcacaggtcgctcagcagtgtcggaaaaggacggttgttggattctgagtcattcctgcacaagaaagccaaagttcacctatgtgtttgatatgtataaatgcacatatgcttgtacgcttatccactgttattctccggcgctgcccggcggctgctgatccacatacacagggaatagtcgtgacgtgagtgcacatatatgtaaatacatgcaggcacatgctgtcttattctaccatttcgagggaggtattggtgaggcgtggtgtattgtcaaaccccgcggggagggattaagagaaaggtaaccgggcgagacgagagcgttcgtatctgcagagacaccatactcgtgtacctttgtttgacccgaggacccatttgcgtcattcggacggagtgaactctcatcaacattatcgtcggaaggttgcatgtacacagccatataaaaattctggttcctgttcggaa

SEQ ID NO: 3484 - DNA, 1353 bp, Toxoplasma gondii
ttcgagatgggagagcgactgcggcgtatgtctgtgaagcagacagacaggaaacgtctggtcggccgtcctttttggggtcgccttcgagagcaacgacccgcgagtctccccccataagcactcctctttctctcgatctcttcatcgactgtgtcgatgttcttctctctgtcgactgtgtggacttttggctctcctgtcgcctctgcggagcggtgatattttcttctcgcgtttgtcgatttcgctccacagcttgggcttgtctttgaagagccttttctgtgtttgagagcttccttattcgcctgtaccctccatggtcgagaaccgaggccgaaacctttctcctctcgtcggggatgcgacacagacgacatggcgcaccgcctgtgcttcatcttttcctccgagttgtgcgcttctcggcgcctcgcgttccgatcttcacacctgttcatgtttctctccactccgggcgtagcaactaccgccgacgttttatagtggagttagaccgttgggcgcgcagattcgccgcgaaggcgcggacttcttccacgcaaaagagcaaatgcgaggctccagtgcctggagatttgctaacaaagcgagccggaaacgcggcggaattctcccgtacggggtctaagtggacgtttcgggtagaaggaggacatgtgagcgaaaagtcacgagcggtcgtggaggttctcgagctcgtcgtgcagaaatgttggctggaaacagcttccccctctcagagcacctcttcgaggagaggcaggagagccgagaggaagcagaagtctcctcctgaaaaacttcacgctcgaaaaaagagaccgaggactggagctacgtttgctcgacgaagtcgtcgaaagaaacggtcctcgctgtctgtctcgcagctgcagactcgcaggagagttgaagcctgaagtctctgcttttcggccggacattcggcgagagagggtgaagaatataaagaaacaccttctcaaccttcgtaaaactcaaagagtcgcaaaaagcgacactggattcacaagtgacaacgctcgtaaacgggcactgccgtgtaggaggagctgttgttttccggtgagaggaggaaaatgtgtggtctcgtccgagttttttcacgtagatttcgcgccgaagaggcgagaccgtaaacagcctcgcgtctcctcaagaaaggatcgcccgcagaggtaagaaaaaagcaaaagaatgaacgagagacagcgggcgtgcagccaaccgcgtttttctgggccgagaaaagaagacgctgttagcagaaagcgccggtggccgaactgcatgtgagggccagca

SEQ ID NO: 3485 - DNA, 1574 bp, Toxoplasma gondii
cggatatacagatctgaagtttggtccagagaaggcaaggagaatccatgccagtgcgttgaacgtctggcccagcaaagcgacagccttaggcccaacagtatcaagcagatatccggctacagcgctgcaagtaaaatgacacgccatggcaatagtgaacaacgactgcactttggtgtcctgcagcgcgcagaggtaatcggtctcgccctcttccggggaggtatctgcgctttctccagtgcatacccacgaaaactgtcccgatttgaaaagcattgcgctcatgctgcgccatccgaaataaacagatgacgttagcaatgcatagatcatgtagatgaccagtagcacataccggttgacaccaaacggcgtcttctgctgtgcagacggatgagcactgtctggaagcaacgcgtacacgcgaccgcagcacgagctaagcagacccgccataatgccaacacgaatgagattcaacagcaagggcggaccgagaaaggctaaagtcgcagcgaagatagcctcttcgattcttaagaaaacgacaagatacgggcaaaagagatgaaactctccgcgattcttgcgaaatgagcgcagaaatagacagcaccggtgttattggacaacgcagaagctgggagacggccacgccagcgagcaaagccggcgcgtccactgatgggtaacgaaaaaacaaacacctaaataattaagaaacacaatagtgccaacacagcacaaacaaaaaatatgtctttttgaggaaagttagcatatgagagctacggacttccagaccgcaatatcgaggtagtcatccctagtgcagccagtcaagaaagggtactgcgaaatcaattcgacgaccattttttcggacgcggccgcacacagattggctctcctttactgaaaagactggagcgctgagaagaaatgaaaaatctaaagatggccacaaagcggaagcaggcaacaggatagctctcccggaagcaattccacgtggtggtgcgttcgcaagctgctaggaactctggctgcgccaccttgagaatacccgtctttacaccttgtaaaatcgttcgaaagtgctttgcaattctgaaagcagtaaacgatgacgctggagcatattttcaaagaaggaactaacctcccgcgggaacagcaggtcgccccccgtggggaggaccgaccgcgtggcaaggtatgaagttggggaaaccagctttttcccgaccacagacgcggggggggggggccagggggcgatgtgccggctgagtgaacttgcagatggtcacccgtgcaaccgcgttcacgttgctctcgggcctgctgcgtgacccaggtagcggtttgctgttgcaacgccactttttagagcctcgcttcaggcggctggggccctcctccacatccgtttttcctcacctggtgactggacgcgcaccgggacgcctgcactcgtcgtccctcgatgaacaccttccgtgtcaattcaagcgaaattcgcagagcgcaagatgctcagtaggagactacgctgaaagcgacga

SEQ ID NO: 3486 - DNA, 4390 bp, Toxoplasma gondii
gcgaactcagggttctacgtcgtctgtggaatgctctcgaatatgctcctggttgcgtttgaaaacgagctcattgggaggtggtggtggtttccttttttccacgtcgtagcgacgacgtctctgcgtctgtgtaaagtatgctatccgacgtcgtgtcgacccgctttcttctagacgccggtagcttacaggagtgttaccgttgctcgcaagactacaagaggagtggagaaaaaggatccgtgaggcgccgcttcccctcctgtttttggtgtcacattcagctgagctctaggtcactgtactcaggtagtgccaccgttacctcttttcttcacgtttcatctctcgtggatgtgtgggctcgacaaagcgcagttttaatgcgttttgagcgaacgatgactgaacagagtctctcaaaaatagttctccggtacactgaagagaacaagcacgaccgagagaaggggattgaactacattgttttaccgcaattttcgtcggaagcgtgtcagcaatagcgggaagtttctcttcataaagtcgcgtcacaattacacaaaaggagtcgctaaaagcatatgtatcgcgaatgattcactacatcgggactgctgtgactgaacggcggtaggtcctgagcttattggttcattcaatatcatgtgtaatacacccccaagcgttacgtgcaccatctgcaacagttttccgactgaggagcggataaaagtatgtcctaacactgctggcccactagaccgtctttcgggggctagaaggcatggtcgattgtattggttgcgcttttttctgacgttctgatttgccaatgaatacacgactccctgagcgcatctgtatagaatttgatacagcgtctggtgaccaggcggcgatcggcacgctgacactttgaggttgggcggagctcacctgagtctgccgtatctcctaagggacgcggacctgagaatggctgtagttcatcttttgaatgcctattgtgctccctagcataaacgtgtcctttaaccttttctaggtagtcctgccattcaccggtcctagcaacgaacagaaacgttagcgacgcaaaaacggtgcgtggccgtggcacccacatcagttttgctcattgatgtcaacggtttagaacgactccgcaagcaactcggagcaattacatccagccactttatagtctcgcctcaatagttttctggtcagctggttggctgcatgaggtataccaggagaaaactcgattagtctttatcggcagaacgtcaacagcacgagagacaaagctgagggggttcaagaaactaaacagtgcacaacaatatcagcaaaacacgtctttgcattcagtaagatacccattcgtcgacttgcacttttacacaaaacggtggctgatgcccccgaagtcgcgctgttttctacaccatggcacaggcatcaaggtaccgcacgaaaaaactctcaccgcgcgcggcacccaacgcgtaatgaggccaactcgttgtccattagggcgtcgactgccaaaagcatgctctggtcattaaatgcattaagcatactattaatccgaccccattgtctactgtagtgcgccagtaccggaacccttttcaagaaatttcagtccgcctcaggtgatgatggccctaatggagataagaataccccaaagcaaaccccaaatccaaccaacaaacggcagcaaaagctgcagcacaccaatgaacacattcactgcatcattctgcaggaaaccgataatgaccattcccagtccgaatatgaagcagttcagtatgcctagaacgaaatagatgattttgtcgtatggtccccctggcggaactggcacatccaaccgtgttatacgtctgaataaatcgtttactgacattttgagtatgtctctctgagaacggagtgcagacggtgtgtttcaaagaaaaacagtgtccgtaggaaatgatttgcaaggaaggttggcaactgagcctcaaccggcaaactcattactgtggctagtcgtttgacgcacatgtatgttttcctcacgagcacgaggcgcgtctcttccacttttggctaccctgtcgcagggacacttgtcggtcgatgctaatctaccgccaactgccgcctataccagggggtagcttgtgggatcgattgatcgctcggttagggatgcaccagacgcgcggctcctccatgtatctcaatcaaggctttcatcatgttcagtacgtgcgcagtcaatgtaaatctccgagtgaattgccagaacgtagaaacgaacgaggcaacactcctgcaaagagaaccgctataccaatggcagctgaagggtcttcgctccaccttacaagaaatcaacaacaatgatcttgtgcgcgtacgccttgagtactgaatctgcaagaagtgctggcgctatctgagctgtatcctgctgtggaaagtggttcgcgatcaaacgccacgacagacgatcgcaaaccgctgtgattacgaccatgtgtttgtggccttgtgagtgcctctcaaggagtagctgtttgcgaagcgcaagaccgtttcagcggcaaggctttaaagtcagacgctcaagtatgtgccttttaacggccctcaggggcgtgttttcggaagatcgatagctccatcgtagaaaagtgactgtctgtgtaccaacaaaaactgctgcggttaccggacaatcatttgacactcagcagagcagaagcgaagccatactgtccttcgcagccgtatcgcaaactggtcgatggcctagcacacataggagtagcggcggtcgtcgtttgacgctgctcgtcttctggcaaacgtcttcgcgcacttcgtcactttcgcttctcatttccagtgaatcaccagtctgtgacgcttttcggtctgaagcagcttgctccattatatatttgaactgggcactagggaccggacgacgatcatgacgccccaaacgactgcccagatccagccaacaatgggtaacagcaactggagaacgccaatcatcatgttgacgacgtcgctttgcatgaaaccgatgacgatcattccaagtccgaagaaaaaacagttcaggatgcccaggaggatgtacgccgccttgtcctttgggcttggtggctcgggcacgcggaagtgcagggttcgttggaagacgtcgctcgccgacatcgtgctaatgctagtggagtctgcacctggcgtaggtgcgaacggcagtttatctccgatggggaatgcagatccgctgaaagaaggcagagacgaaaatgtgatgagttatcagatgctctgactggtcggcaattgcgctttaatccccctgcagcgaggcacgagaacacgttccagtgtatctacaggaaggggcgcaggacacaaggctgacgtagcagctgggcttgtttcgcagcgtcatccatgactgtcgttttgactgcggatcaaggctcacgcagtgtctaacgtttgccacattcatgcaagtcctggtgaaaacctttgaaaacctccctgcttgcagactctcatgaatctagcttcaacgatcgtttatactgattgtacactttcggagatgcagtttcgttggtaattcttgtatgccgcaacggttacatctgcggcgattcaaggagacggaaaactcgtaggacggagttgttaactgttcttgagagttccctgatacttttgtaatgatgacgatgcccctatatgaataggatagagtgatatccctgcttttcttgtgacacacgggcagcagcgcggctctgaatacgaactgtactctctatgtcaagcagcataacagggacttccggtgacttgtgtataaggtttttatcagacacatttaagttatgttcaggtgataccgcatcatgcctgacagcaactcttccaccggtaaagaatgctacttcaccgactctgtgtgccactcgatccagcgttctaacttagcgtgttctcattgacacgggacatgctttttcccctactgtatcacaacaacgacgtttccttgcccgaggcaaatgactgcatgcggaccagctggccacagtcaaatggttagctaccaccaggcaccagttattcaaaattgttgctctgctcgttttccaaagtggatttgaagagcatgttgtgtcactgtataactatttgaccgtgccgaacattctcgtgtggctgccctcggcacttttcaagtttcgattccagcttttgtcacggttcatccccccgacttctgtgcgggcttcaggaaatctgtcagcttctgtttcttggaacagttttttgcca

SEQ ID NO: 3487 - DNA, 3783 bp, Toxoplasma gondii
aactcgatactctgtctccatgtaaggaatgagcaggagaaggaacgagcatcagcgacccgaaagccaacaagtgccgaagcatcagttcattcctagatccacagaaaattctcaaataccacaagagtcgcaactgatttgactgctctttgtcctgcacgtacagcctgaatgaagtgtttcccagtcgaggctgttctctgtttcttgacgacatgtacaggatcctcatcgtccttgtcagactgtcgctcatctttttctgcacgagttgtttgtgtgcctgacgcactgccgcctgcagtcgcttctgcttcagcctcctcggacaacgggccccttcgtccttgcttttttgtcgctcgtttcgcaaacattgttcctttaaggatatggtaagaagagagacagcttcacaatcgactgagcttccagggggaaaggcaggaccaaccatttcaaaactggggtcaccagcccacggtccaaacaacggaagatcgaaattagaattagtttcgtgacgtttaaaataagccacgtatttcggggctttcagtacgactcagccgttgtacaccggtgtatccatggtggccgcagctggaatcctcttcccttctgggaggatcctattcatcggcgtccttatcggctccctcttgctagaagaaggcgtcaggctctgccgacacggagaaaaattgaaccgtatttttaacccagagctccgtaagacagacacggacataccctccacggcagtgccacgaataatggaacagctccttccctcatctgttggcgcctcaatcccttttgaatcgaactaggtggataattgaggaccggaggaacagaacggaaagtagcgtgacagggaaaagagtggacagatgctttccttgctttgcatgctcgattgttagctgaacatcggcgaatgacaagctctcggagtcgagctgctctgcagagaaaaaatccagagagaaaaacttaccgttgaaagtcgttgacaagtcgaaagcgactacgcaaaatccatcgaataagcactataacagaagcgtttctcgataaattttgcggacggaaaagaaaggcttttcctcatctctgcagcaatgtccacgctctgttgtcagcatgcatccagcatgactgagttctgcggttcacctcgggcacttcgagggccagcaactatcggactcttccagtggtgttctttaataaccgggaccaggcattccattataggaaatatcgtcaacttcgaaggacaagcaaagaaggaaaggctttttgaggcaagagatagagagagccatgggaccctctgctggcgcgacactgaataccgtcccgcattcactccgtaccataaaatctcaggcatacagcgcgtctgcttagaacgagagccaacttgaatttcacattgacatgtcggccacccgcagactgggaagggcagcatcagatgggaggcactgtggaagagagaaaactgcatcctatcaccgtattcgacaaagataagccgaggagaaacgaaggaagctcttctcctgagcaacttcccagaaaagtaggcaaactataacacggtaaaagcaagcttaaaagaatctaaacatttatctcgtggcggcaacgctagttcaggagatgttcgtgagtaccgtcagagtcacggaggtgcagagactggacgggttcacttccgtgtttgtttcgcaagtagttcagttctttctggttacaatttgattccaatgggaacagcaacgctagacgtgttgagggaaatgcaccgaggtttgacgggagggacaaaacaatcctgaactggaggtgcctctctaggatctgtgaataagcgttcaccacaggacgcccatccaaaagtaccagctaaagggatagcctgcacgagttcgaaaatttaccggattcacaatagttttctgagttcaacatcgtcagttgtatgttagatggcaatgcacgctgtctgccccgtacaggattattagtcaacttcttcacgaacagagcgccgttctcgagaatcctctctagctatagaccttcctgatttgatacaagatttccagaacgaaaagaacagcgaatctggctccccctacctctttcgtgcattcatcgtgcatttgtcatgaggtggaatagcgtagcatgacattgtcctgcttaatatagaacaactgagactcgcgctcgatcccaaagctcattcaggcgacagactcatcacggctggccatttttgtagagtcgagatatgttgttttatgagaaactttgcaaggttccaccaaaccccaggagctactactcatcataactcgcctacagaggaaatgtcagtgatagcctcgcgtccagtagctgtacctcggaagacggcatcatcacgagcgtgccggcacgcttctcgggagccggaaatatctgtttgtgtagtgctggtaagcaggaatgtccccgtgggatcagcagcctttagcgatcagcatgttgcacgtatggaattattacacctgtttggatttttcgaagcgtcagcagttcccagcactctagtgtgtacaaaagtcgtgtctgtcaaagccactatcgagcgtgataagcgatcacctggcgtgcgcaagtctgcagaattgtgtgcatccgtatttgcctgtttgaggtttctaagggcagtaacgtcgacatcacgagctcgcggagttctttctgtattgacttttttgttctataattttacatcactagctttcacaggagcttatccgcaatggaaacgtgggggcgacggtgacgttcccttaaaaaacagacatcggaagtaccttaccggcagcaaagcgaggcaatgcagaagcgttttgctgcaggtggtatgccttccatatatgaaccggatgggagaaacgcaaacataaagccgcgcccccgttctccaccaacacacactgtttcatgcatttagacaagcacgcatgacgaaacaagggccgcgtccacgagcagtgtggggctccacgaaagagcaggtttcttcccgcggcattgtactcagggatcattgacagccagtctgttctaaattaaatagttctcttcggcattctttatgggtgaagactgtcattcagtctatttgtgactccagagggcgcggcttcctggtatgaggctacattcaggtgacagtccatcgctatggcccctcgatgtctcccttctgcaaaaagaagaactatgcggtttttcatgtttgggctggcctgcgacaaggttttctcagagtatgcacagcacttgatgatgtctcctgttcgtgaacagagaagtaagacacaacgacaggtcgtttcgtcctccaaagttgcgagaccttacagataccccctggtgggggggggggggggggaaaagccggtgcgtttggggactgtgcattacgtacgctacagcgtgtgcggccttcctatcccccaccactgaggaaccccgctgacaaatggaaagcttctttcagccgacgcggcagcaactttgctccggcgcatttttgctcccttcttccgcgtccctcagggctgtgaattccttatccgttcccaacgaaaggcatgtatcggcgcgcgtcctctctctctgcacttgtctttgttgaaattgtttccactaagcggtgagggaatttcagaaatctttgtacccagtagggattgtcagcagcaa

SEQ ID NO: 3488 - DNA, 2728 bp, Toxoplasma gondii
ggatttacagcagaacaggcgtggatagcgcgtaaagggagaagaagggcgaagtccttgtcactttgttttccgaaatcaatggtccgaatcacaaggggtgcaactgacacatttaggcaccgagaacggactcttcacattgccccttgcggaatgacttctcagagttcaacatggttttgtgaaagggaacgaatctcgaattgcgacagatcgcttcttgcgggggcttgctttttccttagcctagcgagaggcggcggatgctttctgtgatcgttttcagagtctctcctacacaatcatgcatctttcgcaggttcggcggcgaggcgcaactctctcgtgcctttgcgagatgtgggtgaagtccatccacgagcgctgccttcttcaaaggttttggacagttaaacgagacacattctccttttgtttttttgagagttaagcaatcaagcgcgtgtgttgttcggccagaggcgaatacgccccggaaagttcttcaaagattgattatggacaaagctaagctttttagagtcaagtgttaaagaaacacagtagtaaaaactttcaacagtgaacaagagcacttcccctaaaaagcaagttccgacatccgacggccgccacgtttttcctcttgaaagcagcgttttgctcacagtctttcgctgcacataccggaagcgcgaccacagactgcatttcaccgctttctggcgtcccaaacgtgacctcaagtagattccgcaggtcaaaaatctccacgggtgtgaatttctgcggatctctcgacgcttttcgtccttttcatatcgtcgtgttccggaccagccccgagatcgtaactctccagtgatgctctttccttgattttgccagcaaaacagacaactcaaaggaagggtgaggcgatgacgccttttacacccgggagtctctgctttacgacttgactcctgaatcagatctctctgtgcatctctgtgagcctcttttgcgtacacgtgtctctttttcgtgcgctctgaatcgaaggcttcctctatttcctgttgcaccgtccctaaagctgtttcttctggcacacaaccactttctttgcctgcctttaatctcgcttctccagtctatgttcaagctttttccgacgcagcaccaccaagagagtcctctgtttccgttttttctcgaaattttgacggaacaacgactcccagataggtcactggcaggtcaactcgttacaccgcttcatgttgttgtgttgtgctcctctgtgcgtttctggactctgtttttctgggatgtacgctccgcggcttcggtgtccacggtgatctcgaaaaaagtgattcctcctcgctctttagggagcggtgtgtcgtcacgtttgttgcatttcttctgtcgatacttcaacgaacgaaactcgttattctctgctttaaacagacgcacgtagacactccggaacgggagtgcggatcccgagcgcttgaccgtgccagataaaagaaataacctcacttcctcaatagagtgaaggccgagaaaaacaagacatcttggaggactgcgtcttcttgaataaatgccaagcacagtcttaggtctgcgagcaaacagacttccccgacagctactcagaggtgcaataccaacgtgcagggttgttgcggcgaaaatacataaacttttcttttctgcaccttttgagttcgcttcttcattttttgaaagaaaaagccagcaagcactctgttctcggttcggtcggtttctcatttgtccaggaacgcgctcattttgccttctcccttgcccgttgcctctccctggactctgaggtagccctctgtgtcagccgtcgaaagggcattgcgtctgtgtagttctctctacaggtcacgcgcttgacagtttgctgttcccttttctcttcatccgcgaggtttctccctctgtctgtgctgagggttatagccatttcctctacgaattaccttcctgtctttcgcgtccttgcctagaggcgagggacgccgaaacggctaccgactgtttcctctggagctcccagttcccatatcacagtgtttccagttctttgtcggagcctttttcggaccttggatttctacgcggcagaatcgcaaaacgcagtctggcgaagggccttctccgagagacgcgtgtgtttcgttcggcaacaacatcggggtataccggggaacgagttctttgcctcgacagctctcgaaacgtcgagaaaaggagcagatcgagaaaggattgaggaaacgagagtctcctgcgagaagacgaaagcggaaactggcgggtgtctgagtttctcgtgacgcacgcctccgttcgctgcctttctcgttctttctctgcatgcagtctgttgcttgccctcgcatgcaaagtgcacagcgagaacaaggccgctatcagcttcgctttttgctgttcgcgtcttgaacacttccacagccatttctcactccattgccctcgttttgcaagtctgacgagatcttctttctcttcggggacgcactgtgtgctgcagttcctgcagagaaaggcgagagaaatctaaagccgcaggggagaatacggggctttcttcttcttctcctctgcaaacctttcttcttcctcaacttgtaaagatgctctcctcaacacacaggtcatgcgtttgaga

SEQ ID NO: 3489 - DNA, 1191 bp, Toxoplasma gondii
gaggagaacgtttcttgggtctgcacgaagttgaaaagcagttgtttttctcgtataaaaattcgcagaacttcgaggaagaaagcgcgaaccagcgaccaccgcgagatgctcaacacaccttcacagggagttttcttttcgcatcttctctgcctttcgggcaaaggtctctcacgcccgggggtcgcgcctggtggaggtgcgtcgctttttaggaggatggcagatacgttctccgcaacgggccttccagagctttggcctttcgcttttgacttgagcaggattggacttcgagaaccaccagtgcaccagttttacacagagggtccgaagtaaaactttttctcacattcgctaggagaaaagaatcttcgagaggaaaaaaaggaaggaagggaaaacagatctctcgatatatatatatatgtatatatatatatgtacatatatatatatatatacatatatgtatgtatatatatgttagcacatgttcacatgtgtatatctagctacctacatgcctgtgtaatctccgtgtgtttatagagatgtatttgtacattcgtttattcatcgattcaccgattgcagttgcctgcgggtgtgggcgcaaatttaggtgtatgcctctgtgcatgcctctgtctattcgaatcgatgtgcgtcaatctgcatgtgaaaatgtctttgcgcatcgcgagagagagggacgaggacggaacgcgatcaagaaagtagatccgaattgcgatttgcacctttctctaaacctgttctgatctttgccgacacacttgtgcctgaaagaagctcgctaaaccacgaaacccgaatttgtcaaagacctagcggagacgcggaagcggtttttttcaaggaagacagacagagaagtcttggtgcccgtcggcgctctttggaggcgctcgcgcatgcacgcgtcccgttggaaaacttcgggtgtgtgtctccagcacaaattgaaggttcttgctcccctgaaggcctcgcttgaaacgaagccgcttctcttccacttgacgcccttaactctcgatctctgcttccccgttttcctcaccaagtttccccgttttcctcaccaagtttccccttagcgtaaaacctaaacgcctctctcgcgtccacagggttgtctcagtggccgctgccttcttcgca

SEQ ID NO: 3490 - DNA, 1428 bp, Toxoplasma gondii
cctttccagattccctatgcttcggtacatatctttagactgacaaacggtgcttcttcgtcgacggcactacgcatgcaccgcgtcttctcccaggcgccgagcgaatccggagtgctgtgagcagacgcccatgaacttcaaaagcattactgattcatgtagattaggagcgcagaaactcatctgtgccaaaggtagaacgtctgtccgcaaagggcagtgcctgatgtatgtggcgccccagaaagtcgttttggcgtccccgtagtagatcgtagaaaccaatggttatgggaggtagaaatgaaatcctaaagaactcgtagtgacctctttccttcctgtagttctgcgcggcgagaaaagcatttccttaggtagcgatctggcatcagcccgtactagctgttttgtgaaacgagggagagtcaatcactcgcgagtcacaaatgtatttagtgaacacttgatcactgtttttattgaacacctacaaaatacggcgtttaagtcaaaagttttgatctcccctccctgtccccacttcgatacttcctaagcgcgcaacccgggggtcgttctctttcattgaccatagcaggtagaacaaagaaaagggtgaagtgcttcgcctgcagttttctggtcgagtcatcggagctaatcgcgagaagcactctgtaaaagtcagctaaaatgttaaacacaaaccctcgacagttgaagtttgagtccacatcggtcacgctgcaggcggatgcacacattcctgctctgtctcgttttctcaagagtgacgtgaagaaccggcttttcagatgctcgcatggtcaggaccaccgtactgagagcctgaagttttgcttgtaaggagttccgtttctctcacgcgcggtcgctgcaccttccaagaggatcttccgacttcgttttgcattgtctgtacacaggtgcttcgcgcgacacgaaattgcgaaactgcagaacgcgagtcgactaaacagaaacttctctttctagagagagagctacgtgcgtgtaaacggctgaaggtctctgttgcgtgtgcaccaaggaaccttttcctcgcaaatcccgaagtgaaggggagattttcttctaaacagaacaccaacttacaaacatagcggttgaaggctgttacctctgcacgttaggaataaaacaggtgctacagcgagctgtaaagctgcaatgagccaggagacacagtggaagactcgtccagcctttttatccgcatgctcgcgcgaaattctacaacgacggtgtcaaggcgcgcgctggatagccggtgatgacaaaggacgcgagcttctcacgttttaatttcgtggtctcccagaaacggcaaaaagcacgttttttcgcgcgtctcatgcccggttgcctccagtgtgcgca

SEQ ID NO: 3491 - DNA, 1299 bp, Toxoplasma gondii
tcctatcaataagaatccatgacgtgtgaaaaagtatggattcaatcgaaagcgacgggtgagtagaccgtcccgatgtagcgttcattctgacggagtcttaaataccggtgccacctcgtacagagagttgagttattgtacaagtagtgctgctgagtgttgctcaagtctggtcagtggaacccctgtacctttcggtgtacactgcgcatatacttgtcaggtggcgcctcgcagtgcatctagctcggctagccgacaaacctcttagagtgaggtttgctcgccgagtgatcttcaactgagaaaacagcagtaaagagttcaagagggtgtcagagagcacacgtgatatcactggtagcagccggtcagtttagatggatttcgaaacatagaaacttttgagctgccactcaagcctgttggggccaaggtgcatggcccgtctggtcgttcttttccatttcttcgagcgaacaacagtcttaagacacaaacaataaggaacctgtgtcgagcacaaatcgtctgatcggaacagtgctcaaaacgggttcacctttgcgtcacagcaaaagtaggaccagctcacaagcaatattccacgacggttccgagaggtctacatcggtccagtagaacgcccgctgtacatcaccatcccctgtttcaagggatgaatcacctcagcagcggttacctggagctgtcaccagcgtttacagatgaattatctctatttccagggaaatctgcgacatggcggtcgagtctccatgctgtgcagcatcgatttgtgctttgtggcaagcgcattcagccggctgcgaagacatgatgcttttcacaggaaaaatgcagattatccacttcatttcgatgaaagttctttagtgccttttgaggcgagacactgtgtatttggttagacagcgaaggtgttagatgatggctctgaatgcgtcggctttactccggataaaactgaagtgcggtgaagacgctcatgaaacgtctggctgttaacagcactgatgtgtcttgaaggagtagcgtatctggaccaagcagaggtgttaacgtcaaattgtcattcactgacccgcagggtgtgtggcgtgaccagctgttctacgagagaattctaggtgtacgaggtgacacgagagcaaacatatgttcaagatgttcacaagagtagagttgaaagttgcagttcgttctctgcaacttcttagtcacgggtggaggtgtacacctctcgagaggaccgagtgcaaccatttctggtaa

SEQ ID NO: 3492 - DNA, 3621 bp, Toxoplasma gondii
ggtaacaaatgattgtttgtcggaggcgctcccatgggacttggcccacttcggggtgtgggcggggcaacgacgattccagatccggcaattccatggtgaataagggggccttctggccctccaatacccggcgctgatggggtgatgtgcgcgggcacagagggtgcatgcactcctggaagggccgagacgccgtgggtcgggcctgctgccttcacaggcgtcattggaggggcaaggagacgagacatgacacgcacaggggggcgtggagcaggagcaggacgtttggtccgtgtggaaggcgacttgcttggcttttgaaacgatgccgctgctgcgagaatcagcgacaaagacgcaggcgaaaaggtggaggaagcagccgcggcctccgcttgtggagcctgaggatgaggcgcgaaggatgcctctgagacagtggacgaggagcggtctccagaaatgcctcgcgttaggtcgaggtcttccgaaccagacggagccgaggaacgatctgaattctcgggaaaagtctcggacgcaagagacgggaagtggagacgtgccgggacgtgacaagctgtccggtgcgctacacaggctgcgggacttgagacagacagcgggtggccttgaggtgaggacctcagctcgtggaaagcaaacgccctggtagaggcggcctctgtgtcactcaattccgactgtgatctggagtccaaagccacagtatcggactggcaccgatagcggagcggtctctgagcgacagaacctgtcagttgagagagctggagcgaatctgaagaaagcgagtcagtcaaccgcggctgctgctggcggcggctgtacactacgagcgagcgctggaccggctgaggcgacactatgccctgtaacgctgttggcctaacgttggaagagagcggatgtgccaaatgagaagtgggcacttggacagagctccaggtggcagcagagcctcgttgtgacgacaggaccgactcggggccgtgcgcgaactgaaccatgctttacctcggaagccagcggttcagaaagacggagctgttcttgacacctgcatgccggcaacggctcaacacacggacagaaaacgcaactgaagaaggaaatcatcgaaaagacggagggacgtgccgcagtgacacagcagtggacctctccaactcaagtggtgaacaaaaggccattcgtgttcgaaacaaacgctgggacacatctcgatggcgcgcagagaaaccaaagactccagagctggtcggcgtacggggagctccccgagtggaggaagcgatcagcttagagcaatcgaagcaaaaacggtaagtcaacaatcaggcctcgaatccgctaccttgaagtccgtgatcccttccgcgtgtctagacggccagcatatccgcgtgaaggaaagcctcttcttctaagtgcggtgaaaataactaaaatatgagtgtaccctgagtttggcggtgttcagttttgtagccaacgaaggccggaaaacggccggactcaagacaaccagcagtccccgaatatgcagccagaaatcgggtggcaaaactgtcaaggacgcaaagtgactttacacatgtaccggaaggtgaacactgtgagagaattcgtcatgcaaaactcgagcaggtcgtccggaagagtgcggcagcgctcttgagggaacctaacaggctcgcaagaaaaatggatacgaagtttactgaaaagcgagccccggtgctgaacgagaagaacctgagaagcacaaaacgcaggtagttaccagctttcgaacagaacgcgcttcttgtctctgctgaactgaaccctctgggtgtcagctagagcacttgcttcttccacaagaccgggcgaagaactcgcagcctgcacagcgtcgtttcagggaggctttaatctggcgttatttgcgtttgattctctctcgcagcacccagcctgcagcgaagaaaaacgtatcgcgcggctcgcacccctagcagctgaaagcgaaggtgccagggtacaacctcgccattctctgtcttcttcctcgattcttcgcaggctcttgctcacggtacaacgcacagtgcgctaggtccccttcctgcccctggcacacctagccgattgctagcaaacattgcagctccgcaggtagactgtgtatgcctgccgcaagaaaaaagaagcgtgtgacgctacacctctcgtcctccaaaaaagtttcgcttttcacgcaaagaagagacagacatcgcggaaagaaacgaccgcaaaaactgttttcgtccgctttttaccacgactgctgcgccaggtgagcagcgcgcgaatccgtgccaacagtgctaagaatcgacagctcgcgaaaatcgacccagatgcacgggtgccgaatcactcttcagttctcgaaagaggacttccacttgcgatagccatatgaattcctgggcacgtccaacgcccgcttccggtgatttcttcttcgaagaaaatgttgccctgaccttctcgggtgccttgtgcgcgctccgctccgacaagggagcccaccaaccaattttctgtctcgccgctctcgagtcgtcggttcccttcaactcagcgaacagaatagccataattcagagcagctcgtggaaattcgatttacggtgcccttgagaagcacccttcgttttgtgtgtgtgacagttctttcccggaggtgaaagaccaaggttttcgtacgtcgtcctagtgctttagagggtttaaatgatctgaaaagggtcttgatctaaacgcaaaccgggtgatacattttgcgatatcgtcttttgttggcatttcaaatgtggtagaaagggacttttctgcctgcgagaaaaaccgtcgctaacggtgacccccggctaggccggcgccttcgagtatagagtccgtctgcttgtttaacgacctcaaaggactttcttctgctcatgtgcgcgtcgcataaagggatggatcagtgcttctcaacctcaccattcggttctgttcgtgtgtagaagtctttcaactctttttttgtattctgcctctgtgaacacagccttgttgtgtatgtcgccgaacggcacgtggtgttgagcactcgacacttggggctatagcaggctcgtcgtcacttgtttccagttcatttcattatcaatttgtcttccgtacatcgaagcggagggagagtcgctgacatcgatatccgtgttcccagcattgtgcagatttagagtcctgaccccgcttctaccggcaaacaggaaactctttcgagattcacgctgccacatccatttgtccgtgtcgcgatcctcgttccttcgatgccctcctgacgaaacacgacatgcactactgtccctgctccacataaaaaggttaggacaggacgttttctgtgccgtgtggtctttttctgtaggtagccaaggcttcaccgttttctctccctgtcttccattctggaaggcgttttagaaggttcccgccttaacggttgtctccctcaaggcccttccatttcgctttcaaacgactcggcaaagcttcctctcagaa

SEQ ID NO: 3493 - DNA, 1786 bp, Toxoplasma gondii
agtttttcgaagaggaatctacggttatgaggtacatgcctgcttcgaagtgccgcaaagaacgcgtttttctctgtacgacagaaactcgtgcgatgctagcgagactggtcgtcgaggcgcccgtattgtttcgcggaaaccagatggtgagcgccgccccctgatgtttgagactttgcatgtgacttcagcaaccctactttgcacatttccggcattgtggtctattaagagtatcgtaaatcaaaagctttgtcttcttgccgctcgcaagagcaatgaggccattagtttgcgtcacccggaaagaagcggtttgattacatgcaaccgaatttgactggaacctggacaccccccccccaggaagctacattctgttctgtaattctcctctggttggatgtggttctctttcacttctcaaatttgtgtccagcacctagccataaaaaaatagtaccgccgaccctgaaacatgtggtgctcgaaggccataaggaacacactggtagcaagctgcaagacatctcgggacgcggcagaacctgaatccatatttttaaagttgatcattattacattgtgtggctttggttaaccatctcctgacatcgaaaatcatctgcgagtgttcagctacgataattccgaaccatggatctcgactggtacaaaaaagttaccatgccctccgtacaaagccggcattaagaactgatagcttcattaaacatgtgcccgttaaaggcgctataatccgtatgaaatgactgtggaactacacgcagaatgtgatcatctctctcattcgcgctgtacaacacatagtgacaggcagtacatagttgccgatatcctgctctcttcgctttcagctcacccactattggagagcgcaggaatctgccctcacctacagcaattcttttggcactcttattgtgtgaaaagaatgcagacaagagagtcctagctactgttttaccaccatcgcaactgtgttccacgaaatggcagcagagcgaaccccggaaacagcaatttttggaagccgcacagaagaaacgacccacttccatccaacccaggctttaagaattgtcggagcatcactccgtagcagaagaaaccgcagtgtcccgatatttcgacgaatcttcgtttacctcccggaaaatggcggcagaatcaaaaaccagatgcatgcaaccccggccagtttgacttacgtcaaagtacgcttgtcttgcgtgctgtggcttgcgctcctggtgttcagcgcggtacactttttaatgcattgacacaatcgtgtgttttttcgttgtcattcgcgtatgaatcgtttgacgccatgttggtgtcgaaacgaccctgtaaaataaacccagaatccacaaagcaaatctcaggtcagccactgcggaaagatagcgtcgatttagtttggtgtaccatggaagcgtgtcgtgtgcaagccggcagcccagccccacaagggaaagaaagctgtagtttctttctgggatcattctaggctttcgaggatgcgggaaatgggtgaatgcggtgttcacagagtgtatctgacaagtcttcgccgcggccttgcctgtgcttcaggttcgaccgaaggtgagacacacaccactcgcgtctgtttcattttggagttctgccgttacgcgcaaacaatacgtcactcgccatcgcgtcttcacacggcacagccatgttggcgaaacccgcacgtcaattcctgcccttccactgcctgtca

SEQ ID NO: 3494 - DNA, 1769 bp, Toxoplasma gondii
caaatggcgtgtcgttatcaaagtctccaaggcaaaagtcaggattgctttctccgacctccgtttctcccccaaagcctctgtgtcagtgcgcctacagactctttcccctcgggaccgctgctccttcgcagccgtcgatcccttgttcgactcacctgggtggatttcgtcctcgaatttccctccgaaaatcgactctccgcctcgaccggtccccgtcgggtctcctccttggatgcagaagtccttcgcgactcgatggaagactgtattgtcgtagtagccggacttggcgagctcgaagaagttcctgcaggtcttgggcgcatgtttccagtaaagctcgacttccacgtctcccatcgaagtgacgagggtcacggtttcgtctccgcggtaaacacctgcaccttccgaagcggccgaaggcagcgaagcctggagcgacggcgaactcaccgccttccgcgaggccggggcgcttgcgagcgaaaacatgctgagccgaagcggggagaagaagcccctgaggggaggaaagaaaacctcgaaaagggagaagggaatcttccacgagacagcagaccgggagagactgaagacagacggacgacagaaaatcagagcaaacgggagggacggagtggacagacagagaggtacgaacagaggcaagagaggaacgcccgggagcaagaaagtagaaagggagggcgccgtgagtatcagaggtgagaggagacgaagcaggcggaagcaagaaacagatagcaagaggggaaaaatgtggagacaaaaggataacgagacgtcaagaaaaccggagagaaggcgaagtgagacaaaaccaaaagacgcggaaaaacgaagctctcacttccggacaacagctgaggcagcgacagacctacggagcagcggggagagccgtcaacgcgagacagagaagacggcgaagacagcgtggaagaaaacgatgaatcaacgaaagaaacgactcaacgaactcgcgaaatcacagatgaagacggttctgcttcttggagcgccgaaggagccaatggccagttcaactcccggcacgcgcgacaggagaaaggagttgtcactctcgagggaaaaaaactcccttgcagcactgtccggaagaaaaataaaagaggacaagaggtgccactttgaatggaactgcgaagaagaatgtcggagcactccgcgggcaaagtgtctacaggtttctgtgtcctcggtcagccggtgcttctttgcatgcatgcaaagcaaggtgcatgcacgcgcatcgcgcagaaatagcccgcgaaagtgtcaaacaactcggggcgtttcctttccttgatgcccccgacttttttcacagcttcctttgacttgtgtgtcggctcgcctccgataggaagtaaaagcctcgcgtccggagacgccgaggagagggcctcaatgtctgacagggtcggagagagagagcgagagtctgtcagagggaagccgacgcgaaaaaaacatctcgcgcgaaaaaagtaaaggaaggttgagagtagatgaagtccacacgtaagaagaacgcccctggactcggatgagagagacagcgaaggcagcggagaacacaggaggtctaagctgaggcacagagggagagaaagagagagggagaaaagtgaatcaatgcaagctgaaaagagacagaagggaggcccccaactggccgctggagtcgttctggtgtacgtacactcaacagacca

SEQ ID NO: 3495 - DNA, 4668 bp, Toxoplasma gondii
tcgacctgtatgcgtgtgaagctgcgaaaacctccatctcgcactcagccgctgtgggtatttcacctccactttcccggcatctctcctgttccccgatcgccttcaccttcttcagcaagcataggaaggctcgacggcagtttgtcgcgtcgaaatcgccgcttcccgcgtacgcgaggacaacgcggctagccaagtcctcgtatgtgaggctgtgcggggtcgagtgtggagtggaaacagactcctcttccgctcgatccggaagctttacatgcgccacgactgtaggcgacgagacacacatcacgccctcgagtcgcaagtgcagcgcctctaaaaaggctaggactcgtatcagaacgtcccccacaacgtaccgcccgcaaaacgccgcaatcgagccgccggaaggacgaaaagattgtgtccgtaggtaccgttgtgcagcgatgtctagaagcagatggtatatgatacacacggacgaaataaagagcgtcgctgccgcatgtcccggtaaatcgcacgcggccgtggtaggaatcacgcacacaatgaccgccacaagtgggattacaatgtacgctaagaacacgtgcttgctcgtgtagtacccccaaaaagagacaagaatccacagaaccagcttctgcgatgtcacaggagagccggcttcgcccccaaatatccagaggcctgttgcttccaaaacaatatgggggaaaaagtctttttgggtctctctgttttcgaccgcggagtgattggacaaagccgagagcagacatgacaagccgcggaaaaggaaggcaacagagacgcagaggaagaagcgaatcgtcaccgccgacgcaagattcggagtcaggaagtacatgcggaggacggagcagaataaaaaaatgaggaatgcaacgttgcatgcaaagacgcttcttggagcaggctcggcacggtggaagcgagaagtcgtgcctaaaccatcgcgttctacgtcgcgaaacccagactctggcagcgttatgaaggacgacgagaccgcagtgtcctcccctgacaactcatgtggttgtgctgctcgcgagagctgggcaaactccccgactttggcggttacctgctctgagaccacggcggcaacttcgctgcctttactgtgatgtgcgaagggtagatttctcgcgagaaccagtaggaccaactgaatcagaagggcgagcatcaggatgcatgctgccaaaaaaacccgcaacgtgaacaccccaaaaatcgattcacaactacacaccttccctcctgcctggcttcttcctcgactgcatgatctctttaggctcgaacccgaagcagatagagcgccgcctacgctgctgaggcgcctgcaactcgcttcacccgtgctgtctgctgtcacaacactttcactcctcgccagtgacggaagcgaagcgacaacacgcttttctgtcttcttttgcagtctggtcattggactcctgaccaaacgaggaagatgcacgtacagccggcgcgcaacacgcgaaactctttcttgcctcttcagcgagacaatctctgagcttggtttttgtttaggggccggaagatccgctctcccgtcggcttctgaaacagagaacgattcatccccccataacttggacagcatcttcgtctcggtggacgtcgtgtttacttcgctcacacaatcgaaagccacatcgatgtagtagcaccgcagctccgttggatcctctccggtggcggcatcgacacacgaaggatctccgttgatggaagcgttaccggagatactgtgagaccacgccggcgaatctccgcattcaggtgtcatcatctttacgacttacaaacgagcgcgaaacaagtctgcaccgaaaaacttgggatctgacggcagactactggcaatacgaccacagggttccgcacaaatatacagatctatggaaatacaccgatcggacgacacccgaacccgtcaactgcacacgtatacggccacatgccagtgtagtgttcacgccagaagtgtccctacgctgcgctgcgagatcttgtgagaaaccgcgccgacaaaacggagaaggggacaccggccgacacacaagaatctcaaagacgcagactactactttctccgttctttgcgaccgggtcaaaccacttcggtcgcgcacctggtagcctaacaaagaacagcgactagaaagatctatgcagaagcacgcgtagctgtgcataaccggattattactaattccctaaacggctgtcggtcgcggcacctgtcggcaggttcccttgtgtggaactatttctctagcttctttctcccctagagagcgtggaacggatgaaagactggacagccgctgggcttctcgtgacgcgacgagacgaaataaaaaaggtctacaagaaaccagggacgaaaccacgtgagcgcatccccacgtatgtacctatatcgcttttttttgccgtgcgatggctaaccctttagagcactatctctcgcaaaaattgcgcacatgtgtatttctctgtgaaaaagcctttctgggttacgtcaaacacctctgccactacaaaaaagagagacgcgaaaatacgcggaaaaccccccctccatgcgagaccggcctcgacacaaggcgacaaaatcgaggagaaagaaagacaccttgtcttccattgtggttaaaaaaacgaagcgaagagcaagtaccccataaagtgccgcgtctcgaagtggatgtcgcgtgttccctagttctagccgagccaaggcactttttgtggggacgcaaatgagcgaatcatcacagacgcaagatgttcagacgcaagcgaaaaaaattggagaactcgaagcgagactaccaacgaaactctcgtccgaggatgtgctcagcaaagccaaaacaaaggagaataaaacacccccgtgagcctcggattgaaacagccgacgcggcacacggcacggagagaggccggagcggagacacgagacgcgcaatcggcagacgaaggagaagcgttttccagtcctcggcccgaccgccagaaatcacgacggtgatacaaggcgaaatatcagttcgcacaagcgaaaaactatagatcttaagtgcctctataggtaaacccgtaaccccgagtggagccagccgctcgctcccggcctgctctaccaaagcagaccagagcggctacacacgttcttgagttttttgtgcgcatgcaaacgatgagacagttgtctatttccaacagagacacgcggccttcaggatctgtgggtgagccccatgcgatcggttcccagcgaatagtccagtggttgtgctgtcctgccacggctgcagtgaggaaggcctagaccaagcggcgcagacactcaggctttttttctgcaaacggatcactaaaattaagagacagaaatgataccgaaaacgcgacacacacgtacaacagtgtgtctgagcgagcaagtcctctccaaataatgcgcaatctcacaaaaacccacgatatacgtacaaaaaatatatatacatgtaggtacgcctaagttgacatacatagatggaaggcttcacacacacacacacacacacacacccggtgtgtgtaaagtgccttcaacagtactacttcggaaatgtacgtacgtacagaaagacgcatatgtcgacctttaccttctgccagaagatctctatctacattggtcgtggctttcgtggctttcggagagaagtgatgcgatcgtgtcgttcccatctgcaacgaggaaaggccctggtggcctgacacagtctgcaaagacactaagatcttaatgagtgtgaggtttcgctcacgccgtgcctaggcaatgtggcggctgccttggaggacgctttcaaagcgcacacgcgtgtcgcggagcatcgacgtcgcatgtagagacctcggcaaactgtgtccagcaaagttagcctctcataagtgtgtggaaacgcatcggacagggagaggcgcctcaacgtttttcattcctctccttgcagcaaagaaaatgtagttcaacagaaggaattgagcacgtggtttctgctgcatgcgcgcttctgcagtgtacgcacaggcgcagtcgcgatcttgcctcctcgcatagcagcatcgagaaatgaaaaataacggaacgactcccagttctcttttttccccgtgtgtgtttcgtttcgtgttcttctctgagtcaacgaagattgttgttgagaacactctctggggagagccttcccttccgcttgtcgttcccgccggcgccagcggctcaacgccgtgtgggagagaggaaccagattcaaccggacgatgtcgggctagttcttcccctcagaagtatgtgcgcattttcgcatgcacacgacaaggcgagtgcctctgtggattcgtgttcgagcggagttcaccgcttgtttgcgctaacgacctccgggcgaggagcactggacacgatccggcgccctgtcaagcgtatttcaccgatgcatttctctctctaaccgctgcttcttcttctcccaccacagattgtctaggccgtgctcacaccctttcctcattcttctctcctctcta

SEQ ID NO: 3496 - DNA, 1180 bp, Toxoplasma gondii
cagcgatttacggttgcagttgtgacctcgtcttgcagttctgatagaacggtgtttatattaatgggagcacaagctggtaaccacttctgctctctatgtgtagtgtgcagactggtacgctcgatatgtaaacacgaggggctccggtgaaacgtgactgtcagaggagtgccacgatgacagacacattcacaacgctacggagttcggaggcatgtgtattagatttcacattgctgtgcgtgccctgtcgtgtgcgcattgtgtgaagattcaggcaccataatttagtgtgcagttgctagtacagaaacccaccgccggtcgcggcagaagttattctggttgtccgtttctctctcgaacggcgtaaaagagggaccgcaaaagaccttttccaaagagtgtcttaatatctctatatatcagtgcagtgatcgtccgtgcgcgccaatcaactcaaaaactcttcccctcctatgaacgcttcaatcgggagagcatttgaatcacctgcttgccgaacatcggtttgaacaatcgacactaggtatagcagaaagtctgccgaggcttgcacgatgtcggacgttctcttcgctttcgatgtcccgcgtgtagacgaaaccagatttctcttttcaatgccaggaagggcggcgtagcaacgattgttcgcgtccccacctcgccccacctgccccagcgagcccacgatgacatcggtgactcaaagtctgggatcaaacgggtaagaagcttccgttttgtttatgatttttcacgtatacgcaggtctaggaacggcgcaagagatttcatcacctcaaacgtggtacgtacaggcagagttccgtcaagtggccacctgaaatatgtggtgagacatcgtgtttatcaaagaatttcacttgtttatttgtttcggcttgtttgtggggtacggctgggcgtccctccatcctgttggtggttacgttgcatttggaacctttcagcttcagttgccaagtgtaacagaaaaacaaatcatagacagcccatccccgctgtgttcaattgctctggccttaacaaaaggctcttatctcgtcgttttctctgacagttagcgcgagctttgaaattacgatgtaggcgcaaatccggcaatgtaggctccatttgtgacattgca

SEQ ID NO: 3497 - DNA, 2108 bp, Toxoplasma gondii
tctttgttaggtatgcgccagttgacgcgtgaaaagcacttatgtagatggtcaggagacttttcaccgacagaaacgcatacttttgctgttggggatacatttgtccagaagtagattatctgtatacatttgcgcgtatagcttgccgcggggacgcgtgtctttctcgtacgaatccaagggagacattatccgtccggtagaacgctttcgccggggggcaccgcttttaaagactgtcaatcgagcttgcagagtgggaatgtatggcgacgaaaactgcctctgagagtacagctcatggcaagcgttggcggttctctatgaaactgagacagactacaccgccaggattccactcatccgaccaataggaacgacagaagatgtgactcttgaagctttttatagcgctggaggtattgtgtgactagcagcgatttctagataatgggcctccctttacgagagctacccacgaacgctaatgggtagtggaagtgtctttctacttttagaaggctattcgggggcgccgcaagagttattagttgtctggagaacacttcacatcctgattgaccacaatgggcggcaaagccattccccccagaactgacgcggtctcctattttggatcaccattagggaactctcttttggccggattttaagtacgcagtgggctaagcagagagaggaaactatcgctcctaactgaatcttgttcactattatctgagctgttattcccggcgtatcttacgaccgttgtacaatttggagatacaatttgacgtggatttttccacacagatagcgagggacaactacaactctgctagtatgatcagtatcatcgtactgggagtttgcaaacaggcttagaaccgaaacaacagtcaacccaaagcttgccttttgcacggcggtgcagcgaatagagcgttatagactgttctttttttgagtgattgttcggctactttgatgcagtgtcaaaggacatgttcacacgaagcatggcagtctgacagaattgattcgacagagatttccggaattccctgttgggacttcgcacgtttacgtgtttcaaacaacgaaattgggcgtgtcacactttactgggctggtgttttgcgccctcttgaagctctgcgctgcaaaagaagccccgcgtatcatcaagaaaaaattccgcgagaatatcgaaggcgtcccatgctgatattcagcagagtctgaatacgctcagccggctcgaagataaatatacggtatgataagcaaatatattcgaggtttatcgcatggttttcgtgtgctctaaggtcatccgcatcaccagcgttgcgtctgtgacctgctgtttgtagtagatcgaagtgggtttaacacacaacatgctgtatcctaggggtcgagaaaacgtagtttcgcgtgcttgatcagactagcccacttgcacatgaggcggacaatcacctagacagtgtcaggctacttttcctctggatctattttgtgcgtatggaaattctttgcttgggagacccaccaggggtcccccgtacgtaagacaaacttttatctgaaccctcttggtggttcccttgtatcttttgaggttgtcagatgtccggctcgcagccagacacgctgaaagcgttgcacttcggaatgaaagacaaagctttcctctacattcttcttcgaaggtgtatcgaaatcgccaaattcagtcttgctgtcgaagcaagcgtggaagggacgagggagcgcaccgtcacaaagttggctaggtggcagacttgcgctgcgctgccacgtctggggtatgttgcgagccaaaaatgcggatagggataggtgccttgctgccaaagaaaggatgctgagagagacagagggacaggggaagggaatcaacttctcttctgtggcgtgacaagagcttgtcagtgcctgtatcttccgagacgaaactgtgctgacgggtctatcacttcttgcttattccaggttcgcgcgttgcactgcatcacgccggttgtatatatatctctatcacaggtgacttgaatctctctgacttttcaaca

SEQ ID NO: 3498 - DNA, 4932 bp, Toxoplasma gondii
tggatatgtgtgtgtgcagttctgtgagattacctgcggactgtgtccccacgacgcagattctcggcaactggataaactgctgaagaccgacatctcggagttcgtcctgagagcagacaggcagacctagaacgcaaggagtcaatgtcgctccttcaaatgaacagcgcagtccttcccgaatttaggtctccacagtacacagtatcgacactcgagtgtgcacacacagacatggaactgtgcgaggaactatcggtattgagagggagggcggacgccgcgtgtaacaaagtgatacggagaagcgaaatgacgaggaactgcggatgaaacacagatgcaacagaaggcgttttctgtgcgtctccacccatttgcatcttgcgagacgaatcagcgactccatagaagatgcgagcctccagataccagagaaaatccagaaaatgcaggaatgcgaacgacacgggtccgtgcactccagtggacagacagccgaccacgccacacacagagttctgcacactggaagcagccattttggaccgcgtagaagcgccgttttccacccctccagacgagacacgacagaagcacgcatgacttcgcttgaacgcgcctctgaattggcgatacgcagcatttgatccacacggcgccgacatttgagtgtctacatctcgactgttggcggtcgcagcagttccggttcgctgaatggaacggtctgcatcgcggactggtcagatcaggagacaaccagagttatgtcgcaaaaagtggcttaccacgacgttaatgagtttcctcaactgttgatacatttgagactcgactttgacgccgtttgtcatggacttctccccgtcgccaggggccgagacggccggcggccgcgccgagacgtcctcgcgtttgccgtccatctgccgaagatttcggaggaaaacgcgtttttagagttgacacgtggctcaagacacaaaggcgaggaggcgggagagacttggcatccccgaaaggacgggttccggaaaaaatcgctagagacgtgaactgtagacctcccgaggaaaagtgtggaacactgcgggctgcaggatggaggtttctcgcacggtcgccggcgaaagtgtctgtctcttgtcttatctcgaaggcgattcggcgaaacgggctctcgggaattcgggggaagatactgacaaagacttctccgcaaacccgaaaagaaaagggcaaactcttgtctttcttagcaatgccaccgtcggccctaacgcgcgagcgagtcgtccagcacgacagaaacacgctcggagcccctggccacaggttttcgacgtagaaagtccgttcagatgggaatttgcggaattcttttctttcgttaatccgctggtggggggcgtccgcaaacgctctacaagccacacccacctagttgcaggaccccgtcgctagtcggtagcccactcgcggcacacttttctccccctttcgcatgttcgcggcgaagacggagcgtttcggagggaatgacagcaagcaaacagcggccttaggagcgaagagaactgaatatgtgactccgtcgcccaactcgaatagacagacatgaaagtgtcggttttgcaacacggacaaggactctatctagttgacacacagacgctactcagtccatcgaggagttctgactaccaccaccgcactactggactgcgtaaaatacgtagacagcggaaaacgatggagttttttcactatcttacgttaccttgattcttctccgttggttcctggaatcaaggagcttccaggacgacattgattggacggaactcgctggcttcgtcagcatcgccctgagtcggccgttcccagaaggcctggaaaaagggacgagcagtcttcctcccgtacagtgatacgggccgaaaaaaaacgtctgagtttctctcgctgttcaatacacgaggagcagcagtcctccacaaattaagccgaaaacgcagccggatgtggaggcaacgagcgtcacagatgcgtggagattccggaaaaaaagagtccagaaacctctccgcaaaagcggggtgactatgagtcggcgtgctctcttcgctgtcgcttggcggggcgaacaaagggcgttttaactgccgcttttccaatccagcgaggtatcgcctcttccttgtccccaatctgaaacgtgaactggaagaaagagtagtgtcctgtcggtggcactggacggcaaagcgtgaaagcgatcggcgggagagagttcttctgggccgagggaaacgactgtcacaaagtggaagacggagctaacgaatccactttttaagacgaaggtaaagtccatcggcaacgatggtatgccaaatgtggatgatgctccggcaagctgcaagaagtttactgtttaagtaaaggggaagaagagctggtcgttctgacgagttcagatagattgactagggaaaaggtgcctgcagtgtggcgttgccagtttttcgccagcgtatatttgcgtaaatatctgcgtgaagtcgaaaaacaggaatcagcgacacaagaagtctcacagtgtacccggggttcgtgtccagtcgcttccacccggtagtctctcaactcacacatataagcggtaaagacaagtacatcaggacttccgcgctgttataggtcggctgaataagaatccgcatccgtcgctttttcgcaggagagggattgctggtatcctgcgtggtaatagcaagagaagacgactcgtcaaatgttagaatgatccgggccaccgtactgggactagtcagtcgagacagggtgattcataaccttctggggagtcggcactgcgacttcgtttagagcttgacccgtagaacagcagggtcaacacagaaatctcgctaccagagagagggtggttgtgatgtttgcacgaaaaggtttgcatgagaaacgggacgatgggttggtcctgataatgccgcctgccccggttcctccgagaaagcgtatccggttctctttcggcagttctctctgattactggcacctcagtaatgcgtaggatgctgaactgaagacaatgttacgtgtactaaattccttccgacggctctacaccatggagccactggactgcctcagaacaaagctcaaagtgtcggatttcagtatcgtgtgagttgcatccgcggcagttcacttctttagcgtgttttcacacttcgtacctctttggattgcttgtgtattcacttcctgtctaaagaaaaacaagtcttcaacgaaactttcaacaaatcgccgcatgtgtcccgctagagtactcaagatttagtggaacctgaaacaacgggttttcgatccggtaaacaaagactttcaagatgtaagcccgtcgttcaactcgcaggatctacactgcccagaaaaagggagcttacataaactgcggaatctcattttaggaagtgtggctctgattttcctgcttctctgggatggcgagtccctatatgcccctgtcaactcgctacttgacgctgctgagttcacgggaaaaaacgtatggacgtttatgcttgacgaatgtcacatacatatacatgtgctgattcacttacatatatgcatatgtatatacctgtatgtatttacgtataacatacgtatatatatatatatatatatatatattcacaggatctttacactttctttcgtaggtggaatgtattctgccttcctgttcgcttgcctgcgatgcgcaggagttcatgatgtccacatgatgagatcgagggttctatgagtgtttgcaggaaatgtatgttcttgtaattcctattctaatagcgtctccagctcagcagcaacatgaatttttagccgcgtgtcgggtcccgttgaaggattgacccttctgcagcgacaaagtcccagaaagctctcccattctggtctgcttattcctctcccctctaaagaaagcgtttctctcgttctgtagaggcaactgttttcttctgacgaaaaggcgccaaagcgcacgacgggccacagggcgtcggcgtctcgccagcgctcgaagacatgtaagtaaatttcttccagagatactgtgtttttctggatgtttttctctccatagagcagccaggcactggaaaaagtgaaaggcgtttttcgatgcgtttccgcgaatttttgagacgacccacctgttcaacaacttgtgccttacacatacgcatgtgcgaccaagaagaggtaccgggacaccgactgtctgtgctctctggggttgagttctgaaaggcatcgtcacgtcagatgaaaggcgctagaacccccccaacaaagactggagttcaggacattttcatttctacgctttcaagtaccctccgagtcttacatcttctcgattctaccctctcgaagccggtcctgccggcggtacgctttccctagttcgccgtcgaaaagcggagcgttgttttctgggtgacgtggatgagattttggaacctccttctccgtcatgtctgcaaatcagtttgaaaggaagtttcctcgtctctcggccctgtcctgttgtgatgctgacgcccggaaaagtcgagtctcctcagcttctctcaaaaaaccgtcccggcggtgaccgttgactaggcgcggacatccggggaacgtgtcgattcatctgtgcgttgtctttcttttcgcttcattgtggccataaaagggcgccctttttcctcaactcttcggtcgcgcgactctgcggacgccgaaattcagttgactggaccggcgttttcgatcggaaaagaaatcgaaaagtcaagcgccgtcgcttcagcctacccagacagcctcgtcctcaaaga

SEQ ID NO: 3499 - DNA, 3927 bp, Toxoplasma gondii
cgtgacgagaacgcgtaaggaaattcccttctacgcgagcggcagacacgcgggaggaagccgcagttcgaacgatggattcttcttttttcactctgttgccgcattgttcccggaggagctacgcgtcagtgtcgatttcgtctgtgccgagtccaggggtttcctgtttttgtcctttgcttggatccactgagtttctgagttttttaggtagctcgccttagtcctgacccgtgtgattctccagatgttttcgtggttcaccctgcgcttcctccgcgaaaaccgtgaggcgaaggcgaacaacttttgctttctgtcgatgcgcgttcacggacgttggccagacggatacgtagaaaaaactccgacacgctcctagggtcttctacagggggctttccgcacatttaggaagatgccactgggtaaagatgtatcctctctgtccgcatgctgggacacaccttcagatccagtccccgggatgtcacttcatcgccacaaactccgatcgagacactgggttttgagagagcaatgtagaactacacgggtgatacgccgctgtacctgtgttggaagtgtaaaaaaccggagcagaaagagaaaggttgcattgatgggcatccatccaaatatggaagagaatctgcaactagaaaggctgcgtaaatcgctaatacacatgttgagagatatatagtgatgctaaaggaaacgcgtgcgaacattaacctgtcaactcgaggacacatttttttctgaggtgggaaaggcgaagagcctgcgccaactgtcaatgttgaagaaactggaaacatcacctagtctagtgactgcttcccttctgcttcgtactcgagtggacatcgtgcttgaaaaaggtgtcctcagcggttccgcgttcgagttgaggctttgttacggaatgttgagcaggttttctgcttgctttcaagttttgttcatcaagtcgatcagaacgcaaacgcgggtgcgataactcgctccgtacattggtaaggacttccgttgtcctcacaaaagttctgcgtgcgttctacgcccgtgcggttcctgtactgtgaccgctgctatgtgcggcgcgtgccgagacactctttagagtcaaactcttttttgcgatgcgctcccggtagtgatgtcgacaggggcgtacgctcccagcagtgaggagtttcgtacccaaaaaaggtattcgcgtggagcgtgtcgtcaatcgtggcggacaacgagtgtttggaggtggccgcacaagtgcagcggtgtcggctaggcacaggagggagagcgttagatcagcccaaagagtgcgtgttgctgcgttctggaaagctcgagaggcgctctgctcgcgaagcccggcagccctaacgatctacatacatgtcaggctaacaatgcatccctccagttactaaacaggtgctggcgaacgcgaattcgatccgtgaattccgcgcctgggaccatgaactattatatactgcacccgattgagcgtggactcacgcatgaaccagtatggtgcagccgtttcagtgtttcatcagcaaacgcaggcatggtcactttacacagatttttcctggttagctgtatcgacagagaggaaacttccgaagaaaaaggacttgccgtggacccaccacagagcaagcacagtgagcagcaaagcgaagagcacggattccacaatagtgaagacaagtggcgcgactccaaacggatattcgagaagcaccaaattgaacagaaacgggaggtgtatgtacaccgggtcgaacgaccgtcctctcttggctgcgcacacctcgacgataaaaccgtcgaaagaaccggggttttcttccggagttcgaccctccgcgccctcgactcctgcatccgaagaggtcggcttctctccattcgatttgtttggggaatccgccgagaaaaagaaaggaaccaacggtgtttcagcagttgcgctgtagagtgtcccgctgtcgcctgcggtgaacgtccacgggagcaccgcgtcgaggatcgcgcttgagacgtttcgaacggtccactttctagcaaaccgattccggaattcttgccactgggagctggctcccttctcgtgctggccggacgatgttacgttggcttctgccgctgtcccggacttgctcggaagaacgctggacggttcggagtcgaggaacggtccgcactcagaaccaaaccaagagacgagttgctgttgctgtgcagcggtcaaatcgaaattcgagcgttcctcttcattggctgcttcgcctccacctcttttctcattgtccgggttgtcactctgtcgcctcccctgacggcggcgttttccgctctcagcaccagcggctgctccaggagagcccggcagctctcgctcggacccgcctccctcgtcagcttgcccgtcatcttctacaattcttcgctgctgtgtgcctttggcatttctccggagttgctcgcgcactgacactgcagcagcccgacagatttctgcttttccatggactcgaacgcggaggtcatgcacgggcgcagctccgaggtgagactccttgaagccgtaccgcgccctgggagcgaggaagaaggcaggtagaggcaggaagacgcacgcttccggccgcaaaggcacattgtacagctggacgtctggaagcactcggggaagtggagacagcagagtccacaggtatgccgaaaccgacgaggaaaagaagggaggggccgcagagtcccccgacgaagccgcgtctacaggttctccggacatgcctcctctcgagacacgaaacaggtgacagagggggcaatcggacgcgggagagagattctcctgtaccccaagggaaggggccttcccgtcaatccatggcactgtccagaacggaatctgcaagactgtcggttctgcgtttcctgtgtcgagtccagcgacaactggaactgtctcgcgtggctcctcgccctctcgagggcaactggagacacgcagggagtctcgcgttttcttcggatctgcctcgagttcattccatccttcccgacacagaggtgcggcgtcagcctctgcacgcgcgtacacgaccggaaaagtcgaccagaaagagcaactcgccgcaagccgctcatctgtcccagcaggccctcgcgccactgcggagcgtccaagccaaaaggtcagggtagacgcagagaggaacaaagcgagcaggcaggccgatgaaggcggccggaccggacgcctgtttcctgcgtggatcgacgtcattgtacactggagcagaatctggaggaagagaggcgaaaaagctgaagatgcgaggcggacgaagccggcgaagcccgggagacggaagaaagggaaaagtggaagcgttccatcctctgggttcgcgagcgagagaaacagctagccccacggagcgtaagagagtgagaacagagagagcagcgagacggaacagcgaaaaaaatcacggacaaagacgacgcacgcgtcgatggttcgccggttttatacactcaaatagacggggacggctgaaccgctcactcagaacgcgagtagagagcgatacggagagaagacaaagttcagctgtgtggctgaggtgaaaatgtgtgttgcacgagacataacggggaaaggccaagcccccggagaactgctcgacagccggttgcccatgaggcgcataaagaatagaaccgtgtacccctgggattgccttcttatctttggtagagtgtatgtgtgtggcgagacgtaaaacaaaggaggctggtcgtctctgagatcgcttggtagctgagatgctccagagcctctggggaaggggggcgcagaggagaaagccagttgctggaaaa

SEQ ID NO: 3500 - DNA, 2795 bp, Toxoplasma gondii
cttcttgccagagcgtaacaacgctgctgttgcttcgctgaaaaatccaccgaggtcggcgtgagcttgtgtttcaggtttttttttcgaaagcggtgtgagcagcagaacagagggtctcctaggcttgcagcggtgagcactttctgctctatttcccgaatctcagatcagataatcacggaaattttttcctctcggtcttccatattcgcatgtatatttctcgtaccacttttactttgggaaagacatgccttctctcttaggcgtgttctcagagatctgacagaaacaacttttggagcaagcccctgatttcctctgcctctttctctaggtttgcctctgtgatgtaactccgaaaaaacaggtagtttgtggggaacacgtacaatggacgcagcaaaacggtccatccgcaaatgtgcatctcaaaagacagatctggatctacttcactcagagatcgcaattgctggaaggcgatcttcatcgtagatggagcgctatgtgacaaggacatgaaaaagacgaggacacgcgtggcatggcgcctgttgagtcactcgaggaacgctttccactcccggtatgtacggtcgatgcgagactatgcttgataaccgctactgctcgaagtatgcattacctcctctcggcagcactgtcaagcctcctcttcgtgtggttctcaaggcaggactaaggtcccccggctctttgttgcgttgttgtctgtgctgtcggcgacaatctgcgcactgacacttttttcccacttgttttcccccgggagcctggcaccgctttctcctgcagtgacaacgtcgtgtggtacggcaggagaatctgttgctcgcggtcagtaaaaaacaagagagtctctcccattgtccatatgcgcgtggcgtcgctcattctaaggtgacagtgtgtcgtcacattgtgtcggcgttctcccgtgcatccaccacgttgacgactcctgaagtcgcctcacaatggcttgcgagtgcagtgcttggaatgtcgatgaggagaaaacacttcctcgagcaacatttgatacctaccacccaagacacttttttccataccgcagaaacgaagtcgagacgaaccaaagaatctgcggtgtctgtcttaagttccttgtcgtccacttgaacgcaggtgaaaccgcgtcacagagaggacgtcaaagcttcggtttgcagagcggcggccggaaatgcacagaaacgacagagactccgacttcaacggtgaccgggactcgtgtcgaccctttttctcgagagtttgcaccacgcgtttgtagactgttggttttggtcttgattgactgtcgctgctgtttgccagtcctatgttgtatcgtgtgtcgcttctagagcacgtcagaactccgtcaacttgcagtcgggaccctttcgtcctgtttcaggagagatgtggaccacgatgaaactctgtctttgagcaagtgaactgtgtagcgtcgtggtcgctcctctctctgctgttcgacggaacacgcttctcgacaacagggttcttcaacttaaacgggagagtgtcgcgcagttcacacaccgcgccgaaagtacacgaatctccacgcctgtgcatgtggaggagaaacgaacttggatttcaggcgttcagcgacgaaaatagaaggcgcggaagacaagcgcattttcgcggtctgcacgtgacttttgtaccagcgcaggttgcctggcaaagagcgctgcgactttttcacactgtcctctccctctctgcgagttaggcgcacagaagcaatagaggacctccgaaattcgtattttctccgttcagctttgaaaagagtcgagctgcgtgcgcagacaacttttctggcgacgtctagggaactctgcgtcggtcgtgtccgactctccttcacccttcagacctctcgtgtgtctcccgcgagttggagaaaactctccaggtggaggatcttcgctggggaccgctttttctcttatgcgctgtggctgtagctcgtgtatttcgccagtctctcgcttccttcatcgtgccactgtcttcgaattttctctgtcctctcccattcccgaattccccgggggtggactctgtgtgccctgatcttccgcatcagcctgggtcgggtctgatcgtacacatccgctttttctccaccgtttcccgcggcgttttctcggaaaaacgcatagtcactttgcttcttcggtgcgcggcaccgacgtctccagtcttgtgtttcgcttcgttccgtcgcttcgtttgcctctctccgcgttcggacccccttcaagacagagcaggcgtctgtccgcgacgtctctcgctgctgcgggttccccattgccggtgaaacgtgtaggttttcctctctgctcgcggctttggaggctgaaacaaatagctgacacagacggagagcgtcaacgggaaaaacgacgccgaaggaggccgtgcttcccgactcgcgccctgcgcccgagacaagcgggtgttgactccggcgttccgtcacacacaccgcaatctcctgacactttggtgatcgttcctcgcggccaacagggaagaaaaaagagatccgcagaaggccaacagttttggaaggtcctccacagccctccagaacgacagccattgcttttcccggacctttcgccctcgaagtttccgtcggcgtcggctgcgggagtcgacccagcgcgcattgtctgtatacccgaaccaaagtgcccttactttcttcacca

SEQ ID NO: 3501 - DNA, 2875 bp, Toxoplasma gondii
cttgcgacttcttcctctcttgcttcatcttcggcattcgccgttttgcccgccgcaaagatgggagccatgcgagaagtctcttccctcgtgcgtcgccgagagactccagaggagctttcgctgcacgcagactggcgaggctctctctggacttctcctcccgtttctccagactgtctgggcgcatgtagactctgcgcggtccaccctgccggcgaggcactgccgagaggaaaagaggaaggagggagagacggcgaagacggagccatggagagatgctctccagaaaagaacgcaggaggaaacgaggaggcatgcagagacggtgacgcagacgacgagagagaggaaaacgaagacgaggaaagggaagggagaagagaatttgacacagacggggaagagaaagaatgctgaaaagctccaagaagaggtgcggcaacggaggacgagctcgcgctgggaagcggaacaggagacgacgagagggaggacgaatgcgaatggccgttgaacggcaaatgagaagaggcgaatgggccgtggaggcgagacgctgtaaatgtccccgatgctccccaagtcgatcctggagaagaacctccgaggctctgcgagctggtcccaggaacaggcggcgtgtctgcctccatgatgcctcacttgagcgaacgctgaggacgggggaaatggacagaagcacagcaggggaagttgagagagaatgggagaaaacgagggggaaaccggtttaaacgcactccgagaggaagagaaagttagcaaaaaccgcgcgccaatctgcaaatgcaaagaacgtgaaaaacacaaagaaagaaaagtggaccctcccgtgtccgccggtgtcgccttttacgcagcgccgtcgagtgtgtgtacacttggagcgtgagctgcgatcagcatcgcagtgtggacgcactctcgctttccctgtcctttcccaacgtccctcaatagggtcacggaacagtatttttccccttccgacaaaatcacttgtggtggaaaacggtatttcttcctctgagagaggacggtggcgacgagacacgcgagccgaaccaggcgcgaacgcaccagtcgcgctttttatgggggccgacgaggaaggaagagatccgtcaaacggagcctcgacaagcacggaaaaaaagttagccgcttgagtctcgaaacatagctcgtttgggtcttgcggagacatggagaacctcttttgccagaccacgtagcggcaaccgaggcggccggtctctggcaaggccctctttttcgttggtaccactttgctgcctaagaaagtttttaccttatgctgcttagaggtcaacttctagaaaaactctctttcccgcctcatgcaagggcttcgctgtcggtcgtctgacagcgcggcaacttcgcgcgacaaattcacacaggcgagaaccgcagagagacataacttgcaggttgattcactcgagatgccttttacgaagaaaagaagctcgaaaggcaaagcggaagccgacatgcagtcgaggaaagatcctagaattccgtcgagcctcgagctccagcaggcaagtgaccagacagaaggcgtttttgcacgcgctgcgcggagactggcgctgtacgagagtggagtaattcggttcataatttgtgttgtacacgggagccactgcgactgaagatcgatggacaaaggaacttcaaattccacgtcgtttccccctcaagtggcgctggtacggaatacggaacggaagatatcgcaacttaaacagagaacggtcgggaggaatctcgctgactgttcccgtcgtagtaaaaagggcacatgtacaaatgatccgcgaaccagaactgctttgtccaggttcctcgttgttacacaagggcctaggttccttattgcgacacaacaagtcgccgcgacgctgagagtttctagttgatgggaatcacaaaactgtcaaggttcgtattggactgtctgctaacgctcctgtgtgtcgcggaaatacgtcgggcacacgcacatacgcacttttgttttccgaggaaagcaggaaaggaaagcgtttttgcgcgagggcagttgcgctaacgcaagaaagcgggactttcaggtttccttgttggttctcgggcaaacaactccgccgaagtcaagcaatccgtaggtctttgcatgcgtcgttgtgtcgtctctcttgaaagggccgaaacttgggtttccaacggttgaaaaggcgaggatttcgcaaattctgagatcggaggctaagctgtgtacgagaccacttcaaatactggaaacacaggtcaaagttgaccatttccggacgtcctttccggtgtgctccctcgactgccggcctcctcgggggagggggggggcgggcaaacgagacgaggagaggtttctttttttggagaacactgggtggatagagtagaaaagtagctcggtcgacagatccagtgtcttcgcagtgtggccatctttgaatcaatccatgccagatgaaaagccagtggtcgggggagggagcaggaaagtcgctgccttggcgcaaacgcgcaggtaggagagagcgacctaggtgacctttgaagccctttgaactataatgtctctgtttatttgatttgagttatactaatgtgaacacagagctgtggcttgtctttcctcgcagagtccgcttctcagagaagtccgagcaccacgtcgacttcgtcggagtctcgcggccgccgcctctcctgacacaagcgtccaccgtcaacctctcgtctttttcgttccttctcgtgtgaattcttccttatccccttcagagaatcaaga

SEQ ID NO: 3502 - DNA, 1685 bp, Toxoplasma gondii
acaatcaggtggtctctcgtggcatttgtgaggttgggcattatatctgtgaagtaaggtacaacagtcccagcaaaattgaggagaaaagtggtatttgggactgccggagaaaactgcgttactgcctccccttactttgtatgcattcaatgatgggggggcggtgtaaccgggcatataccgcctgagatccgctctggaagaggcaggaggcctgaacaagcatatcacaaagcaagtagcgcacagacgcacagtcatcggactcactaggttagcgaggcatgctgtttgcgtgttgggtcagggtttctgtcgttggtgctacgggcacgcttgtaggctgctggcgttctgcttacacagcatgatgcggcccctcaaccgcacacagtgctgtgctggaaatctttcaatcaccgtgaccacggaataccattttgaacgtgcgtatcttcacgcgtggctgctggcgatgtcgccgttttcgccctactttccctcgtccttcctcatgacccaccgagaaagtgtggatcagtgtgtgctaagacttactctccacctacgcctcgaatgtgtttatttgcactcctatagaaggaggaacaaagctcatcgtcacctcgggccagctgcagtaggacatcgcgcacgcataggggagtgcacacggattttcaggcgactgatattagtccaacatgcttgaatctaaatgcatctggagcgctgcaaaacgtaatatgcatctattggggtgttcgatctccttatgaaatgtgactcattaggtgtccacctcatcccgaagcctgctccgcagccacaaagggcaacagactattcagaagttatgcgaatttcctgcagcctcagcactaaattcctcttacgagaagaagacacgaggacgccatcgcaaaagaatataagaatgtttgtatcggagtcgtcgacgtaggcggcccaaacgactcatcatacgcgtgttaaccacttcacgtcgttgcactcaccatcgcgaggaatggttggcacccggttgagaaaacaggtacttatccgcccgaagatctaccagaatatggagaaagtactagatttcccaggtatcaaggtcaccttcctgcatcaagcgcacttcacagaataaataggggcgatgctccgctagctgcggccaaaagccatttatcggtttgaaggacggtggctgttcccggtaaaaggcagattgtattggtccggacgagtttcgtggaaccacggttcccgaaaatctgtaataggccagcaagccatgagcaaaatgggtagatgggcaattgctgctttaatattcttcgccctctctctctcaaagagcatcgacacgctagcacctttgaaccgcgtggcgcacccgtggcactccaccagttggttaaggtccaagggtgccatgtcagcgtagttaagcgaaaacaagcataagtgtgtgtttggcagccttttctcgccctgtgtgtcgagtagtattatgcgcagcagattttatactgataattattggcatgtcaagtgactctgaggtttttctcatcacgaaacatgggaaccaacgcgttgggtgccgggcgtctccggtgaggtaacgccagtttaacagcggaacgtcattctcgcagtgtctcgtcgaa

SEQ ID NO: 3503 - DNA, 4014 bp, Toxoplasma gondii
tttcatacataggtgaagactcttctgcatttacaggcggcgtgtgaggagacagtgagacaatcaggtctgggaaaatgatcgcgtgtggacgcacataaaccgaggctcacggtgcatgcacgcatgcaggggaaaatccgtgtacacatgcctgcgctgttgtcggagtatcttggttttctcttgggtcaatctatgatactgtcagtcacacgcctagggaagtgtacaagaatagagcgctttgccggagttttttatttacctcacatttttgcagataatagtgacaacggaaagtgctgtctcttgtattgacgcatgtatgactgccttttcattctgcgttgtgtcagatgcacgaagggcgccgtgtcggaccaggggcttccaagttcatcattcggacagatgttctgtacaggcgaaaagtaaggttcttttatccatcatgtgtcttcactggcgaatggcgggaatcatttgatggattcttttgacccatgccgaagctatgatacttgatttttgcgaatgctacgtcaacgtcgtctgctggctacctgtagcctcaatacaattcattcggtcgcttaaagaaagggtgttgtggacgcgtttccgtcattccgacaagttgtgtttccaaaggttccccccttctctgtcacctttgttttacataaaataggtgatgggggttacagagtcggctatttttgtgaggtcggcatgcgccatcgtctaaccttcgtacgcgtgttcttccgatttcctgtctgcgcagatacctcttttgactacgccgaaagatcaggaggcatttgcactgtggcagcgggcagagctgcttgcggaagagggccaggcagacgaggccgccgtcctctttagaaaaagtatcaagctttcccccgacttggctgccatctacggaatggcgtaactgacagcatactgaacacgattcagtttctcccgcgatttgccgaggaaggcaacaaaaaatagcggggtggctctcccctgtttaccttttcgtagcgagttgaaccactccccttctgaatgcagtatgaaacccccgacctacgaaattcacggagaacaaaaacgtgactagcagggtgttttgtggagaaacgttttgggaatgccctggaactgaacaaggaaaaagctttagtgcccgtcaatgtaactaaaggtgtcgactttcgctgccacacatgcctagagcagcgaggctgcgaatgcagacagaacattggtgaataccgcttctttcgacttgcaggcgagaacccgaggcaagagagagatataggtatcgaggttgtggaaaagtgcacactcggtcggtttttgctttactcagtgaggacctatctcccagaagtggcaaagcgaaacactgacaaatgccatgcgtcacgaagtcatgtcaaaaacaaaatcccccgtgccgcgtccaggtatcgagtaacacgcaaattttctagtccaaccgtggaaaaagagtaatggtcttcaaaagtgatgttgtttctctcgctgcagtgcttggttagcgttcggaacgatcgcgtcaggttcttgctttcttcgtgggaaatgttcgatatcccaatggcgactggcagagagcgggcaaacggagggttgagggtgcagctggtaaagttcacatcacatcttgagaggaggacggttcagaaaaatcatttttgaggctcgtaaaacatataagaagcccatgtgcaccggctgtgtgttgcctcactcacccttaacgtgtatatggaaacagcgatgccgtgatctttaacgacgacgcgttggggaactgcagaaaacctcaaacgcatacagcggaagtaggatgttcctccattgctcaaatgagatgaaactggtagttttcagggtacgcaattgttgccctgggctattagtttcagtttgactctgtttgcgaaggacagactgagctgaaaactagtgcgacaaagaaccgcgtttgttggtcgttcagtgttcttctaaatgggatgtgtcagctgacgggacgtcatccacgaaaacccgacaatcttgaggtggcggtaaaggctaggagctctggtgctatcactctttgtatgggcagcctctctagttgctggatgatacagaagcacaggaatctggcagtcaccagggactgctgagctgcagttggtaaggccgagtggtcacacggtgcgcacgtgaatggggcaatttgaaggattatgcacgcattcaagcggggactgaataatcttgcttggcattcagcggtagatccaacgtaaaaaaagggctagatgctttccgcattttcggggcacgccacaagtcagacagtagaattcggccagtccacttcgtttggtttcgaacatcaggacattgttgcctcatctcttcccgagaaccttgccgtggggcgacagtgaaacttgatgctgtcacttgcatcgtgagtaaggcaggtccggttcctcgcattcttcaggaagcttctgtaccggcttccggaggggcagcagcaagcgtcggttccgcttgtaactgagacgagagatagtcaaggattacagcaatacacttgacaacaagggggtaatagcgaacgaagtttccgcatctggagagtcgattcgcggacttcctctgcgtccagtattatagaaggtttgtagacgaatgtgtgtttcgaaggccacagcttgaaatatgtcatgcggtttctgtgtttagttttacactctgagtagacaacaaccagtgtgaaataggaatttccgaagggcattcagtgagcttccagccccgttctaatctcagtttttggctagaaggacatctctaggtatggccactccagccgtccattactccttccgactgtgagcgatccggcacatttaaggaacccttgtctgatgcacgctcagcgtctgtcaagtactctgccgtttgtgctagcaaccgacaatgggaaaagatgcgtttcgttgttactgtagcgcgtcgtgccctgggagatacaacaacagaatagtgtcgcagtgagtcgtggcttttcacgttagcataacaccgactcggcgtcgcggggccacaggacgcagcctgacgctccctttggacttgtaggaatgacgtttcaaaaagagcaggcaaagcttacgtataaatccgtcgcgtttcttagatctttgtgcttctatccagaagaatcccagtcacttttagctggtctcaaactgtttagcctagctgtagatggcagtatgtccatgcatctagcggaatcgctttggggcttctgttggggctgaaaggtcttagcgtgcagtttctctggccagtacgagaggcaaccgcggtctaaaaactgaagagaggatgaggagtttgcattacctagggtggaacaagctttcgaagcgtgtgacacgcgtcgataaacgtagcggtgacagaagctggcgcctccgaagacgcgaagtgccaaacctatctctttaagtttctgtcagtctccggcctcacttcgtcggaggcctggagagttcaagatttaggaaaaagcggcctcaccgatgatagacagagggtaaggggcaactgtttccaagcttttccagacacacggacggaacaataaagtaaagtaactggtgcaaagagttttgaaatcgcttccctctccgcagtgacttgcgtgtgtctgtatcgcattgtttcgccatctgaagagcacgggttaccagcatcgatcagaaagaccgttttggcgttgttccaccacgaattcgttctcactcgctccacacggcagcgttcctctgtcttattcgttagctgcttgggggcttctctctacggcggagcgcccgaacgccctgcataccctgccgcagtatcatggcctctcaataatcgacgcagcgaaagagagccttgccacggcttcaatca

SEQ ID NO: 3504 - DNA, 754 bp, Toxoplasma gondii
gttccgtattatggtagcctttacggttttgcggcattgccttcatggcgcctcacgcgtcacctcatacagagaagatggtaggcgatggccagaatcacgtgttttcagagtcgctattgcactttggtgtgcgggcagtcggatgacacggagaagtgggaccggtcaaacgcctaaaactaaataactgagttaattaatacagggttgaactatgtgagtatcattgtcttatggttccaccgcttcacagttggcactatgcgcctggttagagcaggtggcggtcccctgacgctctctgggtcccgttgctagagcagttccacccgcagcagaatgtaaagcacgattgctggtagtcgtgtgtacagtatctggaattcgggggccggctaggttcctcagtgagtgtctacgagctttctttcgctctgtgcgcttcaaaacactgtggtgagctggtcgtcggtataaaagtgcagtaagaaaagtggcagcttgagcaacattgtggcaaaggtcgaagcagcaatcgcaaatgtcagtcgtatttggatgtgtggcaaaacccgacggatgctggtccaagaaaagaaggaacacaggggagggtaccacgttgcacaatgggcaccataccgtttagagagatccacagaggcagctgaagcactccgtgctcgatcgctagagcctgtatgtgagtagctgttcacaactctgcaatcgaaagggggttggtgaagaa

SEQ ID NO: 3505 - DNA, 2678 bp, Toxoplasma gondii
tgtttgtctcaggcgcatcccatgccaattgtcatctctgcctctccgtcttccgcgaccctctgtatgtcccctccttcttcagccttctccacatttctctctgtgcccctctcgcttaccctcttcggcttgaggtgcggctgcgtcgggtgtctatacagtccagcggcttcgaaggcgcctgctctgtcggcgtctgtgccctctggcgcgcgcgacttggtcccttccgacgcctttcccttctcgccttctcgcttgctgagccgcgcttgctgcatgcggtggagagccaactcgggcagcacgttggagacgatgtcgaagtcttccgccggcaggtgctgaaacagggagaagggcgcactcgcctggcctttgccggctgtacgtacacccgagccacctaccacaggcggcgcggccaacggtgggaccgcgaggaggttcggataccccttggggttgatcaggttcggcagaatgcccgcaacgtcgaattcttggaggagctgaagagaggcgacgacgtcgaagacatttgcacccgtttcctcgccgacctcctcgagagggatcgagtgccccccccctgccgcccccagctgccgagtcaggtgccgggtctccttcgacgcggcgtcctgtgcaggcggctttccgcaaatggcctcacggctgaagggatacgcacaaaacttcggcgcgagagggattcgcggcagaggtacttgaaaagaaggcgagtaaagatacagagattttgtttgcaagtaagcgagagagccgctcgggcggaagttgcgcgagggaacaaaggcgagacgccggccagacggccggtcttctccggcgccagcgccggtcgcctgactcgcaggccttcctgtctgcctcatgctggacaggctaaacgacgtcgcgcaaaatcccagaggacaactacaaaaaagcggaaatcaactgcgaggcgacttcaagaggggttgagactgtcaggggacggaagagacgacgggcgaaacacaagcgtggacaaaccggagggcgacggcacactaactgaaagacagaaaaacctaccagaggaaggaataacgaaacaaacgacggaggcgaaagggagtatgaggtaaagaaaagagaacgagtagttgagacaattgcgcgcgcatgcacgacggagaaacctgtggcggaaaatcgacgggttgtctggacagcagatccgagaaaattctgagtctgctccgtttcaatccatcaactaacggatttctaaagagcatgtattgggcatgttcacgtttctgtcgacgggagagaaaacatgacgctgaaacgcctgttcgggcgtcactcctagtcgccccgaccttgagaggctacctaacatccagttcctatctttgggttgacgatttagcgtaaaaggcatgtctgcgtgccttctctaccgttacgcgggaaacaaattcgcgcgaagatacctgtttgaaggtctcgcgtttcttgcctgtctttgcgacctgtgagagagtaggcttcttaaccggccgtcggggctgcatgccctccttcagagttgtggcgcttcggacgcgcgtcggcttatatacgaatttcgcgttttggggccggtgtgcctgcggcgcgttgctgactcatccggctttctcggtgaacttgagtgacgggacaggaaacggtctggttgcttccttttacggcttctcagcgttttcctttccggatgaagcgcctttttgtgcccagctgaacgccgacaaccgtcgactttcgccggaaaaaccaaccgcgcgtgtctctcctgcgaacgcttgttcttgacgcgagtgctgagaggtaaggcaacagacagcaacatgacaggacgaaagcatctgcaaatcggggagtttgtggctttttcagcgttgccataatatacaggagtgtagccagctggtccagacgacaagtgcgcctggtatcgtcgaaagtcaacgttcgagggaatcgcctgccgttgagccgctgtttgccgttgagacacacacactttcaacctcacgctgtccgttttgtttcgcgctagcatcaagttaggtaacactcgcaacgactgctgctggacggaaagccgccaagacaactggcgtgagcattgagacagttggcggaaagagcgaagagcctgccaaaaaatccacagtttttaagtggcgcggtttagtgttctcagaggtacagccgttcttgtgtggccagtgaagagagaccgtggcgcaagcgtttcctctttgttgctcacatggtcgtttgtttgatttgcaattctgcgcttccttggcttcttgatgtttcccgtttgtttcaggctggtcttgtggcaccaagcgcggacgccgtgctttcgctctcctgtcagaaacagagaaacagacacttccagaatctcgtaggattctggcatccaaactctctttttgaatggggtcgtgagtttttttttcggtgtctgtcaacggcacgcgcggcaacgtgacttgttctaggccctccatacatccttcctcccttgcttttacggacggcgaaaacccagaggttttgcgtcttcaaaaacaagattgacggaatatcagtcctgcaccatcagctttttttcacca

SEQ ID NO: 3506 - DNA, 1992 bp, Toxoplasma gondii
agtgaacagcaggaaggctgtaacgtttctgactttgacatgcacagacggatgatttccaaattagcagcagagaaaagtctcactgtttacaccaaatccccgtccagctatgtacatatacagtaatatatatatatatatatatacatatatatatatatatatatataaacatatatgagatatcactgtatgcaagcagatgaggtctcttctgtatccacatacagatctgtatacacatgcagaactatgcccgcatgtaggcgtttgcgtctttggaggcgaggctaacaagacagaggaagggaggggagacagagccacagcttgagagggcggaagggcagagagagaaacgcatgaaacgagaaaaacgaggcgagctgttcccccgcgagaaggaaagaaacgcgtactccgcattcattttttccggtgttcttctctggcccaggcgaggaatgtccggaagcctgcatgcagagcagcgcctgcccgcgcagcgaggaggagacctcaaaacaaagaggatctgacgggagaggaagctggggaagagcaggaaaaaacgcaacggggagaagaagctccaacagagcggaggaagacgacacagagagcggaaggactcgagaggcgccgagcgcgcgcgcgagagagagaaaagagaaacgacaagatgcaaggcagaaatacagggataaaagtgcagtggtgggcaagcgaggaaggaaagaaaccttgcagatgagatgcgaggacgagaagcagcgttggtcgccgtgaacaacacgataaatgcgaggcgagagaaaagactacagagccttcttaagagaagaaatcccttggaaactccacagttccttcatctctttcacagacacctcagcatttgcgaagacgagaaaaagacattttcgcgatttttcaagacgacgctggcgagatcggcggcatctccagagacccccgcaaagcgtcttgagcctttcctttcttctctcgttctgctctgttctccggcgatctgtctgcctctccgcctcccaaatctctgctctagctaacgcaaagagaagaactctcgccagatgtgcagacacacctttcagagaaacagggagagaaaagagagagaaaaaagagagagaaaaaagagagaaaaaagagagaaaagagagaagagcgcggactggcgagaggccctgtcactttgcgcagcggcgcagcgcggggcgtcaagaaatcgcgcatgcagcgacttcttgacgtccgcgttgcatgcttcgcctcaatttctctctgttttcaccgctccttctccttctcatcttccgctgagcggctttaaaacagtgtacgcaaacaacaatcagaaaattcgaaacaattgcagagagaaaagacaagagggcgcgactcaagctgcgtcatgcgggagtcgaacgtcacagagccttgacctctctcattggagacacggtctctcaacttgctgtccgcgacaagaaaagattcaaaaccgtctttccccatcctctcccttcttcgcatgcaccagctctttctcgcgtcctcttccgcgcctctctccacggctgttcttcttctttttccgcgcgacttgcgccctcccaggaactccccgcggcctccggcaaaaagtgaagcgtgagcaagaatttgaaaccttttgactcttttggccttccacgataaccgtcttgctgtttgtctcgcgttccagaggacgaggagagcgtttcaaggcctgcgcaagaagctcgtgagcgcgagagagctcgtccgtcccccgcgcggcgaagagagagaccttgaagatttctgtgcttttgacacacgccgcagaccttttctcggaatttgccaacggagttcttcgtctctcttcttttggagtctcttctcagaggtttcaccttgccctccttcgctctctctgctcacacaccgcacgaacca

SEQ ID NO: 3507 - DNA, 3115 bp, Toxoplasma gondii
aggatttccacgctgtcgaaaattccgtctccgctgccctctttctctgggcctcgaatgccagccagaagtgcactctgctgttccagccattgctgcgggggaaggtctgtgggtgggaagaggaagaggaagttggctttcacgactgaaaaccggacttgactcttttccagcactggaagaaactccgtgagaaacccgcggtgctgagtggccctcgctgccagacgcttgccctgatcggaagaagagacacaaacttctgcctgaggaagcgaggactccggaagacccgtcgaggcagccgagcattttgaagcgtcgcacgctccaggggcgtcgcatgcaaagaggccaggaggccacgctcctgggggagaagaaagcaggaacgctcgaaattgattggggtcaatcctcatcgtgtcgacagcgcgtgagagaggaaagaagcggactttatcgacgtttttcctggacttcttgagtcagccaagagacaatggtcgtcgaacgagagaaaaaaaccaagccaagagatgaactgaagactgggggagctgcctcagagcacacggaatgcagcgagtggccgtctcgccgccggcactgacacccgcggaacgaaaactcacgtgtgacagggcaagcaaagacgcggttcgtttctctgaactgagtatcaaacagctggaacctcagaagagctgaaaacccagagagcctcgtgaggagcaggaaaagaagctcgacttttccagggcggggatacaccagacaggcggacaagacaccagatgatgcatcacggcctaccctgtcgatcgagcacccgcgcgactttttctgccgcgtggtggaactcgacgcgagactggtggccagaaaggcagccctcgtcagcaggaagacaggatttccagacgcaaatctgcaacctcaaaaggggcttgccggcatggcaaaattaagcttttcgcgtgccaactctggaaagtttattcaggtagaccgcaacggggaagcagacaagctagagatcgcagactggtggccaggagacgagtggcaggagtcacacacgggttgcagctacagggaactcggaagcgccatactcttacacatggtggccatgaacagctccacagaacatggatcctggaagaaaggcactcatacgaaactcaggcgtctgtgtctcgctagcccgaacctgcggcagagaattacatcttggatggcggtacattagcggcgaagtcgcacctctttcgcgggaatctagccactctcagccgtcggcatcagcacccgacgaactactggaaacgaagactccccataatgaccgtggcttccacaggagagtgcgtaaagagcacaggaagaaacggcaggagactctcttttacattggataagcataacagacaaagaagagacttgaaaggcgcacctaccccaccatggtcaacagagccgcgccgttcgccgattgacccgcggtagcgcgtgtgaggggctcggtcgtggcgtggagggggtttgcgtggaatccggaaaaccaagaacatcgggactcagagaggggcacgctggacgaactccctgtaaacaatgagaaacgagtaggaaggaagagcccttttcgacatcgtccgcaggtctgcaagctcgattgccggcaagggttgcatgcagtccagaaaccgcaccgcgagttgacagcgctctcccgtctagccgatatggctacctctgacgaagccagacatcgagacttctgcgtgaagggcactttccattcagcctcatgtagatggagatttgcgggttccctcgaaaagcattagctaacatcgggagtccacggttctgggtagaaaattcgaggcaaaaaatcgctgcaactgtccagcaaagagtcaaaacggcgccgccgccttcgagctgccttgcaaccagtacgacagtttggtagctcggacaaagacgttctttgcgcacgagacacagtcgcaatgccacactggtgtcgacaacgcgaggaccagttacttttctgtttacgcagtagtcagtttttgcgtagggagcagccgctgcctttgtttttcataaaatctgttggagctcgccagtatttcggaaattatacacgtttcaaatctggacacccggcactggcggcaggggaacctcgtttctcgagagacgacggcgtatcgtgtcaagaaggacagtttttccttcctgcaaaaggttacgctttcctcattcttctgccgcaaaatcatttgacactttcccactggccgtaggctgttctggagggttcgcgttttcagcggagttcctgtcggtcgtggtgcgatatctgcacgggaagcccctgtggtttctctaaatccggttcggagagaaacggccgcaaaaggcgaagacaagaatcgaggaacagcaaagacccggcgcaaatccggaatagggtgcgtagagcacaacgcgtcgcgaacctaaacgcgtttctgtgtgccacccgctgaaagtcagtgacttgtgtcgatttcttgcttgggtcttgcgaaatggatgtaaacacacagattcatttatataagtatttaattacaccttcttcaaggtgtgagggaggtgattgccacgtgtctttatccgcctgctgttcccagatgttttgtcggtgacgccttttctcgtcgacatttggcctgtcggccaccgactccggaaacgcgttcttcactccccgttctctgttccagtcttcactggcggcaagagttttttgtgtcggtgacacgcggtaacttccctgaaaacgctggcctccgtgctcgtgtttcgtccgtgggatttccccttcgttccgatttcgagcttcccccactgggcacaagcactgcgtgtatttatttgcttttccctccgcccgcctctgacagaggtcttgattcgtgttgatgggagcacaattgcccgaatatccagtccagtgctctgccgtgggcactgaaactgatccacaattcaacaggctttttcctctgccttctatcgcgcgattctcacagccgaactttgagaa

SEQ ID NO: 3508 - DNA, 3071 bp, Toxoplasma gondii
ctgcgcagagacgttctcaatgctcttgacttcagagacatacgaattttctgtctccccgtttggatgtatgcggccgttgtgctcgttttaaactactagatcaaccgtacctcaccgggttgtggttgaagggtgctttttaaggctttcaagggagttcgacagcggcggctctcatctgtatttgacgggcatcgtaatgaccatttttctgtttagattcatgctgctccgtggcaaacgtttctctttcaacctctgccacgcgctgaactgtagagatataccctccgcccacgcgtgtctagaggggtcttctctttatcagaacacagccggaaggacacctttgaagcgacccccgtaaagctgttctgcgcccagatcctctcttaacggccaaggtgcacgcacgggagtgattcctacagtcatatcacggacagcgaaccagaagtccgtgacaggcggtattcaaaaccgactgcaactccagccgacggttttgggtcggcgtcaagccacacacttacaggatccccttttggatgagaaacacggcagattttgacaaacggccaggaaacctgcctccccgtccgcaccacggggagaaagagacacgacgtggcggccggtctttgttttcttgtgagtagaatactcttggcggctctgctgcgtttcgcttcaagatatccgattgctatagttacaacgaacacttcctcgggggaagagagtcacattcttgatatttgaacatctgcctcgagatcacctgcagttcctctacgacaagcactgcccccgcgagtacattccaacagttcatttcttgtcaacgggaagaagccacacttgaatctgctgcctgtcaggccactgtcctgagacacgtttcgcacttcaacaacacacactcgaaacgtgaacatggtttatggagacccccgcggcattcaagttgcctgtgggtatcatgctacaggactcaggaagatgacgcctcctcgctgttcttttggaatctaagtgtcacagaactcatagaggaagcgagagttttcgtatcctgtgtgacgtagcccaaccggacagaatcacacacggcttctctctctttcacccttggccccgctcgcgtgtctgtctttccacaaacgtgtgttcttgactcctcatcgctaaaaggccttccgccctgtttattcgaaagcccgctgcttctcgaggatctttctacttgacagaaaaaacaaacagtcagctgtacatacacatacggacaacgtctttcttcgaaacctctgcagtaggagcagcagtatctcgagttaatatttctgcctgaccggggtggagtctgtggaacctttttcctcttgtcgcaatgcccacgtttcctctcgtctgtctcccagatcaccgtctcgactgtaaacggctgcgattctgtcgtgttttatcaggaaacacgtttttttttcgcaaggctgccagtcccacctctgtggtctcttgagcgaaaacgaagaaattcgccacacatcttgttttcgaagcgttgccccctaacgcaaaacttttgtaagagtgttcctccgctcgtgtgcttcgggagccgtgtaactgtggcgagtccggcactctgcgcccatgccgtcggttcgcgcgttctttttccttccaggacacgcactttcttcaccaaaaaatgaattttcctccgggaagatcggcttccctcgtcagggatcgctttactaagttgacgccagcaggtagaaaccggcggtgcacgtccgaagagacaccaggtttttgacagcgttttcgcacacccagcgtccagacaaacatcgtcgtccttttgctgcaggggaggaacgggaacggccctgctagggcgaacgaccgagcgagtaaagcgatcgacactgagaacgtgggctcgagtgtctaggaagaaaagcgcgacgtttctccctttccggaagaacaaccgaaacatggcacttaacgaaagcgggacggtatttgcggcaagcacagacagttggcaggcctcgcgcgcgttcgtccggtttcgtactgtctcccggtctttcattgaccgcttgggttttacctcttggcgcgcggagcgaaaggggaggcttcgctcgtaagttcttttctgtctttttttctggattccttttgtatcaagcggttgcttctgccactttcagatcctctgtcacacaggacatttccaccaccttcgagacagctgcgaaagacacgcagccttcctcgacgacgtcgtccacccgctgcccctcaaagctccgcgtctgtttctcttttccggtctatgcttttctttcactgcagtgctgcctggacagcagtcggacagttttctctccgtcttttccgtgcgtttctcgtcgctaaatcaagactcttggaacgtgggtgtttccctgcccacggtctgtgttctcgccttatccgtcgcggcgtctgcggtgtctccgtccccggttttcttgtctccttttgtgtgcgttgttctggcgaccaatgtctacgacctcttttccgtctcaaaagtcaatcgttcatctcacgccttttcgttccgtccaagcctcccggggaactgctcactttctcgaccacgcgagaacctcaaggccagagaagctgcacacacagggtggcgactggttgaggaatcacaaatacatgcgtcaacttgggtggcgtttcagggacttcctcactcgcttcgatcgttcacgcttcctgtgcttcgtatccgcaagtccacgtccactctgaacacacctcgttcctgttttcgtctctggacacaaaaaaatttcagtttctctctcctcgctaaaccccgacggctgcctctcacacgttcgtcgttctttccatcttctctcgccggcagctctcccatcttccccttccgtgtttcctcctttctctcttcttctttcctcctcccggagagagacgcctggcgcctttgtcgcagtctccagccttcttgaagaaggaaaaga

SEQ ID NO: 3509 - DNA, 4480 bp, Toxoplasma gondii
tagagggcaaaccactggagatgaaggtttggtgtcgacgtcgctacacctggggaggagcatcaaaagagattccagacggaagcgaggcatctgactcggttgaaacgccgagctgagagatgacacggaacctcgagagtgaaagagtgtgcagcaaaggagatgggagagtaactttcctgagctgcttccttcttgtccataccgatgactacgctagtgacgcgcgaatctgcgctgtgcgatacgcttgcgtctgtcgctctctgtctcccttcatcgtggctgttatcccagctcggccgttcgtctcggtgtgacacggtctcggtttccctcccgctgagtccgtctggttttttctctccgcctgctggttcagctgcgccggaaaacgccaccagtgaagagcaaaagagagaaacgtagtggattcgaacagccacctgtgtgcagtccaggttggggacgtacggtgcttcccacatggcgttgggccgcagattcagatgccccagaggagggagaaggcgacagggaaagcggagaaagacgcgagacagaggagaacaagagagagaagaacgagagagagaagaacgagagagagacgaacgagagagagaagaacgagagagagagaagaacgagagagagagagaacgagagagagagaagaacgagagagagagaggaacactcgagagagagaacaacagagaggagaactcacgagagagcagacagtctgttcaggcacaaggccttcactggttgagtcgactttcctttgacttcagccagcccaccccctcggcgttgccagttggccagagctcggtttctcacgagcaaagaaaatccctgcaagccgggcagccgcgggagacgagacaggcggaagaagcgcagggcgacaccaacggcgagagagagaaggatcagcgaaggagggagagccagccaggaacggttgcgctgttggtcaggttgtttacggctagggtgggagaggaacatacgaaaaagtcgaaaaatggaggagaaaacgaaatgggaagcaaagacagctggaggctctctctcgtggcggttggcgcggaggcggagcaacgaaggatcagcgagacttgaagaaaatcgaccacgcatgtctggcgagcagacagttcacgttttccggtagacgaaagaaacgagaaatccacatgcgaatgacactccagttccgagttgtgtgtgttgacgagaaatacaacgccaggcgtatggacactcgagattggcgtccgccgtttgcacacctacccaccccccaaccggacagcaagcgatttctggaggttctctgcgccgattcgtggagttttctcttctttgtctcgtcttcatgtacagtatctcaaccgcaaacacatatggactttgcgaacttttgggacggcaggacaaactgaaggaataccctttcaccgtcgtccagtcgccatcgctgccaaagcgctgagtccgtcgtaaacagagcagtgagcacggaagacattgaagagccctttcctcagtgcatcgctaggtttatatgctgggtcgatcgctttggcaaccaaacagaactttgtttggtttgctgtgtttgtccgagtcgtgagtcagaggaggggagtttcttctaggcgattaggcttttttctagcgtccttcaatcgctttcaatcgctttctctgtgggtacaccgaagtccacaaacaaacgaattcaacggcggggtttctgtggtggtgttctttgttccgttctctccaagtcacttgtacatttgcttcgatatcaagataagaaagggggaccctcgtattttcacggaaacctgatttgtttgccgtgcctaaaccggtacgacgtagcaaggcggaatgcggcactgtccgtttcagaaaccctgtctccgagcattcctagtgaattcttttcctctccacagtggggaccagccaaagcacgggtgccaagctaatccaggatctcgccacctataggagaagcgtcagaattgacgttgctgggaagtgtggccgttgatctcgtctcaactctaactttagtgtttgctcatcgcccgatccggtcgttttggatgttccaaaggattcgccaacacagcacgttttccgactagctgactgagaacaagaaaccgtttctctgaactcttttttttctggaggggcctcgaactcaaagttaactgccctacgtgggacttcagtgtgactgcagactctcctggaccgcactttccccctcgttcgcgcgttgccagtcgttgtctcaccactatggaaagacatgcgaaggtgaaagaagaaggcgaagcctcttttactcgaacggcgtttccgacagatcgaggatgccaaggctctgttatccggcgaaagcctttgcatgtcgtataccgtgtaccgatgcggtctcagtcgagatccacttttgaacttgcgtgcgttcgctgcagcagtctttgcgggaaaaaccagtttcgtagacttcttcagaatcggcacccgtagacagtgtgttaagggacaaggtagaacagaatggtttgcgtcgcgtggtaaatatagacatgtgtaaccgagcatcaacttagatgcacaaatgggcatcatcagcccttgtatgagttgtaaatgctcaaaaataatgctgtctcagagatcatttcttctagtacggtccctcacgtatcgacacactccttcatttcatgtcaaccggttggaacgacacctaccttcaaggctccaggtgaatacggaagaaacaacccgaaacatacacaacagaaaccatctccacttgcaactcatcctgcaacggtacgcgtcgtcacccggtcttctctgtcccggcgcaggttctatccgtcctcgctctcttttattgtccatgacactttgtttttaatcagggtatgcacatgtctcttttctgaatctttcgcatgagaagcaatgctccatcgctctctgatgtggccgcaccacatgctgactctgggtcaagacgaagatacacggcgtccttctcagctgtggcacttgcgattgctactcctataggtactaagatctggatttgaaagcaaacactttgagctctcttgcgcagtccagtggggtggtggcgcacagccgttctaaagaactgggtgtgtgtctcataactggagacaagttcggtaggctaggttttaggcgaaagatgggggaaaacccattcactctgttaagtgaacatgtctctgtctcaaatgaaggtggcacacgtgttgtcaccgaaatagtttcttttaccactttcttaggcatcgcagcagcccttttctgagagaggcagcgccagagaaaacgagacatccgaaagagcccatctcgaaggctgggtcgaacgcgtgcttttaagaaacggatttttcgagaaaaggataggcaaagcaaatcaaccctaagaaactaacgatggctatttctttctcttttcaggtgtgctgatgagcacacatgccgggttcctctgccgcggcacacgcgtgaatgcggagacaggaggcgctcgctctgtcgggggaaaacgtcgaaaaaaacgcgttttctctcgcttcccgtctcagaggggtttccttctttatcggctcaacatttcttcctgtcgcaccctgttctttgtctccttggcctttgagcggctttaccgtcctcgcacttgccctgcgtgtatacgcgtgtgtggccgacgcgtgtcgcacgaaccgaacaagacaagcaacttcagacatgaggaagtccggggaaagaagaaagaaaaacgaaaggcgaagatcagaactctgtatgcactcacccttctccttttgcggagaaaggaacgtaagcaaccgttcgtgcgggaggtttcccagtcgtttcccagagagacaagggagcgctcagaccgcggccgctgcacatcgtccagagcggcggatttcgagaatcattttgggtgatcctcaggcaacagagaccttggagtgcccagagaaggtcttcctttaaaagtgggcggttcaacgggtctgggagggaagcggcgtacacatcgtgtgaactatgcatggcacagagatccacaagagaaccgtgctgcctgccactcttggctgaagaacgcggttgaatgtatgtagtctaggccttcagttcgagcgggcttgtttccgcttccgcgttacggcttcaccactcggggagttgcctgctgcatccacccgcggcggcgaacaagaaaagggaggaggattgagggggcgggagaaataaacacacgcaaaaggggagtcttccccggtgaacaccggaatcagagctctcagaagcaagaacgttgagcgaccgtagaaacacacgtttcgctcttttgagtcgtggacta

SEQ ID NO: 3510 - DNA, 5041 bp, Toxoplasma gondii
tggtggctccatgctaaacggatagtcaccatctgccaacggaaaggaccgttccgtcccggtcatgaactcagatccttgcatcatggccgcgaaacctcgctgttgccccaggaccatccggatggcactgaccacgaattaacgcccagtacgttctgttgttccaaagagtagcagcatccgcaggataaaccgtaacccacatgcaaatcagccacctctagtgacaattgtttgatcaggggaaactcactatgcagatcacacaagccgtttttacgtcacctagctaaccatctgccaatcaacgctcgcaaaccccaacagctgggcatttgagaggtaagcctcgtctagcgcatctacacaagcaatttacgataagaattccaacagagaacttctctggtatgcttcaccggaaataaccgaaacagttctctactagcgacgaccagtcaccacacgcaaaatgtatcataatccaccaagtctgttgtgtcgtgtacgactcttcgtcatgcctgttattctcccgtgtcgccgaacaagcgctgactgtgtgaaagaccacatgctcgaacggttgtcctcgcgggagaaaagtgtggctgcaagctaacccaggcttcacaaagagacgaaacacaaacgcccaagtgctcgttatcacacgaccaccagcacgatgcacgtcactacaaggatacggttttcgtgtgagtacaccatcgccggagtcagttgttctacatgcgaccgaagaaagcaatgccgttagtctgccaagccccttggcgtcttcaagtgctggtcattcttaccgttaaggaataaaagaaaactgtggacagacactggcaagaaaactacggaaccgcgaggagaactagtgccggcacagtaggcctttaaaaaaacggttccattcccctctccgtggccctaagcccaggctgcctacgatagtccatacagtgcgagtcagttgttcttccacctgctcgcttgataatttgcctcccccccccttcagagaaaggtctgacgataagagctcacggaattcctgcatgacattccccctggcccctcgaagtgaaactcgtctcgaacagcttcacccgttcaccacacgcgtacacactaacatgaacgaactcagtgcgtcatatagaacaaacctatccgaaaaaccaaagccaatcaagggccgacaggaaaactgttctgatggtatttactgcttcaccattaacgaactacccgataacgacatggctccccgtgacgctttgacgtctcgaccgatggtctcggatgtccgcagagcttggcagcgaccaccagagacgcgtctcacgtcccccctccagcgtctgacacagttacgtggaaaaacatgtatcctgcaccggtacaactgcgccgcattcaacttttagtgtcgtcttccgttgcatgtaccagacaaaaagtgctgaccaaagctccgttcgccgttccgaagaacgcactcttcgggccaccccgtacgatgcccgcgtcgtgatccaaggtgaggcaggccggttggcactcattcaccacatgaaactgaacaaataaacgctccaacgataccgaatcattttccggaactcggaaccacgcactttcccacagttcttggagtgcacacacacgcacaactgctggtcgcgtcaagttcggttcacctgcaaaccaatggtaacccggccgcccgactttccagtcaaccggccgggagggtgaaaaagggtcgtcaccgcgagttccaaatgaacgccggccagcgagctggaagcatgaactccacagcgtcagtttcaaacaatacctcacaggacagtcaaaaacaaaagtttgaatgtacaagggttcctcctgcggcgtcgacgcttacttacactacatagtggcgtcgacagcatatctgctgggggtcgacggttaactctgcgaagcgcgatctcgcggaaccggctgcgactggggcgacctcaccgtagcagctcaccatagtggcaatgtgtctcgacctatgggcacttcccactcacgacgaccgacgtagcgcaaccatcaagctagtagaagaaaacggagacctccctagtggtgtttctgcacaccatggatacaactcattcttgtggtttcactgaagcaatcaattaacaatgaaaccggaagaaacagaagtggcattcacttttatcgcctataacacgagtgcctacagggaacgtggatagctaatgagacgggagacgtgatcgttacggttgtgtcctgggataagaagacacagtttcggatgtcatgagctttttgagacgcgcaaacgtactttcccacacactgatctgagcgatatgtcgtcgatcaacgatgagtttgctgtagtcacaaaattaacaacgggagcccgttgggttggctcgccatacgaagaaacggacgacagtccaccacgcatattaacgttcgtattacctgttttcactagcttggactagagaggcgtgtgtttcccttagagattctgtattgcgtttcttcgcggccaggagatcaaaggtattgaggcagacagcagaagcgccctgctttggagaagtttgtctcccctacaaccggagcaggatgcgcaaatacaggtgctttgtcgagacgtgcgaggtagtagacgtatgcgcggcaacatgcttagcgtggtaaagatggcacgtgggacagatttaccgtaggacaccggttgctccggcaagggcattacgcactgtcacccacatgacgtggaaattgtgatcattcacatggtgttgtttgatgacagtaggcgttcgtagaaccagttgaggacgaatacgttgcctcaagatgatcgttttgaagcttttcaacatggttctacgaaagacacgccatcgatggtcgcaagaatacttttggtttagccaagtacaaatcggagagaaacctgaaagtaagggaaccttttgggcataagtacagcgcacagggacgcagcgtttccccttcttccctatcatgctccgtactcagatccaccagcttcagtattacggtcagtttccgcagtgatgtctttcgctgagtggtgagggtattctggagtcatggtaactgaagtagtgtttggtcctcgcgtgtcagccggatatggttgttgagtggatggattgggagggccaggcgagtaaagagtaacttgctctgtcctagatgaagtgtccttcagcactttccgcacgcaaagggctgtcagagcgaccatcgcgaagagacagaaaatgccggcgatgatggtaaatgtatggaaggagtctgttgcttgctgcgcctccaggcgcttatggacggaggggatcctgctgcaatcatcacagtatctgaagcgcttggagccctctttacgggaacaatcacgtccgttgccgcttttcggcactactattttgtaagtctgaaaatggaagcaatcattggtaaattctccatctggtccgcggtcgagcttgaaatcgtcgtcggagtcgtggtgagttgcatggccttccaagggctcgcacacggaccacgggccgtactctccttggcagtcagtatctgtaggcatacgacacggccctttgggtgagaagtgtgagcgcactaaacaggttcccgtcctttcggtgacttgcatgctcagcgatctcaaaatgtaggtcgtctcaatcatcacgcgtggatgcgaacatccgcaaactacaacttaaggaatactgaagtggtgttgagatgtgcctcctcccatgagtgaataaactgtgtccgcctactatgcagtaggaaccccaaagcaatctggagttctgggccagccagtgtctcagaatctccatacgcatgacacctgtctaccatgtctgatctgggttcgcaggatggtatgttttgttgttattaactgcgctactgcattgttagcagggtggacgcgctggtggaagtatctgcagtcgtggacagaccgaatacgaaggccaggcgacgtaaaaccgtacacaggcttcccatttggaattctttgccgatagtgtgaagattaatcacggaaactgggtccagcgtgttacgtaggaccaccgcactgaactactgttcagccctcgagggagttgctgttgttcattttgcgatcttgatttgtctggggcccattctgctcacctggctctgcacgagcgagaaggatgccagaactaagacagaaaacggtggccgggaggaagaccttcatggtgttaacatagcaaaccagacagttgaccacgtgttgggaacctgtagagacggacaaccggatacctgggaaccgaagaatacggcaaacgcttgcggcagtgtacacctctcaaaagcattaataggatgatgtttcaatttgcaaaaaaggaatcttggtgacgggggtaaacgtagtttactcggagaagtgccgtgaaacatgtaaagggcccatctgggaccttcaactgactggcgcaaggcgggtactaggaatggcgtgatgcctggaatgatggctaactgcggcaagatagctctacagacagacaaacaaatacatagggaatcacctgtttccatctatccgcggcagtgtatcaaattactcaactggtaatctaggaaggaggcagcagtccaagtcaggcagccaaaaatatgccaagcgaggataggatcgcgtttcggacctttcgtctgtgtcagccagcaaccagcacactctagaatcacgttcaaatcctgcatttgtcgacggtgaaacagagtttcatccactttcaccttcccgaaaatagctgtaacaaaacacctgcgtcgacgacgaaacacctcctcccgtcaggtaatttcctgtgtgtccaacacgtttccgcaaaggtttgcacatctgtcaaggacagcgcctccttacattcaaagtcagcctacaaga

SEQ ID NO: 3511 - DNA, 1970 bp, Toxoplasma gondii
cctttgtcggctaaaacagaccgtggaatagagttgagcaacagcaggtgtttgtgttagagtttgccttatcgcggtgcttgagttcattttttgcatgaggctctcaaaaatgatttttgtgaaatatgattgctgtcgctaggcctaaatacactttgtgaaacggagttggcaaactgcttcgatggggagccactttctcgcataacggctatgcgactcgtgtcgacatgtatcacctgggaatctccaagcaaggaagggcgccggaacaataactggcggcagaaacgtgatttcttttggggagtctttatgaagacaagtttgcattcaccattttcacgtagaaccatgaacaaactgcacagcgtgtccgtgtgagggcaaccgagagtccagcctcgcgtcttgggtgtcaagaggtcagaaagtcagtaaaccctcgaagaaaacgaacaggtgatgcgactaaaacggctctccttgtggcagaacagacttgccggactaacatcctcgcaaccgcgatacgtgctacctcagaactaagcgatcttcacactcacgtacctcaggagttgaactggaaagggagctgcagaaatcgcactgaggtctagaaagaagaatcggcacatgacgtagtaaagcctttgaggtgatcatatcaaaatgcccgtggaaagaagcaaatattcatgcttgcccacgaattcaagcacttctcgacctgtaggtcccggcatgtaagttagcgtcgtgtggactcaagagataacaaccacattttcagtgcacgcttctttgtcccaccacaactgtggcggctacctgggaagtaaattacgggaagctgcacaaggcagtctaacataaaactctggatgagtcagacgctgcaaccgtcaactctgtcgattggaacttgaagtgaccacaggtgtagagggcttcagagtgtcacggacaatgaagagttagagtttaagtctataacagctagacgaacatggtaaaggcatagggaaaaagtgttttctctgtacgtggagaagcccgagtccgttttttccatggatcagtttctcaggatcgtcggcttgcctttaccgctaccgcatgcatggcgtcgatttcgcattccacttccgtccgttttcgcttcttccacactacaggttgttgagaaaaacacgccgtcgactgtgactcgaattctgaaacgaacgcagtcttttctgcatgacgcttcacgtgcttttcgcttcttcgccgactgaaaactcgacgtttcgtgcacgcaactcagcgtaccactttcgttcgttgtctcgccagcagcgctcctcaggaggtctgatctttttctgtgtcttttccagggagcgtttttcctgcctcagggaaaagcgagttacttgctctcgaggcacaccgcggcggttttttccccacccgttctcccgagactcttcagtgtgtgtaccttgtgtgcgtgacaacctgttggtcgagaacagcgaagcgacggtcgaggtgcacggggaatctcttctgtcctgttgtttccctttttttcagttaaaacgaacgacccgagcggcaggcctcacctgtgcctttgtttttcttcctttttaccgaaacttttcgctcaggctaccgagacgcccgttcttcagctgcttcgcggctctctcatttttcgtatgcccgttgagaagcgagcagcgacagcgtctgtctcgcaagttgtcccgtcgactcggatgctggggagcagcagacgcctctacacgtctcgatgttccactttttctttcttggacagccgtgacgttcagtctccctgtagacaggttcggctcctgaggctcgggaactttcccccagtcgctctgtcgccaccctctcgacagcctgaacagcggcgctgcgctggctctccttcgcctctctccata

SEQ ID NO: 3512 - DNA, 2161 bp, Toxoplasma gondii
ggctttttgaggaaatggtatttctgtgtatttcgtttccatggcgaaacgttttttttctcgagaagttgttcgcgattcgaggtgcgagctttgttttcgagagaagagcagttgctctctgactcggcagaatccgcgttttcctcctgtcgaggcacagaggtgcgagttcctctctgtcgaaaagaggagaaaccgagggccttcaccgcagaagaaaaggaactttcagtctgttgaaagtgcgaatcaggcaatcttgagacagaaatcgaaccttggacgcgcgtggactctcggaaaatgtgaaaaggtaaactgttcctttttcggtgagttcgctgcctacagccttagcaggggaaagatgcctcgtcgcgtcctggagaaggcatacacacgaacgtttttcaggaaacgtttttctgcttctccttcggaatctataaagaacgcatggaaaggaacctactgtgtttccgcataggttctacttctttttattttagaactgggggaaaaaagctgaacgtcaagaggtctaaatgggggagcgaggaggcgttctcaccgtctacaggtggatgtgtttaacggaaccttagatttcagcatcacccacgcaagacggaagggctgtctctgattcagaagaaaggcgcgagacgcagcgatccactgtcaccttggcaagaggagctctttctctgcacaaatttcaggaggtagatcgaccagagggaaagcatttaagaaggcagaccgcacatgaagagaaaggggagtggagggaaggccgtggacatgaagcgacgcgcatgcagaggcagcggtaccaggtgtgaaagttaaaatccgttttttcgcgcgagcaaggcgcgtctttgttaagtctcctggatctctcgagatgcgaatttcgccgaccgcgaccgcagtcgacagagcaagtctctaagcctgtatgcagccggggcaacggcgtctggatcaatgcacgcgacgacagaggttgtgttggaggtgtagatgtagacagaaagcagtggagaaagagtttctcttttgctatcgaaattgaggctacagcaaggaacgccaagtagccgctagcaacgcgcagagtgctgggactcgagagcgagagggccgcagtgtttaccggttaacatggaccagctgttcctgtgttcaggtcgaggcggtgcttgtctctttgcaactgtgtccatttttattgatcggtcacaaaaaaactcgtattcgctcgcgtcaggatacactcgcgcgcgcagacgtttgttttttgagggcaacgaggcctttcgaggcgccttggtggggtcaaagagaaaagaaaagagcgagtcgacgttgtgtgccaagaagggtgtctcccctagcatgtttccggaaaacaaacttttttctccgctgcagaaacaaacagggcatcctcctccccagagagagttccatttttcgcgcggacgcgcagacgcgtgctcgcgactactcgggcgcagcacgcaaagatagcggggctcgccgacgcgctcttcagctttttttcatatttcttctcttttttccctggacttttcgctcgcgttttctggacagaacaacttgcccagcaacgcgaatgacgggtgcttccaggtctccgcctttcctcctggcctcctcctctgtcttcctgtgagaggtctcttctccgctatcgagggccaggaacgagaggagacagtctctgatgcttcgaagttttcgtctttttttctaaagggagtcgagcgaagaagtctttctgcgagactcgaaaaagacaaagaaaagacgcctctcgcggcgtcgtggaacgaactcggcgcctacgaaggcgctagcgagaggatcgcccgactctcaactcttgtcaagttctttcttcctcttcgtccacctcgtgtctatcttcttggatgctttttctcctttgactctcttcttctccattcccttccgttctctgcccctgtctcatcccgcgtcctctcttcttcctcttttgccttcttcttcctcgcctctctccttcgtcctcgcctctctccttcgtcctcgcctctcgccttcgtcctcgcctctctgtcgcgctgcctgttctccgccgcca

SEQ ID NO: 3513 - DNA, 1714 bp, Toxoplasma gondii
cttattcatgagattatctgtcctcctgcccggaaccgagtgaaggccaggagtctccgcgcgagtcgagaagggcgtcgctcctcgcccaactcccgccacgtacggtccgctgggacccgagccgactcccggcatgaaccggcgagcgccgggcatgagggaggccggctgtcgaggagcttgcatgttgacggaacgagagggggacgaggaagcgtagaaatcaaagaaacagaagaacactgaggcaccaccggatgaaaatgacggagaccggggcagcaaagagcaccacggcgcgcgggacgaagggcgccacaggcgaaggcccgcagcaagaaacggaaacggacgggaagcggatcgctgagggatcgattgtgtgaaggtttgcgggttgaatatttgtctcgagaacccaggaagaatagccgtcgaaagcgatgcctgggcaccttcaacgtccaggcttacgggaagcgataggctttgccgatgctgaaaaactggcgaaataaaacttgaaacagggacggaagaaagcaaggtcgtggtctcagcacggatgaccagctgcgccggaagagaaaggtgaacgaaggagacgcggttccgtgacagaaaataacacagaggggggagaacagacctaaaaacagatcaccgcagtttctttggaactgcacattatgacagcattctgattcgaatgcagaccctcgtgcgtcggtgtgcatacaccccagccagcaatggtgccgcagcccgctcgagtccaggagcaaactgtcttttgcacgttgtcgcaaagacctcgtttcctgccaacgactacatagacctccacggaagatggcgatggtaagacgattttcctgctggggaaaaaacccgagaacagtaagaggaaatccacaacgccaacaggagaaccagtaccggtactaccgaacgcagatcctgcgcggccgacgcagaaagacgattggaaagcttgacagaatacagcagcgcgaagacgaaagaaagaacaaccgaagaaagcttgaagaagaagtggagaggtcgaaaacacaacggcaagagaaccgcgtaaagccgacaaacatgtagaccgtctgccgtcgacgggggacttcggtatgcgagtctgagcagtgctgctaacgggaaagctgaaatgcgggaaacgataaggaaacggaagggtgacaaaaaattgcatatacgaacgagagagaaatacagccaagactcgcgaaaagacgaagtacattatttagagcagagacgggcatgcgcgtccgccatgtaagagacacgccttttcgcgaagaaaggccccttgtactgtgttttccttgccattcgccccagactaaagacaaaagaaaacttctcgttccatggattcgtgaagaagcgacggccagaggtcgttttcgatatagtcatgtgcatgtgccagagcgccagcggaaagaccgctacatttgcccctccgtcaatgcatgcacggaagaaaaacggggacgaggccggctgatctgggcaagctcttcactttctcccatttccggagacttatgacaatttccgtgaaagaggaacgcagctggaaggaaacgacacaaagaagacgggaaacgctggcgagccgagggagcgggaggcgacctccttcacggcaaacaaggacgagtgtcggaaa

SEQ ID NO: 3514 - DNA, 2033 bp, Toxoplasma gondii
tggaatgatcttgggaaacggccatggttcgggtcactgaagaagaagtccggctccgtttgtcactcctcatggaccacgccagcggctcttgcaggcggggcgctgtcgttggtatccctgtttcattcgatgacggcaaacaacatagtttctcgatccctgaagcgcttgtcacatgcacggaggtatggaaacttggacctttgagcgaccgactcgctctcaaggggggaaagaaccgggccgaaaccctaggtgagagtaggggagccgcaagggaagcggccgagacgtctacccttggggctctagacaccgggatatgttgactggagcatcggcaatatggaatatctgtggctaacgacattgtccacagatgttgctgggcctttagaggaagtctgttagtacagacggggggaacagcggccgcgtgcagtgactcataaacggcgtgaccccctggattcgtaggcacccgtcgcacccgttgccaccttgcgtcctgccgaaactgagggaagacatcgcgacgaacagcacggctcaagtgccgcatccccggcaaaagaaggtgttcagattcgccagcagccagaaacgccattgtgtgaggaggcgactacaaccaacggcccagatagtcttcgatttcacgtatcgcaaccttctttgacgaataggggtatggcaggggacggctccgcaaatgcgaagaaaccccccactcacgaaagatgccaaggcattggtttcatgctagatctaccggctctgacgagaatagaacgaatcgatatgcctgcgaatactaacagatggtgggaggaaagcgacaaggtacacagcgaagatcactgtgcagtgatcactaatccgttttcacaggacgagtatttttggggtaagtggtcaacttgtgcgacagaaggacgcgacgggcccgactgcacattgaaaaacggaagccagtaagactttctcatctttcgcccgccagtatactggatagcactgacgacaactgtaaactacccgtagcgttttcttcagtttatttcagaaacaacacaaaggaactttgccacggttcagtaacttcaggccccgcaaatcatctgaagcatgcgcgggctttgagcctcagttggctcaaggacgaggcaccgtgtataaaaattggcttttactccagcgtactttcgtgtagcatcgaataacacgtgaagggaattccatgaaaaagaaacgttcttcaagcaagctcacagtccagacgcacacccgtggaatccgcaaacggcgttcttgtctggagatccagagctgttgcatgcagcggtgtcgagacaaaacaataagaagtgtccacgcttgattgaaaaagcattgcatgcaacaacgaggcactaatatccaacgaacactttcactacctgtcctttccggcacactgcgtacgaattgctggcactgagaccacagcgttaaatccgctgcaagtgtcgttcagtatgtggaaagtctgtattagcgttcctcgcagctgaatgagcagggcagagatgctcgaccacgggcccctgctgaatatgtattggctttccggcattgtctcatggcttcgctccaagctctgtattttcttgttccctgtgtgaacacctgcatttcacgtcattgtacattgagaaagtgtgaaaacacatatttttatgtgtaccgccatatgcatatcggacaccgatattttcatggttcacctctgcttttccattgaacttcagttaatagcaagccgctgaggcgaggacagttgacacttgtttttttaatacgtctgtccttctagaccagaaaggaaccatttctaatggccgccacctctgcatgacggagctcggtgttcaacaccggcggaggaggcaaacggaccacaggttaccacgatatgaacaaacaagttcctgaggctacatgataactgttatgacagcgcatcaacggccgtgtttgtccagaaacca

SEQ ID NO: 3515 - DNA, 2740 bp, Toxoplasma gondii
agtttttcttaaagatccacagttgaggagaaactgggtctctggtttcctgttccacgccgccaaagtcttgctggtatccgccgcaactgaagcactgggctagttgtaccccttctgctgtgaaaggtgtcgtgatctttttggggacatgtgttaggtttcagcttatgtttctgcccgttgcatcagaaacactggagtaattgtacctcttcacacatgagaggtgtctcgacttttcttggaatacggcataggtttcaccttatatcaaaagcaacataccccgctattccgcagcaagcaaaagcatcggttcccagtagtatcgtgataaaaggacgaaagcaatcgacgcaggggcgcgtggaggccgtatactctatgcaaccaaattgttttacatgcgaacctatacacaacattctttttgctgcatgtacagctgtagaagggatgtgcggatagttctgaaggttggcgtgacccaaggtaccccgtagttccgcggacatcccctgctcggattctcgtttctcgtagggggctggagcgcaaacgtttttggcattctgtcattgttcggggggtgccgcagcagaacataatgaataatcaggtgcctcttaaagactgctgctacagtcatacatctggagtcgaaggaactctgcatgtattttcccgaatgttcgaaaggtgccgagcaacttgacacgaatgactatccggtacgttttcatgtcccctctccaggcaccgaatctttgttggtgttcaaacctgtccagaagaatgcctgattgtttgctcgccaagtcgtatgcaagaagcttccaacagtctaaatgcttgccattgcagaccgagagctgacaggcacgcatgacacgcggtcactggagttgatgaccaggcgttccttcggaaataaatgtctgtgtacatttcttttgagaagaaagacccagtatagtggagctgttgtttttaactgtttctgagcactgctgcccctgtgtggatactgctttccactacaaaattgagaccttcagggtaacgtcgttggctgttcatctcatccgaggaactgcgcagcataaatgcgctgttagttctgccttcgagaaagcttatgcatcacgccagtttgttcaggccgtacgtgtgcgtaaatgtaagcaaacggcacccgagcctggcccgcctctgtcgttgtgtcagccactgggagaaagaagggatccggtgtgcctgcctgccgcgggtttcttaaagaggaattcagcttccccaagaagcgattgctatttttggcctctgcacgtgcagacggcagccatgtttttgtgaacggcgcttacgatgataaatttggctggaagtacggttgtgccgcgacagtgcgaagtcggacgctgcccagccggtgagagtcgtggcatcgtccactctccttcgcctcctcgcctttcttcgtctcagtatctactaagcgagcgcaattttactcatagtgtagaaagagaggcacaaattaccttttttactcactcacttcttgcaagatctcttttgtggcgcgggagattgctcgcgcgaactgcagtcgttcggttccgactagtctgcgtccgactgcatgtaccctcatctctcccagttttatgccacaactttggttccactcttcatttgcagaagttctcttctggccagccgctctttttggctgcttttctggcctgttcacccgtaaactttttttcagggcttttcgacttgcggtctgtggccccgcctttgcgacgagttcgcgcctttcttctcggtcgaccttcctaaccttgcttttgtcacgctgacaagttcaactgagaccaacgtctagagttgtttctctctttttaactatctttccttcttcgtgagtgccggagaagtgcgttttccccgctctttgcatgtctcgaagtgtggcgtcgatgtctgcttgcgctggccacagtgcaagccaaggcagctcgtttgctcccttttttctctgctgttattcttgtttcttttaacatcataaaagagtcctcgcagtttccgcattcgaggctcagaatttggcgtcgattctgcactggaaggaggacgcgaatcgtcctgtccaaaagagtcctcgtttacttctccgcacggaaacagagtcgctttgtgtccatatttgttttagtttgggagaagatgaggttcttcttcagccgttccttcgtcggaggagcgaaagcgtcgagctgaccgagtactatggaccctgtacccaacatgaagtccgagttattgccttttctccatgtatcggatttttcggaaaaccagttgtctagtccactctcgtcaaacagtgctgttctgtcccgagttttgtgcatttccacccctcgtgcgtctcttgcattttcgcgtgcttctgagttttctcagcgataggtcaatcctcccccctgcgttgtggtttttctgcgttgtcgcctggttctgcattctccggccgtcttcttttcctgcgtagcctcgcgtcctctcagcgtgtgcgtactcccgtgtttccgctcttcgcctatcacgcgaacttgtcatgtccgcctgactgggagcgtgagagctcctttaagctgtatctgactctcttttttccactgacagcggccttggctcttccccggtttcgcttgtgccacaa

SEQ ID NO: 3516 - DNA, 2721 bp, Toxoplasma gondii
tcatcctttctcgcgctcctctccctactgttctcctctccacctgtctctccacttgctgctctgccagtctcctttgtcgtcgtcgcggcctccgcctcgtcggccagtgtgtcgacgccccgccgcagggccaggcggggaaggcggcgcgcgagcgaggttgagtcagctggcgaggaagaccaacccgacaacgaaacgactagaacagacaaggaaagacaggacaagatgcacccgagacgccagaagccagcgggacggacgcctgacgagtcctttgacagcggacaagcgactgaaggaaaacaagaagaagaacgagctgcggagagaggcagatgggggagcgaaagcaccagagacaggagacaggccgcgaggcgctttcagagacagacaggaagagacgcagggcaggagcaaaagctcgaaacctccaaccagcttcacgaggaggaaacgcgggggccgccttcagatgtcggcgaacgagagacgaacaaagacgaaagacaggaacacaggttctcctgcaagaaagggggaccgcgtttcctcagaaacgcgcgcgaaaaagagacggcgacaccgaaggatgcccagtcgtttgcgtttcgaacgctatgtatgtggacgagcaccgacccagaggcgcagccagccggcagcgctccgtatggaaggcgaagggagactcgccttcttggggcctctcttccaccgcagaagacagacgcaatctcgctcgtgaagaacgatattcagttccagagtttcggaaaaaggcgaaaaaacgcatgcaggctctcctggcctgggtgtcctcggggaagaggcagggagcagctgcggccgacgggcagccggcgagaaaaaaccgcaaaagacagagaaaacggcaaagggaaacggaaacaggcggcagaggaaaaacggagcggaaacaaagagagaaaccaggaggtgaaattacgcgggtgtcgtcgactagaccgtggacgcggaggggcaaagatggacgagaggagggaatgccgaaaagtcagacgcgcggagccgcttctgaccgaagatgtgaaactcgccttccacgctttttccggagaaaatgcgctggagctgcgaacagggacttttgccaacttggaggggcatgtgcagagagcgggggtgagacaggaagaaaacggacgctctctcgcagggcagctacgcgagatctgcacgccttcgcaaccgaggagaagcagagagagagcagaagaagaagaaacctcaaagacgttcttaaagcgcgaagcgtcgccgagaaaactggttggcgcactgcacgcggcatagaccggaaggaagcgggcgttcgcaacctcgacacgagcgactctgtggtgaggcggggtcgagtctagaagaggactcgtgaacgagtttgcagacggcagcgcggaaagcagagaagagagctcgtaacgcagacgagagaaggactgaaagcgagaagtcgagaaaaaagcgaaaacgacaagggaggtcctggaatcggaacctgggcgttcagcctgcgctcgcagagggcgggagacttcttttcggccgatggggggtgactggcgagctctacttcgccgcggaggagaacagcgaaacgcgttttgtcctctgcgttcagcacactcagatttcaaggcagaacccactgcgcggtgtctgtgtctttgcgcatttcaagaggcgaaagatggaaagcctccaactgaaaagccgagttttcctgagcactgctcgcgggtcttctgtgccccgtcctctcggtcttccagacgccgcgaacgaggaaacagatttttctctgcgttctcgttcaagcctttctactggatcgcttcctgcttctccgtttcttcgccttgcgttgtctctccctgaatctccaacgagttccctcctcagtgttccctgtcgcgacgcgcagctcctcccttcgctgctcttccccggtgtacatattatatacatacacacccgactgcgagaacggtcgacgaaggctgagaacagggtcaccgcctgaagaagccgcgcgtcttggtttcttgggtggcgactcgtctgacgatgtgacagaacgctcgggagttcttcgacttctttgctccagtctgcagagctaaacttcgtgtcttgtctgctctttgtgaaaaccgctgctgggcggaagaggcgccgcacagcttcctcgctcgagtcttctttcctttcgcagaaacgctcttgggtgcgattgactcacacgttctctgtttctttccctcgctgacaaggttcctcgctccgcctgaatgtcctctggagcttcacaagctctctccgccgacccagccgaggtgcgaagtctaaccgcagctaccgtctttcgcgtctgttcgagagtcccttgagttgtcagaagccctccactcgctctctgcatgctggaacaaccgtcaaacggttgaaccgaccgcacacgcatcgttttccatgcgctcaggcactcccttcgtccgtctctcttcctcctctctttgttgttcactccgctctcggagaggcctgttgcctccgtcttttttccacccttatctttatggctttgaagacgtctctctccgcgtttttgctgtctttccccgagaacaagctccactctctttccgtccccccctcgtctcgata

SEQ ID NO: 3517 - DNA, 1457 bp, Toxoplasma gondii
gtgtacaggcacttactgccatatacatgcgtagacagctttgtctatgcatagcgattttcataacgtcgaaaccgtcgtttagatttacttctgcattagtgattctgtgaacctgcataggcgcattcgtgtatgatcatgtatagatgactatatatgtgtacatgcatttgtagatttgtagagatccagagatatcttgccaggtagcattgggagtgcacaatgtgagacgccaagccagtttcattgtgactttgtgtctgtcaagaattgcctcttcagtttgcagcgaacgaaatggcgggaaaaaagaggcggctggagagattgtgcggcccgcgtctgcatgcgaagtgaaacatgaggtggaggttctgtccatcgcaggtcaacgaagagtttctctgttctgggtcgtttttgatttacgaaagtcttaaatctattccactctcgaaggctgcaaagctgcctgtccaatttcctctaaaagcggaaagagacgaacagcgaaaacgagagaggagactcgggagcgtcaacaccacgaagagagagcagaggaaggatagaccgagaagctgaagggaacatgaggagacagaggaagagtgaagaagagagagaaagtaaacaagcggtagaaaaacgacagaggacaggaaggaggacagagggacaaacacagcgaggaaaacgaaggggaactataagatagaagtaaggagagaagagagcgaggaaagatgcgagagagacctgcggtgtttctacggaggtttgagagacttgtctccgtttagcacctctttttttaacggttcgaaccgtcaaccttggcagttttctggattttggaagagactcgctgcggcaaacagtctcgaatgcgtgcatgcgcgcggcggcctcgttgagaagaaccgctggatgaaaaagagaaagaaataaactccgaaaggagtgtggaagtgatttatgccacggagaagaaaatgccgaagaatcgcgtctgctcacgaggccctgctgaaacagctgcatgcatgcatgcacgaatgcacatgcgagtcgaaggacgagtgcacatacgcggactcctcttcagaattagcgttcttttcaggcgagggagagacggaagctcttctccttttcaacgcaaaggaattcagaaggtgtgagtctccaaactcgcctttttttctgcagtctcggacacaggtcgaacagttgttgccctctgcagagccatccgcggaagtcgctgggctgcgcgtcccccactgcacaagggaggggaggaaaaggaactaaacagaatagaggacgaagaagagaagagaaggagaaagcgagagaagacgagaagacgagaaggataagacgaagaagaacagaggagaagaaaaaaggaacggataaaccgtgaagagagagaaacgaaaaaa

SEQ ID NO: 3518 - DNA, 4624 bp, Toxoplasma gondii
gttgacacagcaggtcgagtctcaatgttcgcccaggactataacggattcggtctgagtggcatgatcgactactggcacggcgattacaagtttggattccagatgaacgtggtgccgcctccgccgcaagcggaacagcctcctccgatgtagataggctgccctgtcttgatcatgtactgaacagcgaaaacaccgggggttgtcgctcagagtcgcacggtttttgcgctcgatgacacttgagcagaatgcgtgaaacatccgcggtttgcggaacacgtgccagcagggagaaaccgatgtatgctggaacactggcagtggacttgtgtagagacaatgtgccattgtttcggcgacaggccacatgctgtggcagcgataccccttttttgtccttttggtgcccattaacttgtctttccgacttttacctcgtctcccatagtcgttcttgctccgcgctcgcgaaaatggtgcaccaatagagctggcagctgtctgaagattgtgtgttcgagcaacggaacccgtgggtcgcaccagggtggctaatctgctgcactaaaagccgaagacagcgtgggttttcggagacaaggaacaagggcaaggaagcaaaagggacgggtagctctgttttgcgacctggcgtgggagatacttttccaatggagtaaaaatccaaccaccctttgcataaactgactccgtccgggggctgtagccgtatgctgttgcagagagccacggcttgaagaggctgtgtcggcgcgaatcgaaacgtttgtaccattatctgtttacagtataaggcgcatccaaaggctaactgcacttttgtgggtgaaggtctgaattcgtacgggttcgccttaacagcgcgtcgggttcgagcaagaaaaggtctcaaactactgagatggatcttctggctctctgctcgctgcgttgaagatgcgaacagatggcatatgcgaactgcatcttggactttgttgtgggtttgtgtcacgccttttcagtgggtgtgtagtgtcgtgagtccgcccaagatttcctgtccgttctctcactcctttctgttaagctattttttcaggaactgtaacagtgccagctttgagcaaccgtggcaagcgcttttctgacgatggcgacacacacacacactggcggttgtgagtctagcttgctgctacttcacgtgtcgccaagcatcctgggggagaacgcacagctgcaccactttgtagaaaaaaggatttgtccttgccagtagacgggagctagatgcgttcttgcagatagccaaggatacgacttgaccatattcttttggaacaagaatccagcaggtcttgctggttttcggcagcaacacggttcgactcgacgcgccatccgctaggaacaacccgcagaaaaaatcattgaagaactcctgtttctttggaagacctccaattgtacagcagcagttccattcagctgtcgacgcctaaatcgacactcgtttacacccatttatgattacctcattgaaacctggaacttgtggccgacacagcgtaactaaaccgcgtgggtttgtgcaagtttgaacaataccaccgtgaataattttgcaccgaacaccccccgcttcccaccccccatcatccgagacgactagttgtaaattaaaggaatcgataaataatgcaactgcaggagctgttgctttctttggtatcagatgctttttaagccggacttgcagaaggcacaagggcttcagattccggactgtcatcctttgggatatcaatgccaaatcgaccctttgtttttgcggcaatgaacccggtcagcgtccgacatgcagcccagcagcagaaaacgcagacgtattgctcaatgatactgaattgcatgccaacgaaaacgcccggttccactttccacctgtacagaagcacgttccaccaaactgccactattgtcgcaattggtccaagcccaatacagcagaaaagagcgacaagtagcgagaaggtagatgtcagcactgtgccgacgaacgccgtagcggccaaacaacagagaatcaagccttccagcatgaacgcccatccaatttgttgtgcctcgtagctctcaacgaagtgtaggttccagaagctgcgaagagttttagcagccatcagaaaacacacaccgcttaacagaagcacgccttgacctagagtcaagcccacggtccacgtgccgaccctcgcccacgcgtcagaaacgtgtccgtcatctggcttatgcaatctgggagacgcaatcctttgtcggccttcaaagcccgagttgccggcactttgaacagtagccaaagatgcgagaataacagcagcaggccatgccagtaacgctccgaaccaagcgtcaggatgcagacccgcactgtgtgtcttcgctccgtgttgggaacaatcgaaaatgctccagacgccgacgagaaatagagaattgtagattccttgagtcaagattacagtagatgacagacgacacaactttggagatcgcaggccgacagctaaaccggtaagcagaacgacggcgaagttcagagcggcagctccggcgtggctgatggacatcaaccccaaaacgacctgtcttgttccatcatcatcacgaactatgggctccgtaatgtctccagaaaaatctacgtgtacgaaaactgcggcgagttgccacactgcgcaacaaaacgagacaatagcataccagacagcagcgctgcccaaggataagcagtactcccagtgtttgaggcccaccagcatgcaacacattttggcaaaagcatagtcaactacatggggggcctttcgcagacttaggctaagtgttggagcaaaatttcgcaatcaataatctgcagcacagacagctgttttgccaaattacagtggtagtcttaagtcatgcctctgtttccaagaccacgctctgacagtgcagcatgatgtacaagccacaacgtagccggtactgtttttcttcatatcggtcgagagttcatgagtgtatcttcggtatccagcacagaagaactcagctaaagtaaaaaacacttttaatgctgcagagatcgatgcctgtgcccggctagcgatcgccaatcactatccttgtcaagacgccgcagtcgcggtgtctcgaacggcccgcagtccaaagagttccggggaaaaattttcagcctcaggcattcacttttgacgactgttcagttagctgtttcataacgactttttaacgcaatccattactgccgtggtaagtttcgatcctgacaagccatagcggatgcgaggtggcaaagcagctaggcaacgacccccgcccctcttgcagcaacgctgaaattcacgtctgtctgtcaggtaccgtgggtcgcactcacatcctattcctacatgtatcctcgcaaatatatggatacatatttattgctgcgtttgttagccgtggtccctaaacaccgatgtagtttaccgttagacgtgaaacacgagggcaatcggggagagaggcattttagacacttgtgtcctgtcagcggtggcaactgtggcgagtgcttagagtttccccgacgcacggatccttgtcgttttttcctcatcactctgagtatcagctggcagccaggagcgaattgtgagagacacacacgtcttactcagcccccctccaacaaaagcagttgctacctgagaacaagcacggtggagtgctctttctgcaacagatggaaagtctaccgccatcgacgaggcagggcacactctgactgtatctagcattattgaagcacaactctcttgcgttcgttagaactcttgacacccaagccacctttcttaaagtctccctcaaggaaataaaatgctgattggccccgggctacatcattcggaaaatggcggcatagttcccgtctcgcttttccgaggaaagagctacagagccgaccttatatgcggaatgccagcgcgaagcgaacaaggccagtggcgggtgcttgttcggtgtccgcgtcccccagtcgacgagcttggacaccctgagacgccaccttctgcaaggcctcttccctaacccgtagccgcgctcgctcctctgtagcttttccgaaacactcaccaaagaaccgaaagagggcgggtgaagcggacaagtagagtctccttgcatacgtgcattcctgtgtagacttgctttctgtccatttttaaaacgcaaactcgattacgccaccgctgtcgcactctgactttgtctcgtcgactacggcgttcgttgatgtttcccgagtcccggtgcatagttgctaacaacggtcatcctgccagttttttgccatcgcacgttttccctgttttcttccgtattgtcgaggagcgctgcgctgtttcgttactgagaagaactgtttttttggcatttcctggtgagcgatccctacgttttcgcttgtagtttctttttgccgccgtgctgttgatccgaatcttgcgaacccacaagggcgtccctgatacttctgccttcgaaaacaaaccagaaa

SEQ ID NO: 3519 - DNA, 2246 bp, Toxoplasma gondii
tggaagatttgcgtggttcaagacctgatctggcgctttcttgtcttcgtgaatctgtgtcattttgtgtttgtttcctcttgtgaggggaagtgtgttgttctcaacgaaatcataatcttcgtccgcgtcctcttccccctctccccttgctttctctgcttcgccgcgtttcgctgctgctcggaggccgccccagcaagagctccatgaatattgcagcttcgctctttcgcttcgcttgggagacgctcacagcacacccgattcaacttgcacagaaaacatcttttctcacttgtgcacccttgcacgtttatatttatacctattatacatatatatatatatatataagtatatatatacatatgtatatatagatagacagacatgcatatttgtgcattgatatgcacgtggaagtacactttcgtgcaagagttcggcgcagcagattgaggaactctgttacatctaaaacaacacgagaaacgccttgaaaggaagcgaattaaaaacatgcatgcaaccaactctcgcccacctgtaaatcacaacaatgcagttctagcgttcataagtaaactgagagacatcatcctcgcacggtctggacctctttgtttcctcagagacagagctacagatagataagagtgtacttagcgtcgcgcggaggtctgtggcatcgaaagttcttgtgattcaatatcagtggaaactcacatctgcggcaacggaagaagaaggcagggccagaaatgagcaggccgtccctttgtgggattgtgtttggagagactgtgctttagagaactgctcgcatttgaacttatcgacaattgtcaccaagctacatgcagtctgatgtacaaacggtcaaaacattcactaacactgcgcagattaatacgtgcatgcttttttcttttctgtcactgcctgcttgcctacttctcttgacttcgctgtatttgcctgttgatgtcttccgctcctataaataacagtctaccgacgcgagtatctttgtttttgtctctcgaaagaagaatctcttcccagctcctttgtgacccacagatgatcataacatatcacttctctgcctctgcaatttttctgtgcgtctcggagactccatttaactctacggatctacctcgattccagtgtctctctgccggtgaagcctacctgcctagcggggctaagaagtcagaagaaaatgtgaatgtgcgaggcagcgatgtgtctcccagatgttgatgtgaacaacgaaacgtcactctgaagaaattttatattttcttttcgcgcgaatcagctctcgcagtctgccactgcatggcagctagcccaacttcttccaagctggtcgattaaaaatgtctcagctgacggacttcgccccgtcgtcttttgctactaatcagaaggcgtagaaagccaagaaaaagcggtttttcaggagaaagaaaggaaatctggagcgacttcgaggaactcctctccggcatcattgccctcgtgagcgacagccacgaacgcgcaactcgctccatgcacactttccagagaggttgaaaagacgcaagatgttttttatttcttcctcttttttcttccttccttcttgtccactttgtccatcctttctcactgtttttcggatttttctgccgccttttctttcgcgttgccaccctcctcatgtcccctcatttacaccacatccgaggtgctcctttcttgtcttgcacgagtcttcgtttctcagcttgcaagacatccagcaaaaccccgggcatgcggccgcctttcatttcttccaggcgctttgccttctatagtttttccttgctccgtctctcgtctcgcgcggtcgtacgttccagaggcgtctcttcgacgccttgtcccgtgctctctgaccttctcgtccacaacctgctcagttcatttcacggttgttcagaaccgtctaatcccttgctttaacagcagaacgtactttgttcctctctctgatagcgagccaatctccttgtcgtcctgattcacagaagaatgcttctctttctcgcattcgcggtaggcgaggaactcctctctcttctctccgtgcacgctgcttcttctcctctctcctctattcagcagacctccttgtcgttcttgcagaaaaaacgactttctagtcgatttcttcgagggaaagacactgctcgtgagacacacga

SEQ ID NO: 3520 - DNA, 2400 bp, Toxoplasma gondii
ttatgttcatttttatttagcacggctttccgcgattgcctttgcttgtggagatgagcaaagcaggctgtcgcgtggaggctaaagtgctgtcttgcgtccacgcagtgtagacacaggatgagagctcggggattttttaccagtttagcagagtgcaaatgccgcttcggtggaccagaaattctggtggtagggcagagaccgctcaagcgtcttggttgttgactagggaaaggacagctgtgcgatacgaattcgtggacggcatcgtggcaaagaaatgcgcgtatccgtcgcctttgatatccgcaaggaaatgcatgcacagtgtctgtgtctttatcgaccattcaaggtgtcgacgagtacatttgcccagacacctctactctacacgcagacggtgccgctttttctggtttccctccggcgttcctcttgcagaggatacccgggtttatcaaccgagttttcggtgagattgtctcagccttcttgccaaattctctggcccgttgtgttgcttttttcgtgacgtaagtctctcacatgagtcgcgatgaacaaagaagggatctttcccaatagagtctgcgggcagcgcggtgcgcgcgcgtcctcctttctcgaactctctcctccgcaacgctattgtctttgatgtaccatcatacggccactaacgagatcggtcgcattcgtttctgctcgtttgccgcgtccttcttatacagccctctctttccgcagtcggagtcgcgccaagagtacggggttcccagagaagcatcgacgaagtctggtggcagttttgtacgtttcgtgtgtatccgtggaagtagcacatatacgcaagagcgaccctttggcagcgctattgtctaactcatgcgaaattcgtagccgtttatttatcaggagctgcttgctgacatttccattaacgccatcgcgccgttaagagctgaatatgctgaccgtgtcagtttctcttagctggaagagctcaaatcttgtggactttctacactgaggtgaaacacccctgtctaattaagtactcatttgttcttcggtgacgcttgcccgagcgataattcaaagttgatagtcggttatgtatgtggtacctccccggctaagcgtcccctttcttttaaacgcactttccttgtcgccgttagtatgatctcaaagtaccagaaggcaagcgacgtacgtgaatctcggcccgcaaactagggcagcggcaacacagggacacacatacaaaaataaacagcgggacatcttgttggccttgtttggagtatttcgtcgctgaacaaacgcgtcttagttaactgtcaccacgaagacatgcattgtttctggacacattcggtgaacttgcggaggacgtacacgtgacgcaaggtcttcaggacgatttctccactgttcccagctgtctgggcgagaggccggcaaaatgctcgctttcagtttgagtgtttctctggaatttgagtgttcgcgacactgccgggccagcccatgatgtgcgccgtacgaacgcgcgaaaatactcctttgtctttggtcgtcagaaaacataagacgtctccgctgctatcagggcttatgaaatacttcttgtatccgagctcaaacccctgccccaaacgctcccctaccatgcacatcgaggcttgctgcgtgcatgcgttgtgccgatagacgcgggaaggtcggttgtcatggagggtgagagggactttttaacctagctctgaaacggtctagaagagggaacggaagcgcgagcgctttcacgttttgcatttttgtcaattcacggcgttgcttcagcgattcctcgcgacccggcaggcgaacaacatgcagctcgattccgcgagcttgctgccgcccacatccgtacgctcgacgaacctgtgcttgccccgctttttcgccctgtaggtcgctggcagttttctcccagaatctagactcggagaattctgctggggacaagccggcacagctgcttcaaaacgacatccgccttcccggctttcgttccggcatcgagcggcgcggaactctcttttccactgtggtcgatggaaacccgcaccccttcctacggacggagagagaattagggagtttcacgcacgtcgtttcctactaatctttaaccccagggcgaaacgactgctcagagtctcgtctggctagctgtcatctcaggtgtaccgacagcgcggacgctttacacgttttaggcgacaacatgcgtgcgcgttttgaggagcgcacagcgaaggtcgggtaggcttttttgtcgcgcgtttttctctcggagtcgccttcatagcgcgtttccttctgaagagagggccgggacga

SEQ ID NO: 3521 - DNA, 4383 bp, Toxoplasma gondii
taaccgtgacgaacggtgatgctaggaatttctgaaacgcactccagcgagacgtgaatgaacgcagatcgcacacgcacctggagaagctcacaccacgcgccttcgctgcagccattctggacagatgtctcggagagagtgccaggacaggctgcagcgtcgcgttcgcttttcaggagaagctggcggagttgcgaggccacggcaacaaaaaggacaacatctggaggggagagcctggacactgaagtgagttgtgacctgaaaaacttctcttccgcacgctggataaggtcatggcggaaggccgcggacagctgagcgcaggggatagcacacagcggcggttacgctctgggttcgcttccatgacaacattgccagcaacaagattatgagatgaacgtttctgtgacacaaacaactcaaacgtagtgattaaaagtaaagatacaaacagttttgtagcagccacggtttgctttgcatcctgtcgtcagactgatgaggcggcgcgcagcagcacgtgaacagcacacgcgattgcaagcgtcggggtacaacaacagaacacacatggtacggtaaaacgcggcgagaaaacagcgtttagactgaaagcgaaggcgctcctgagaagccgaacacggggagtatgtatcgtgtacagaagcgacgggattcctgacttgagtcactcgcacatacctgtcggcaaaaagtagaaaaagcagctttatccttgctgtcctccatttcgaactgttcggttatcttttgcacgatctgagggaacacgcgtccacctaaggaggaccgcagaatagaaatgttttttcttggcggcggtacgatctcccgatgagtagctgagacacgccgctccgagctctggcagactggacagccacatgcaagcgcagtccccggagcagagaggcgctcaatttgacggtgctgacttcagaataaaacagagaaacaaggggggtccgcataggatcaagcaaggccgaaacctatgctgcaatgctccgatttgtgtctgggcatgcgcagcccaatacaagagatatgcctgcgcaacttcgactgttgagggaaaatccgctttcagcaagacatttccgagaataaaagatgcgttggcatgcagtgagattgctgcggatgcaagagccttccttcttccgcgcgaaatgacacggagaatagcaatacctctacccgcgaaacttcacagcaggctcgctgtggccgcgcaaaggtgggcgactgcagtatcgattcacgcgaccgccgctatcggcaatcgagtagagcatctaaaaacgaaaaactgctttcgtgcaagacttgaaactgccatagacagaatatatgcagtgatgactaggtttgcctgctgtagaccggtgtcagagagcatactggaccactcaagtaccaagcccccctggcaacacagtgcaagcttatggtcatgtgcgcgttctcaatcacatgtatctagacgatcgcgaccgccgctgttggagtcggtctcgacaagatccttcaaacacagaaaaaggcatatgcatgaaacttgaagagctgtttgacgcctctatgaatgctctctcttggcgcgtcccgtctgcagcgctcccagttgccacaaatcgttagacacgctgcatgctgcagcaatggtgtcacctccgcgtgagttttcaggatccttcattgctgccattagatgtcctgtttggtcaatgtggatcagcacaatagaacttagattcggcaaacaaagaggccttcacgatctatgccaaccatccacttgccacacgataacgcctgcgctcaaagatgccacgtattttgagcgcgtccttcagatggatgtgcgctggcttcaaaaatcaaaggaagcaaagactcgatacaactgccattgcccttggcggggtgttctctgtgcctttagaagaaggacaacacagcaaccatctggaagaatacgtgcaaggtgcttttctgggctgtgtaccactcgggaagttgcaacctgcgactgagacttcttcactgagattaggaagagtccgtatgaactcgcagcatccgaatttggcgtttgtcctatgtggagaacacgagaaaactagtttcgttcaaattgacgtcacagagagaggaacgaccacatggattctcgcttgtgaaactcccactgtgtcgttagttcacattccgtttctaccggaagcagaggtcttttcagaactcgtaaagagagcagaagcctgcgtttcataggaagagtcatttccagcgcaacagtgacacgggtatccatttgagcgtatccgtctggttattcagaggcattaattttctgtcgcgcgaattgcacaagcataagctgctacctcatatggtacagttttggtggcggcggtctcactgagtggaaagtgaggcttcggatatagcgacgccgtcaaccacgaatccctgggcaacaatggggcgacggtgtaaagcgaactgaattgtagatcgtgatgatcaagtggatgcaccttggatcgaaggagaaactctagcagtcggtacaagatctcgggagtaaattgctgttaacaatagccctccacgggaggggtgcagtgaactgaaatagtatttagagtctcgactgtgtgcctgatgttcgtgttttaggctacgatgaaaccctacctcatcttgtttcttccatttatcaagtacaatcatggatctcattgacgatagtgcagatcaagcagagcactaacggcatccaagaaccagagttccgtgatcgatggtaccgtcggtgccatgtgcgtgatatacctgatgcgtgtgctgtgatttgagatgccttgttcatttagcatacggaggagctagaaaatcatatcccggtgctgtggggcagcagtatcgaatacgattataacaagcctttgaactagcgtataaagtgtgacgcaaaaacgaccttaccccacgatacactcagcaattacagtcttgccacatgtatcggcgtttaaatcacagccactttgagcagtgcgactaccctgggactaacaagaaggcaatatgccccatatggatggggctggtcgcagcaaggaaatggtggcgcggcgacacagtgggctgcgtcacactcagaagaacaaagggaagcaaacactttcagtatgctgaacacacaggaaaaatcttgcggtcgtgatagaagttgcctttcgctcatgtggtcgaagaaaattatattttcatggaacgaccgtaatcaccacggcactaggaggccgacttcatacattgtcaggcctgtctgtgccgtctgtctacgtaacatgaatggggctcactgtctgttcatctcgcaaagcaagaaatgacgcggctattttggtgaaacaaattagtgtctcatgacgttcgttttcaccgggtcaggcggacctttgaaaccgaaactcggttggcgcctctgcctacaggcggccagagggtgtagacccttagaggtcgttcgacaagagtttttccaatgtctggcaaagcattttgccatggcagttactctgaagcagatgaaacgtcacagagtatcatctctatgcgctcaacattatactggttgatttttactctgataaagcaggctactttctgaggcacatacgctgtccctgttgcagggcccgcatagacaacagcaaatctcgcttttgtggttgtcttcgaaaaaaggatctatgttctcaccacgcgtccgtgatgcactcttcagaacttacaggactgtttaggcagggagaactcgtagacgcagcggagaaaagaaggtagtgtagctggcggacggctgccagttagtgccgctgcaacgtgtgccacaggaggtcgggcgacatcgacggcccggcacttgccagcgtcctcaggtggttgcttcattctgtgcctcaagaatgcctgggcctcgaagattcctcatgctcctagtacctgtttgcagaaataaacaacacttcctccttgcatcttggatctgtttttggtttgagatatagagagtttaccctcttttgctggctcgtagcaggcacaaccccaccgggcccctctgtttcgccttgcagagcatgcagcgttgcatgctcaaggcgggggctgtgtccgagcacgctttcacgggccttgctgtggctcttcgcctgcaaatagattgcctcctttgccagatgacttgcgcgacgcccagttcacagttgatcggttgattacgctgtcacacgtgcccgtgcgtcaggcaaagcaactgcctgctggagtaaa

SEQ ID NO: 3522 - DNA, 1292 bp, Toxoplasma gondii
gacaagacagagaaaacaggaggaagaaagagactcaccgcatcgcgtccaccagtccccgcgggtcgatgggccatccgttctgcagggaggacgaaaagtcgaggagagtggagagaaccagagacaaagaaggtctacaagagagcgcagatcgagacgtcctccgtttccaatccgctcttcgtcctctcttccagttgcaagtagcctcctcctctgcttttgacctcagagagaacagcgactagaaccttgtgccgtagacagagtcatgggggcttgtggaccggagctgcgataaataaaaaatctcttgaaggctcgtccattcgcaacttaatgccacacaagcacgcgagttttgtttgaaatttagaaaaagaggctttttcgcttctctcttttctcgagatctgcgcgttggcgctgtcttctcttcagaatcccctttctccatgaaatgtcgttctcctctccttgcttcttctctctccggtcacaaggagaccgggagggagacaggacgagacgagagcggtggagaaaaaagctggaagcgaaagaagacacgcaggggaaacccaggaagaagcgagagacgcgcggagcagagagagggcagaagaggaagaagagaaggaaacgagatgaacggagaggaagaagagaaggaaacgagatgaacggagaggaagaagagaaggaaacgagatgaacggagaggaagaagagaaggaaacgagacgaacagagaggaagaagagaaggaaacaagacgaccggagaacagaaaatgtctcttgactggtgagttttgaaatgaactcggcgctcagctgcgacagtggagaggccgcgacaccatcgaagagtttcctcatagagaagaggcaagacgaaggagaatgagaagcagtagagacgcagatgtttgtctcatttcttccagacatgccggcaaacagagagcaacgagaagccgcagcttcgcgtctccagatgtgcgcggcgcatgcagaaaaaaaacatcgcatgcagactgagacggcatttttttcagtgtcccccggggctgtttggagaggggagagaccaagagagcagctttgcaggagtgtagccggaggcaaatctggataacaggaggcagcaaagcagaaaagaggcgggaaggagctagcgggagaggaggaagaaggcgtccttgcactggaggccgcaggtgagagactcaagaagacaaagcaacctcgaggaagaagcgcgacggaagaagcacagtgtcgcca

SEQ ID NO: 3523 - DNA, 4281 bp, Toxoplasma gondii
gtgaaagcaaagacacgcaaactttggcagccgatgcacagataccggagatacgcaggaacgagatacagaagcagactggggttaacgggatcggagcctaaacacaaaagaaatgcgttttgtctcctgtgctgacgagacacaaatgcgcatgcatcgttgccctcctctcaccttcttccaccattgtctttatcaacgcactcatggaggcgacctcgatgtcaacatcaaactcgtctccctcttgcgagacgagagtgaccttccgggcatctcccattctttcttttgacatcttcggagaattcttttagcaaacagcgccaggtctcccgacgacgaagacagaaatggcaaagacgattcagagttccgtttttgaatggggtatgcgtttactgcttctgtcaggtctacgcggtgtatctgggccccccaggtaagccacagacctatttcgccgtcttccgggggtaaaacgagaaaccaggttttcccctgaaaaggtcgaaaatggcttttcgcccgacaaacacaaacagaaaattccagcgaagacagtctcaaacagaacagcgtcccgacagccagaagttaaacacctatccttttgtcggggaaagaagttcgaacctttctcgggaggaatgcagacaacggaacttggaaaaagatgctcaacaggagggagtgggcgtgccgtggagtgtcgccttagtacaccaaacaaagaaagggcatatctgcgtgcatccggtgacggcagaggtgtacgggaaccagaaaaaagattcgccactaggaagggaagagagttctgttacctttcttgggcggcttcgcgagaaaaagctagaggggcacagagacaggaaacgtgataaaagatggtttgtgacaaagggggacgaaatgcgcgctttgtagaaactcggggaagagtaaagaagagaaacgggaagaaagaaatcagacttgttggcgtcgacaggtcttcgccgccacactgaagtgaagggggccacgggggttttttgtaaagcaacagggagcgggaaaggacaacgaaaacggtgaagttcttcacagcgtgtgatggcaaacacgtctctctctgaaagagaactgctgaaattcaaaaaatgaaatggcgtttaaggtggaacgaggttacttctattcagtattttgcagcacttatcgcttcctggcaaagacgcgaacgcagtgcaggtgccccttggataacgagacgcaattcctaaaagaaaaagcgacaacattcgtcactcacttttccctggcttctcctcggacgcaaagaagtctgcacacaggaaccacaggacgacgtccgacggacgctgtcgctttttgtatgcccttcgctgcatgcgcttcaaagtggggatagggtgcgagacctgggattaattttgatgtttgtcccacaacacatttaaagcagcggttcttcacttcattaatttgttgtttttcatctgaaaacttgctttagtcgacctgtgggtgacaacgatgcaaagaagaaactacaaccggccgcaagaccacgaccccctcgcgctccggcgtaacggtccggtgtttgactgctcagtgtgtcttgtacctgtttccgtcttttccttgttttggtggacagaagttgatgaatgcatggttagcggaagggatagactgaaacgaacagaagggagcttcagttgacgcgggaaaagacgccgttcctcccatggtctttttttaatcttgaaaactgaccgcggtagcatacagacgcagcattctccagctccgcgtccagcctgctaacagagtccatgattatatcccttgagtcacaaaaaggatcaaacggttcttgacgtgtcgacaggcactatgtctgcacatgtgtgatcatgaagcgtacagaatttgataggcaaaggcgcttctccgcatgaatatttactgagaataaatgtcaagtgcatcgaagcgctgcaacatacaccctggcccagcacgttgaagtatctagatctgcatgaagtggaaggagtgcgatacagttatggggatagaaacacaaggtcacgtaggtgcatatctgtttgtccttaaagagacgtatcgacagacttgtacaggaagttatgtaattgacacttgcgaatgtttcctctgttttggggaagggggaattgagacactttgaggtgggcggaacggacgaaaacaacgatacgggggcttgtggatccacaatgttgcggggtagagcgccaaacgacgacaattcctggtgttatgactaaaggatgatgaacgaagggggtacacttcttgaagaaggcaagcatgatttgaccaccagaaagcgttatcgaacgcatacaacaacgcccgacccaatcgcaccgcaagaaatggacttgctgctcggattcgggaaaactagactagtcctctaagcgaaatcaccgttgcacctgggtcttcgactctgaatcctggactgtgagttggagagtgaaaaccacagcgaacgcttgctcaaatgtcggagcaaacaccgcgtctaagtccacactctgacagagacgtatgcggcggcgctgcaaccgcttctcgcctgtcgtgtaaagcgaactcaccagcacctgtcagtctctaattgaacctttctgaagtcgaagccactgagggatgaaagccgcgttcaactagagccactcccgcgaacggtgtctacgaatcatctacaggaattcgaaggggaaatgagtgctaatctctcttggctctgtatgttgagatatgtatcaagcagaggcgagggggctggtagctttttgggtccatcatcggaatgttttacggggaggctgcgcacctcgatggcggctggttacctcctgaggttgtaagactcaagggaatagcgtcttgtacaccatatcgtttataagatactctcaatcgtttttccgaagcattgcatcctgcgggcagccacgacggggtgcggaacgtggaagacagccagacagacctcatccagagacaacttgctctcctacagactatcgctcacacgaacaaggagtcagtgcgcctacgcagacaactgtgccacgaatccggagaaaaggcgtccatccgtagaacactaaaggaacagcagtgcaagcgacgtgaggctcggaacacagaggcgctttttacacgaaacaagtggccaaaggcccttggtgcatgtctgtaactacgattcacatattcagagcctcagatctacctggtggaacaaatattcaactctcgcacaggctcgacatccctcagactccagcattcgagtaaacggccagagtaaagtgtgagcctgggaacggagatgctgtgtcgttcttaacttctaattgtctcagaattgagatacgaagacgagtcaccgagcttcgatctcacagaactccgagctggactaccgatgtagatcttgaggatctttgctttccagatccaaggtctactgtgtttgcattggttttgaggacattcagtcattcaatatatctatgagcctattccgggtacaccctgtcctgtatcagagtgctttacatatccattcgtctcagttttggttcttagttgcaataacctttgcactactttaaactacaagcgtcactcggagagcctttgagtatgatccacgtgaatacagattctccagctgctttaagcgttcgggttgatgtattctggggcagtattatgttaatcttctttggtagcacgcaaatccatctgttccctgctggtaaaccaggtaggggctggtgtcgggcgtagttaagggtggttcctcgaccgagactaatctccggggaattgtcagtttagctctgacttacggtttctagaagaatgcgcattgtgagctactgttattttgacatcgttcagggaaaaaagtcaaaggtgtgagtcgcctcctccttttgttttcttttcctgcagttgcagacgcccggagcctccgaaggctgcgcatgtgcatgcaatgcagagatcatgcttccttctgcatccattgccgggtcgcacacgcccgggaagatagaattcacgcgaaaaacaggttgaaggatctttaggcttctttttttctattccggtaggaaacgttgggctatgaagttgcctcaacttcacgtggttctctgtttcttccctctccggttctgccccatcgta

SEQ ID NO: 3524 - DNA, 4464 bp, Toxoplasma gondii
tcctcactgagttgttttcgtgtttcgaacgctggaggcaggatgtggaggcagcgctttttgtggttttactgtcttcgtgctcgacagaccgcaggccaagaagattctctggtgtcgagcctggaggcgaagacaaagggcgagattgagggcatcaagaaagactacatggagaacaaagacaaactcatcgagttcattcacagaaaagtcatggatgtcgatctttcgttggacacggaaacgattgctgttctacgcacttgcgacaaacgaggcgtcgcaccgtaatttggtagatatcgacccggtgtttgggaaaaagctgactttttctgagacaatgcaatttacggtgtggaacatttttctttgcgtgcacacgagcatctgcgcgtgattgtcttccggacacccagacgcggctggagtgtcgaaactctgcggacttctttctcccagctagatgccgaagcagagcactccgcatgcagatgcacgtgttcgaggaaacggacgaaaaggcgacagcagactctccctgagtgtactcggggcctatgataccttcagtataagattacggggtgacaacaccaaagcagaacaccaggtcactggacacacctacaggaccacaccagagaggtctgcagaatgatatgaacagcaggctttcacaacgctttccgggctgtattctgctaagccgccaagacggcaagacagaaaatctacgcatcacaatttagcaggtctctgtaaaagcaaatgctgccgaatagacattggtctcccaccaacgacaaggtccgcattttagactacaggtgacgtcgaatttgaaactccagtcaggattacagccggagcatttattgaaatgctcaaacttctctcgtatgtttcgcacttaaaacctacttccaattacttacccgtcacacgcctgtctccggagggtcgctacagcatcagaaggctcctcccttttggctgtgcactgtttcattagtattacagacactttccaatcaaactttataaataccatgcagtttcattttcgaattgctgcaatcctatgtgttgaaccgatgacgacactttcgctttaacgtcttatccagggcagtggaggcggtcctttgcaacatcgtttccgactgctacatacgcagaaatgcttcgtcggtgtcttcacgtgctcaaccttgtcagtcgtctagctaaaaaaagccttacagtgaactccggagagcgagtaggaccacacaacgaagctcagatcattgtagagcggattatacgttacagcaagactgagatcgtcgaagagtgggtaccatacaacacatctcagattttctgcctctcctttcgttgcctgttcgttgtgagatgcacatcggcgacagcgaaacctggttcaaaccaccttaaacacatgctttccctcaactcgtgttttcaaagactcacattttaccgtgtctgaactcttatcgctggtcctttatcgtctgtcggtttcaccggaacaacacaggctacgccgtgcacatggctaatgcgttctttcatacacgaactttcgctaggacggttgattgcttcctctactcctgatccggtacacattctgggatttcctaatggatagaaagtatacacggcgttcctcacaaacctgcagtttgaagcagtccgatttttatcgaagcagttttggtgcccaagaaatggcttcacttcccacatgaagagagcgatttctgaacggcgggaatatgacatgtgcagtaaaagttttctccaccatgccacgtaaataccttgacaagcggttcgattttctatgctctaggaaatctgttgttgcacgattccaactgaccggtttgctcttcggcggggatacatcggcaaaaacaggtcaagtgttcgttcagattaacaactgaatatgtccgagcaacgctacgccagctcttgaccctgctgactccaggccaagaagacatcggcatttctggagctggcaaatatctttcataactaaaaacaatatcggaatgctttcactggcggagcctcataacataaacagaggaaaacttcttttctcttttacaaacgtgttacacatcgccgatcagactatttcgagtttcgttctcagccggtctagcccgacgaggcggcgacacagatgtcgcctgacattcagcaaatccgccacatgggccaccgaatcccgaaaaactgttttttcacacgattcggaaaaaccaaacgagctccatagtcccgcgggaaggccccattggatggccgcatcttcacgagtgcttcaagtttgtcctcggttcccagaggtacgcgagtagaaagagacaactacacactttggatctttacaggacgctcgtgttgcccgtcgcatctggttgatctcttctcagcgtcaaacattaccaacaaaacttgtctcgcccttgcttgcaccgttcgtccagtctctcttcagcggtcagttcgtggtccgcttttcgggaaacgaccttgtacccccacatacccgtcttctcacggaccgtgacaattttcgcggccttttttaggttcttctgaagctgtctggaaacctcgtcttggacgactttgtcaaagtctccgtcggcatcgcctttttgacgctttttgtcgcgggtggctgccttttctgctttcttgcgcaagatagccccttcctttcggattgcgaacgtggttgtgctgacgagatcggttgaaaagccatccgagacagtcatgctgcgatttgtcatgattttactgataattcgcctttccacctggtgcgtgagcggatgcttgatcatcaaaacgtctcctgcttcacactggtccatgaacttggtctcaaagccctgaatggtgctgccgctggacacaatgcggccttctccttcgacctcttcaacgtcttccagctctacttcctcctcttctctcacctcgtcatctctctcccgcttcctgttcttctttttgcgctccttcttcttctcgtctttcaaactccctcggcccttaaacaccagggccccgctccttcgctcgtacagactctttgtgattccgtcagacatcgtggacacaaacttttaggacacgcgaggctgcggtggtggcagcacaccgccctcgaccctactccaccccttgaggcttcgcgtctccacagtttgctgacacgaaagttaaaacgctttactttcacagcgcctcagggacaaaagccccgtatgaacgcattcaagcttctacgacccctgaaaatctgtccacgttgtcgtcacgcgaagtcggttgcaagtcagttcgcttctttccttccagacgtcaacaagccacgagcaacacataccgacaaaaacggcgttgaccagcggaaaccagttcagctacgaatcggttatcgtacctcattccgatcgcgacaatacatcgaccacccaagcgacacgccccaggatagagacagacggcggaagtatttcctggaaagagggaatcttcacgagaaaacatcattgctgacttttagggattcggtagtcgttttccagcagtttcttcacatgcgcctgcatgacgtcgcccgtaccacgcatgcatctgcacactcgctgtataaagctgcgcagggcaggacactgccgtcgaaaaaatgtaggagtgaatgtagacgcgcatcactgctggattaactggagcgaaggtgtaccacttgacttcttttctctggcattttgtgagtgccatcgtttgccttcttcgggaactgtagcgctccgactgctcgaccacagggacggggcagagtcgtgttcgcgtttcggggtttaccgctttggtttcgtgagagatcaccgccactggagactttttttctcgaggaaaactttcctctcagcttttcagggtaaatttgggaaattgcgcttttcttcttccttgtgtacgggagaaacgtcgcgaaatacacttttcactggtgcggcgtagtggcggtgatgccacatcatgcagttgaatcattcagctaaagtcgatatacagatcattcatagccccgtccgtcttcctgagagtgtcaactctgttttttgtcgtacgagcaagcgggtgcttgctgcggaaattctcgggttgaactcttgccgaagtcagttctggatggcacatggctccggcgaatcttatttgagtgacaacaatttggcggtgacgcaagcttgcctgacgttgaacagatatgctatttgtgttcaacggggggacgagggatctcgcttcttcggcgtcgaccaccaaccttgtgcaacaccgctctcttgcagctcgccggcatccgtctctctgcggtggagtttcctgcactcctgcgaacaa

SEQ ID NO: 3525 - DNA, 3403 bp, Toxoplasma gondii
gtgacttctttgtgtggacaatgaacgacactctgcagcacctaactctctgcgtacacatctcagtcacaaagagaaaaaatgctcgtaccactggagatcacgcgatgccaggccttgagtcggtcttggtgaggaacgaacgcgacgggttctttcgacgagtggctcagcatcgaaatcgcactctgcagttcatctgcttcctctcgagagtggacgccagacgctgaggtttgctcttccttgcacacccgagtcgcgtccgtttccgtcgagtttccttcagcagtggatttcttcgtttgcctgttctttcgcgcttttccgcgcacagatatagccacacgtccgaggagaataagtgaggccgcttggcttttcgtgtcggcaaggcctcgctggatcagcaggtcgtctgcccggattctcttggaaatggcggacttgttgacgcctggaggactccgaggagccgaatagcagcagtgtcttatccgatgttcttcgctggcgaatggctgagaaaacgcaaacgaaaacgcacggtgaaccgggcgcctggcgcgtcggcccccctctacatgtcccgcgctcagtttgcctgttgcgaacggaggcgaggccacggggacgagtagaaacgaagggcaaagtgcacacgtagatgaaggaagaggcgcatgtgtcgggatttcagtggagactgaaaacgggctaagtgaggcgcaattcatcgaagatttcgacgtggaaagacgcgcagaacgacaccttgacagtgagagggggtgggtggtcatgtccagcggacggcggaactgcgagtcagaggcaccgacatcgggtaacccaaaagtaagacagaagaggaacgcaacgaacaataagaagaaggaaacgtaaagactcttggaaggcaaaagaaatgatctggtccacacgccgccgcccatcgcgccgcacgcggcactcgctgctgtggcacacgtcaccgagcatgagacccaaccacgggcaaaaaaggaatgcaagaaaaacaaggagcatgaaggggggtaagaaacagaatcgccttcaccacatgatgaagacggaaatgatctggagtttcagctgatgcgaaggacgcagtgactatctgttcacatgcacaaacggatctcgaacagcagcgtgcatgcgaatgcttttgcgttctgaaaactttgcttttgctgtcatgtctcccgctgaagagcacaccgttttaccgcctgccattgtgtacagacgaggcgaagttgaccttgttttctctgcgaattacggtggaaggaagagagagcgtgtgtgggcgcttcctggtcgagatgtgtcggcactatggacgaagcctgctgttgatcgtgctcagaatcacacagaaccttaggctttgtttagcaaaaaccacgttaacacaccagcgacacacagcagtcactcctctgatggtgatggcatgtgtaccggacgccagcgcagtttcttacaaccgtccacgaggtatgtaactcagtgatgatggaaatccttttgtcgttttctatgagacatagtagaaccatgtaaaagactgcaagtagttggaatcctataaaatctggcaagcaagccaaaatggcacaactgaatttgtgcctgcagccacacttgacagccaggtcacggtgccggggttgctgctggacagatcaacacacgcaccgagacacttccttcacagagtcagcagctgtgttgctatcaagggatcatgcttcgttcttatgatgaaggaaagagtagaataaggaaacagtaatatagacaaacggcatacaggtggaagtaggaatgacctgggatcgggatggtcgttaaactccggtacagggctacatcggtgaccatcgcataggtcagtcggtaaacagtcgaggaattgtgttggtttcttcacatatctatgtttcttgggtagatgcaggttgtgtaaacgtgtaagactcactagcagaaccacgaacaacgtatatgcgatgatactgacagtcagcaccggcagtgtcgtctcaaatcagaaataaacgcgcgacttgcggtgctaacgacttcttcggcgaaatgcatgagtgattatatgcactacggtactgcaaagtttgttttattgccaagggtattttgccaactgcctgaccgtccaccagggagagcatgagacaaaagcacggcgagaaaaaatagacacgctatagaatctaggatgctgaatattactccaatcatgacatacagacgactgacttctttgtggttactgtacaccccaatgaactgctacagacagctacaagagttggatttcaatatccttcgacattaagactattccgagtcggggccagtagagtatcgaaaaagcgcatgtcatagcagatgagcacgcgcaatgcattcctggtcgcagaattgtttttgggtgcatgaagtcccaggtgccgcgaaaccactttgcgccgctagtcccacgagacccatgtgtcggtcaaccagcccgacacaaagacttgctgcacttgtagaaatcgtacacattttggtgacaagcgtggtactttttcgttgtgtagtgtcagccccagcttcatcgtgacgtaccctgagtcacatactcttgacagtgggagagatagcggcaaccgccgtagaaacctgcttctacacaactatcgtgtaaagtcgtaatgagttttgaaaagtatagttgagttgaacgaaacgaaatccttcccagtgtgaaaaagtcttcagttttctgaaagccgattcatgtatctcgtcctcacgccgccgtactcgttttttcctcagcggcagtcccgtgtagatgcctttcatgttaatgcggaatcgacgctcccagaaaagtcgttttttcggtttcaccaaatatcccagcggttcatgtttcctgaccaatctctgtcggggtggtaaagtgtgtggcatgtgtctctgggaatgaacgtcgaccatatcagacagcatgagccctagagatgcacgagacgtccccgctcgaccctgcaaaagtcgtctggaaagtagcacctgagtgtgtacagttcttaaatgcaagaactctaagtgaagttagcaggcatcgaatttcgcgtgacttcctcacagtggcgcgctgttcacgaaaaaaacctgctctgttctcgtccctcccttctgtctgaagcgacattccgcagtttcacactatttcacctgtcagtcgcgtgaaactgccgtcatcggcggtagtcttttcccgggtaacgacgacctgaacggaaagctgcttctgtaggtacacccgagcccaagctgtcacggagcgttcgccaaa

SEQ ID NO: 3526 - DNA, 1180 bp, Toxoplasma gondii
aaaggaacaagaaataggagaaaatcagagaggacaacgaacgccgagaataacgaaagagcagacagagaccttggtggcagaaggggagacgaaaggagactgcgattctggaaaagctgcaaggaaattaaaacttcttcagctccagattcgcactctctctctccttcctttctcgtgaccaaacacagatatatatatatatatatacatacatatatacgtatacagagatatgtagatagatcgatatgtagataggtagagattcgtagatatgtgaatacagatatgtgtatgtgattatagagatgcagaaatatgtcgaagttacatgagttcagtgctctgcttctctcccttgtacacaggtatgcgtatctgtggagtacagtgtagcccgcaagagccaagtataataagaagagacggtcgagagcagtgagaggacgaagtttgaggggaagaggagtcgagagattaacgcaagatgcgaaacacaccagggagacagttgcgcgcggcgactcttctcgcgtttttttgggttttctttggtcgaggaagaagtggaaaaatagaaaagaaagacgacgtccaccggcctcgtgcggtttcttctcagttttctgcgttgacttcccgcgtctttttttctttgtaaagcatgcatgcgcatgcagcgctctctctaatacgtcccactgtttgccgcgtatttttccttcgcagcttctctcgcgcctttctcgtcacactttttctttcgcttcttcgttttcatttccgtttcttctgggcgtttcttcgcttcggagaagctgtccagcctttttcgtgggggtttcttcgggaccgacgggatcaagtgagaatttttgccatctgtccttctttcccttctgtctccctttttttcgtcgaaagaaatcgttttttttttccttttttctcggactgcgccttccctctagaccgtctcgccaacgcctcctctctcgactctcttttgccaatccccatcccctgaggttttcggttttcttgcctctcttccggtttcttctttttgcgtttctctcgtctcgttcgttctcggcgccttcctgaaacgcgtttccggctcttctcctggctccctgtcctgtcgccttctccgtctcgagaacagcaccca

SEQ ID NO: 3527 - DNA, 1880 bp, Toxoplasma gondii
ttccacgacagagtctgcggctgtctagaaagatcttcaaaagaagtcaggctcgcgtagctcctcgccagaaaaggcgtctgggactgccggccgttcaggacgctgtgctgcgacaggcatgagaggcgcgtgcgccaacggacatagagaatggcgtcagggaagccagcccaagaagcaccctgggcagcagccggttctgtttctcgcttttcgatctctcggtgacagggcggttgggcgaagcatgcagacggacaagtgaaaaggctcgaagcgccagagtccaaaggtgaggcgtagccctgcaaaggacatgcaccctcccgccaaggtgatgcggcaggttcccctgcatcggaagactcggcaaccctctcagtttgcgtcggcgaagtccacagtcgctcgtcatgaagacgcgaggaaagacctgtgcgagggggccgaacagcaagcggccgcctaagaagccgccggcctcggcttgccacttgccgagaaaggcgttgaacgcactgttcacgaagtcccccgaccatcttggctcacaaccatggcgaattctcccgttcaaggaacaggaagacacactgccagtccgcgttcggcgtcttgccgtgcttcccaacttgtcggataggtggagcagcgagaggcgccgtggtcacggtgtgcggttgagaaaacgtgagacgcaacgaaagggtcgagggtaggaaaagcgtttgcgtagaatttttgtggctgcagaaacacgcttcagagtgtcgaggacgagaggattgccgttctttgctagagtggaacgcgcggcggaaacgaataggcgaagctcgacaggtgccgggcatgagggatggatcggctttcaggaacttcgacgaagcgttttaacggaagcggaacctgagacacccgatgattcaacgaatttagagcggaacctgaagaacatgccagcgacgaatgagtacgtaaacgttgactgcaccaggggcaagaaaagaatctcttgttacgacaacgcaaaaagagactcctgattagtcacatgtgtctcctccggtcgagagtcttgggatcttgtgccgcttccgatttccgaaatcaagttgcgccacgttaaggcagagctctgccgttctttgcgataagtcttgcaggacagcacatgctctcaccagcgtctcaaagatttggcagaaagagaggcaagttatggaaaagggaaccgacgcatgtggaataacaaaattacaaacgcgcgagccttatctcctgtttcgaaaatttactccgctgcatgtgtatgtcctcggcccgcatgcaacggcgaggtatttgtacagatggaagacggacgctctttgacgaagattctccatatttggacagaaacagtttgttgcgttttcgtatggcttttgcctgttaaaaggacacggacacacactgcggcggaaactgcaacattgctgtcctcgggacacagcggcgagatgcatgcacagtgcgccgcattccacacgtagagacagttttccatcgcaacttcttgagaatacggtagatctcgacgcagtaccaacacagaagtgccacaacttgtggcgtaggtacagacaagaaacgccctcgctgtgctttcgctttagcctcacgtggaactggcttatgctgactcatctgttcgcggtatgtttcttttgcttctgaatgacctgccgcgcgtctcgaagaagcaagcttgtcttgaagaaatgacggtttctttggtcatcgtaagagtgcagttgccgcgaccaatccactctactctcctgtcgcctagttcccgccccttttccgtttcgactcctgttttcgctcaacta

SEQ ID NO: 3528 - DNA, 2210 bp, Toxoplasma gondii
gactttcgactaacagaacatgcgcgctgacaatctgatcttcggcgcgaacaccacgtgcatcgacctgcatgcaactcgaagaagtccactcccgaagtcgaacgcgagaggcgaaacacacatgtaaatatatatatatatatatatgtatatattttcacttgtgtgcatgcagaaggccacacaaccttacatgcacttgctccgagaaacggatgcccctccctgaaagactgtcacgtaagagtcggagtcgacgggagtctgatctcggcagagagggaagctcggagattccttgttttttaaaagaaaagcagcggcacttgggcggacaagcaaaagcacgccatgtagacctgcggtttctctccaatagacaggctgtcggaacagattctccgatgtcttcaacacctatgcgttggctgcatctccccctcgaaaaaaagacgaaggactgagagcaacaagctcggactggcgtgtttcatcgaggagacagacgagaagatggacgcgaacttgcccaccatacacgaagaaaaacttgtttcgacgcctcgaccctgcgtcccggcgtcacgagactgcagggaaggaagagaagaaacgcagaacgcagtcgttccatcaaatacttcacgccaacaggagaggaaaaagcgcgaggcatgtaccgaatatgagacggcgttcagattcgatgcgaatcgacagctgcgctgttaaggcacacaggaagtgtcacccacgtcgacggcgtacgcagcatcgacctccacgacgttatgccaaggaaactctcagaaatcctgtttcttcacaaattctcggaggaacgtacacttcgcggcgcgcgcgaaagtatccagtgaacaggtgcctccagaagacgccgttccagggtcggaggaaagcgaagaaaaggcaaaagagacagaggactaatctttcgacaagactcgactcaaggagcggtcgaaaaaattctcaagaacgacgcgcggaaccggcagaaaacgcaaggctttcccttcctactcgcagttcgggtcctccccgagctgttctgcaggcgttggtctgtgactgggtgtttctcgcggtggtttcgaggatttccacacgttttgcacatctcttggcgtacaaacggaaggcagcacctctctgcccggattcgtccgctgctgcgggagtttctctctcatttgtcgcgtttcgcgtcttgcgaggagactccgcggcgccacgtggtcaacgggacgacgcagccggtatgtctcattcacaagaaagcggcaaacgggagaaggaatgatggcgggacttgcgtctctcctcgagaagcttctcgccgaccctcgagttcgcatgttgctcaccgtatgcatgcagcccgacagacagtcgcatgcagctgtgcacacaagctgacgtgtttcttccggacttcctcgtgtctgcggcgaaagggctctgccgaaatcgtctccaccgagaagaggctccgcaaaaaagagttcctcacttcttcatctgatttgttccccgggctctcgttcctccctctaggaagcctgtgtgtggatctggggcgaaacgctacaggagacttgcaaagcagctcgcaggcatctacaggtgaagagaaacaaagagttttttacgaggtgtagaagtgcgtctctcgaattcgtgaaaggttccacgcgattgccttcgccgctgttgcctccaagttgccgtgggcgtggctagcgaccacgacagtgtgttaagcgcctagcaaaggggttctttccttttttcgatctcgaggctcggcacttttccgtcctctgagagagggagccttccttgtgtttctttgttcgctttttcagggactagccggaggagagaaaacgcagcttctgactcttcggccatctgatccgcatgcgaaggcgcgccggtcaccagtgtcctgtctttcctcgctgttctctgttctcttttctcactctcaggctgtgccgtccatcgctattttcttgtgatcctgttggtttgcctggcggcggcttctcaggcgttttaggccctctcttcgtccctctctctctgctgtgcctctgcgcccctgcccctctcaacggcttgcagctcttttctcctgcgttctttgtggaagaacgaggaaagaaaacactgcgttgcca

SEQ ID NO: 3529 - DNA, 1033 bp, Toxoplasma gondii
ctgcagcctcagcttcgctaaaaagagcgtcgcatctctccctgctggcttcgcccacgacttgcttgtttgtgcctcggacgaagtaaacgtacgaatggaactctgggtctcgcaacgttgggagaaagcttctcaactctttctgcacaatgcacttcaagaatctacgacgacgccccagagaaagacgattctggtcatgtgtcaccagggaatggattcgctcctggctgtcgacgaaattcattccattgaagagctcttcacaaacgagactgtaacttggggataaacaggactgcgattagaggcttctttgcaacctgccgtgctacaaaggctgctcaggaattcgggaaaatgtttgcatctacgcagcccgtaacgccttgcactctcttctcaagctttcaaaaaaagcttgtgcctcgagtgatcttgacggccttctactacaaaacattgctggctagcacggtgtcgacggcatccagtacatcgaagaactattcgggtcgcgttcccccttgcgatgaaacgctgtcactaaaaagaaaaggcactttattgaatactgccataaacgccgacagacgcctgcctaaaagctgtcaaaatactgttaacaacattgatgtaattctgtctaaaaactgcttaaaaggctgtttaaggtttaaaaggttccagtgctcaacagtcttcgcttcctgggggcagagaactcgccctccgtccaagaaggaacttgagagacggcctgctcacaggaatgcggtgcgttttcttaggacgttcttctttagagtgttccgagaaagtttcacttccactcgattcgggactacgcccacagtttccaatggcagacaggaagcgaatgagaggagaagaaaaaagtaaaaaccgcattcgaacgaaaacaccgacgcacagaggtctctgcttctgcgcgtggagatttatgcaccgcatgcacacagccacactcgctttagcgggtgtcatcacactgacggacatgcccaga

SEQ ID NO: 3530 - DNA, 1643 bp, Toxoplasma gondii
acggatcttctgtatctgtccttcgtctgattcacaattgtatctagacgcatgcatttcgatcggcagtgagtgaggagaataccagaatactccatttgcttcttcacatgtcggtaggtgcgtcctgaactacacactgataagagcctgtagtacgtcttcgaatctgaacgcctctttcctgattgtttcctcgtgtgacaacgcagacgaaatctattcgcatgttcgaaattccgaacgaaaacatgcagtcccgctgcaagcaagcacagattgaaaaagctcggaagtgcagaagcacagactccgctcacagtcaggttgcatggcgtctgcgccatggtcgacagagatcgaggaggaggatgcgcggaggaccaccgacactcagcagggcagggagaagaagcaaaaggcaagtaaggagagagggatgacgagcaatacgatgagggagaagcgagaagaaggctgtcgcggcgtgagtcgttggaacagacgctcagagaagggtgtcggcaacgcctttctctgccgggaactgcctgtcgcagagacagagccgagcggctgcttgggctccacagaccgagaggccagccgaaggggagcgcagcagggaggagccaggagggactgtgtatcacgcgcttctgcatcggcaccccacatgcgccgtggattgcacgagggcgacgaagcgactcgctgctgagtctcttccttggcagacgcagaaagagagagaacaagaccggcggatgttgcgcgttctacttcacggaagacggcgagaggaaactggagacagtcctcgaggagagagacaggcatagccactgccggagtctcggaggaatgcgaacaaggcccgagtgaggaaatcgaggaaacagcgaacaaggagagagaagggaagggggcgggagaaagagagcaggaaagagagcgagacggagatcaagaagagcacacacgtgtacacaaaaagaagagcgagcaaagacaagagaacggaaggggaacgagccaactgaggtgacccgcaatcaaggaacggcgggagagccgtgaaagagttccttgtcgctcacgagaaaacgcgaaaagcggctgaaacgaagtggagtttttggcgaaaaacttgaggcgagcttttgtgtgtaaaaaagctcgagtgtgtcaagcgccgagggacgcgtgtgacggcgcggagacgcgggcgacccagttttttatgaactttcctttctgaagtagaacgctcttttcttcgtttcctcccttctatccttcacttttctgctatcttctctcgatagaactctcgaactcttctgtgctgggcggtgtgcggcgctttgagtctgtgcccggaggcgcgagatgttaaacgcttttgcgcgttccttgcaggttgaacggcgagcgcgttgttgcctttgtgcgtcgacttccaaaagctgcgagaggaacgggagccagtcgcagtggctgccgcgtggtgacgcgttcttccccggtgtctgtggcgccgtcaaagaaagcctgagaagagacaagtcggcggaagaagcgaatttccgacaccgctctcgggtgtacgtacagctgagcgagcggtgggtccacctgca

SEQ ID NO: 3531 - DNA, 3515 bp, Toxoplasma gondii
aatgttggtttccttagcatggccatctgaggaatgaccacagcggcgtgcacgagtcacctttccagattccccggtactataccgacgtgtttatgacctcagctgtgatccgtcgtcagaaaaaggcgctgcatggcagccactcgtatgactctatgcagctggtcggcagaggctgagctaccgtagtttgagaaaacatacactttattctttcaacagttgacgaacctggtttcaaatcgtcgaacaggagataatgatcagcgtcgggttcgcactctacttcaatgccttctgtctcggtgcctccgccatctggctccaagtatgctcgaatgatcgatttcctgtcaacagcgacggttgctctgcatgaaacaacggagcagagttaccggggcggcaaccggtaggcagctcggagcactgtactagcaccttacccggggacgttctccagagaactaacgaagacacatctgctggtgcagcgcatgatagatctgcgcccaaaagcagagtagttgcaaattacttgggcaaccggtgacccccctcgaagagagacaacatcaacgagggagctcaacagctcgactgccttcatacgtggactgcactattttcgccgattcgaccaccttgaatgcctatcggtgattcaaatccggaccctgacagcatgaaggaagacgggacttaacgttttttaacaccacatcctccgtctgtttaaatacacttataaacaccgcacaacacaaaacaaatatgctggcactggacagttattccgtcacttacacaacagaggtttttgtgacaccgaaaaaacgggtggggcgagtttgctggacggcatccttgggcacctacacgcagataacgccatacacaagcaaatggaacacgatccccggaatcttttggcgacgtcttctgtggccgtcccaaccctacagcagtaatacagcacgtgtacatcgcgtaacgatgcttgggagcaaacgatacagttctcagaaatcaacttagtcaccgagtgactttggtttcccaacaccatatcccagctgcttgagaagaatcgccttcacgaggatctctgtgagggtgcgagtttaactatgacgttcgtctggaagctgcgcttgccgtttctgctcgagtatccatgtgattcaccgctaatgtagtggatcgtgagatactatcaggcgttcgcacctttgaaccgcgtttctcccgttcttttctctttcgctggatttggccttgtcgccctgaaggtgtgctgactggactcttgctgccggtgcatcccatgctgacgccccagtcgactccggatttcgctccaattttacctcaactccatatactgacacgccgaggaacgcccagtaatggccgaacatcgaaagctcccgttgtttcttccgtgtatatcgacatcacctgcgactcgcaacgcgtgcaacaaccgcgcttgtgcggttcgcaatcacaacgagagagatgtctcgcgagacgagtttttgtcgagatgtcttccgttgccgttgagcgagaaacggaggaaacaacaaccgcggtcgacggttacggtttctgctagtttgtgattttggagtgcaacaatttgcctgtcggcgctcactagacacagtcgaactcattgtcaaaacaacaggctttggtgaatattgatcaagctgaccggaagggaactcgtctgtccggaactggattacaaatatgaaccggtatcttgaaatgagctgacaacatcatacgcaccttgtttaaaggaaaattgacgggttgcgttgagctcagctcgtagtcgcgtgcatcctgcatgactgaggtgcggaagttgtgctaaactgatgcgttgctacacaggcgccgctggcatccctaatacacaggtcgcccgctctgtcacaaggtgaagcaattactccaagaagaaagcagttatgtcaaaacgactttttgggggatgtcgagcagctgttatgaccttcccagacgagtagctgggtggcccccgtctctgtacacagtctctctacaataagctgcgcttgcgcgtggcgttgtatgtcgccgcgaacagctccaccgcgttcggcatcgttcccagtagcatttatgcacgtatactaccggtaaattgcacaatgcggacaggaatgccaacgaaacccgattcgaatgtcaagatgatacccgagagaactggccctcttgtttgctttcatctcgtcgcatcactctttgaacggtcaccgctagaggagccacgcggctatggaagagatcgtcttgatgacagaaatgaattcgccctagagacggacctctccctttcgttagatctttccccggcagtatatagatatgctgtaacaagtttctagatacgctttaacagacacagacgcttctttcacttaccatattgcaaatactggctttcacacagcgtcactcggtactgtcgttcctgtgttggcggcatcgactacaacgtcttgtcaacgaatcaggccgtcggttcacgtccatatagaaggtatcgtccagaatcaacattgttcagggctatctcgggtagaatcactctaatcgcaagttctcaagagattctccgcagcgcatcatctacactgcaaggtccacttccaatctctcgaaaacagttggtgagcttcaccagtagaccactcccacgaactgacgttgcccctttcgcagctttcagttgctttgccaaagtgaccgcattcgcctggtttgagaatgacaacaaaccgcccaatatcatcaacctcaaacattgttctctgagagacatcttcgtgagaacggtgagtccacatagaagattaagatcctccacagcataccgccatgaattaccatcgtgaacgtaggcatatgaattggaagcgaacaccagctacagaatacagcccacaaccggatgctcgtagccctatacgagcgtttgcgttacaccatacacccagtggcatccacgtttctcgatggagataccatttcatttttttgtctttagagtttttctgcatcccaatatttgtcgtaatcgccacaagaaacaatgaactcaatgactacaatctttcggaacatcacatttcagtatgtctttctactcgaggtgaccgtttttttctcgtgtcggtccttcggcatcgaatctgctaggatgtttgtatcgggtggaggtcaacatgaacacttcacaccgcaaacatccttcgacagtgacttgttttcttctgcagtgggcgctgttgttgatcaagaccatgggtcacgtccgacactgccgagtctaagcagcgacttcgacgatccatcactggcatctctactgccatcacgcagcatgattgccactgttgttgatgggagcatgcacaactcaatttcaggtgcatcaggaaatgatgaccttccgtttgaagcga

SEQ ID NO: 3532 - DNA, 2065 bp, Toxoplasma gondii
agcagcaaaaagtagcactacgaaataggcttgaaactcgcttctagttcacaggcgtatcctcctctcacagtcagactcgcatgcagagaaggcgatcggtttactgctcacctgtctcgccggcagcacacggcagtccattcatctagctttacgcaagggtgaagtacgtattttgtttcgttgtcgtgactccgttcggatcttacctctgcagattcccctgatgttctgtgctcgatccatgtaaggtgtgagacgaggaggagagatggcgagacaaaagtgacagcgcgcgcttttcgcggtttctgtgaaatcggctgcctcctcatctatcaggctgtctcagcggaggcaattttccgcctagagaaaactgtgaaagggtgggcgacgagagggaagagagaagacgcaggtggagtctggagaagagtgatcgcgtctgtgtgtacgcgagacagaagatacgcagaacgttactggttggctccccatcctcaacactggaaacgcgcgtttttgtctctgaaaaatcattggaaaaaaggcgtgacgggcgcgcacgaggagtcgtttccttcatttgaaaacgcagccgttcgagaacagtctactgaagacactcctctctcttctggctgtagaactacagcgaccaacaaggaaatctaatccttttcgagtcgatctgcacatacgctgctttcccccatcttgtacatggaggactaccggagatgcccacagaaaaagaggtatcttttctgcgtttgactgtgtagaggcctctgaagagttccgatctgcaggatgtatacaaaagggtgaatatgcccccgttttgggaaagacctgcctcgacggacatgtttactcaaggcgtcatctgtctacagtttgctctgccgtctccccgctctctcgcgacggcgggagtcaccccaggtgaaactggatttcttcttgccatcgcgtgcatcctgtttctctcccgagtggaaaagaacgagagatggatctactaggcgttcgactaaaaatgggcgctaagaccgtgaattacctttctcgagtcgaagctctgtcgcgccttctctccctcacatcgcatggagtggctccggctgttgttttctgacgcgacttctcatcggtaattctctcctctctcctgctcacttttctcatcgggaattctctcctccctcctgttcactgtcttccctgtctctgacggggtgtgcgtcttgttcgatctaggagacacccgttcttctcgacaactgcagtctgttctctgcgaaactctcgtctccagtgtttttccgagtcactgcttcaggcaggacaagaagagagactcgcttcacacataccccacctccaagcggagaaaaaaaggctcctgtgtcgtctctgctctccggccggtgttagctggcctgtggaggaggagacacgagactgttctttttttttcgccgagcgtatcgtatccggcgtctcggtcgccgggagagaggagggccttgggagagccgcgcgagacttctcccgccgtcatgtctctctctttctcctcttctgcgcgttgcttggttgggcgcggtgtctccgcgtatctttttcctgcgcctccatcgtttttctcgtcttctgctcctcgattcggccaccgtcggcctcgctctttgttttttcggtgtgaaaaaaggggagacgcgaacctctctccgtgtgtggttctcgctcaagttcaagacccagcagggtccagtccgcgagtagtgggagagagagagagcggtcgcgggcagctcctggacggaggggggtagtagagacgtcttgtacgtctctctttttctgcgctttgcatgtgtcgtctgctcgcggagtcgtcgcggccagggaaacgagaaaaatcgcgtttcctcccggagaaaaattctaaaaacgcgtcggtgtctcggagtgtctgtccgcctttcctcaccacacccgctgtttcgcggcgccttcgcttccgcggccagacgatcgtcgaggccttcaa

SEQ ID NO: 3533 - DNA, 3264 bp, Toxoplasma gondii
aagtgccaaacgtgctcgaaaagctgtttctacggctggacaaatcaaatttctatatgggcaagatggagacattcccaagaacagggaattttgtgagtgcaaagagagttcaagagagtgctagtacatacgaagttgtgctaagttcaggcgaaatctgtcgcacgtccgtcatgcctacgaactggggtgctttgacattgaaagagttttgtgtttgtgaaattagatgtggtgattatcttccatatgtaactagtaaagtctggaaatagatgtttgcgttttctaacggtatttttccatgtgcccaagttttggtatcggatatgtgaatgtgtcaagaggtgtagaacagaggtgtgcagccgttcggttatgtcagacacctggtctggtagatccagattatcggtgtgagtgaaggtttgaaatgatggggaagggcagtgtgaaggcgaagtccttctcccctgtggagaatattcttttgatttgttttccgtcaccgtggcatatagtcgccttcaccgttagatctcatggcattgtaaggttgccgctgatgacggcagtgcttaatccttacccatgtgcaatgtctcttacaaagccttgcccgtactataggccatgccgtccactgtcagcttcagttgtctctgactttgactctgggccaacgcttcaacaacgaaatgtcagccacgtgtgagtccaccatcgccaattttgcacacctcaggttaccacacccatcttgaatggtgtacattatggccgcaattataattttcgaactactgtgtgaggttggtgtctgctgtaccattcgtgctatttacaaagggacaagcgttgttgcgggccccgatgccgagttccgaacaatatctagaaatatacacccaaaacccccactccagcttctggcaatgaaacatctaaaccctgagcagatgcggtgcgtgtcgaagctcgccaaacaaaactgttttcctctgttcactggcattcgtgaccggtcgaagcgtgtcagcctgagtagttatctacaccgtatctagactcgtctgacaccgacagtcatgcaaattttgctacatgtgaatgagtatcacgtttggtgtaacggtagatctggttagccatatatctacagaatagcgctctctaggtagttacgcagtttagtgcacataatatacacggaggtctttctttggagagattgagagacagacaaacaaaggaaaaaaattccgacgtcgcgggtcaaccacattctatgtccatctgctgcctcctcctcttctctacctctacgtgtttctcgcagtcgttcataccgatgctggactgcaagtgcacctctcggacacagaagcgtgggccgatccgcacaagcgtcaaagccctctgtgcgaaatcggagtgtatttttcgcgggacgcaccccgaacgtgcttcctttattcaccttcgcaggggcacttgtaagtttatccagaaatgtattacaattctccatagatgcgtattaaactacctagttatatgcgtaattcgtgtcgtgcgtacattgtgaaactgccaataacgttgttgatccgggaccgtgacactgtacaaacgtacatcgaattccctcacaaatactcacaggcgattacgttcgacgttaacgtttggtctccctaagtgctcgacgatggcgcttttctgaaaagtttcaagctcagctatacccggagtacatggtttgcttcgtcgaggagccggttggcttagtctgtcggattcgcgtgctccagcacgacacgcgccaactctgcacacctcaatgtacattatctttgtccatgagagaaagacgacgttgcattcattggctgcaaccaccatccacactgtttcaatatttttcaaacagaatcatcggtgtcgtgaaagccaccctgcacccgcaatcactaccgaatgtgttaccgtaaggggacctgaatatcattttcacggctcgacttttaaacattaggtactacagaccctgctatcgcacgccaactgcgtgccatcgctgacgtgattagtgatcgctccgtgcggcaactagtgaacttcgtcccgatggtagaggtaatgtttgacgtaggaccataaaacaaccggtgcgctgcggtcaccccaactggtgcaaccacaacgacagtcataagcgtgtacgctactgcagacagcacgggacaaatgtttctatacgactcgcttgccccagacatggcgaagcaactgtccctccatagatattctgagacgtatttacgaactactatacaacagatgctgcatacagctcagatcgcacgttagaaatcggcgtaaataaaaaagaaaaaaccgggcgcaacacagacacccgtgaaaagaatttccgctcttcacagggcaaaaaaatcctggcagaggcggaaggtgagatgttaacgggaggaccagtgtagctgcgtgcaattcgaagctggcgctttggactgggccgcgtccacgaagcaatttttctctaaaagtgtctcagtaccgccggaaaagcagacgtccagtgactgtcctcgtgtttctatgtccaaaaatccagcttcgtgtgtatcggcaggcaggcgtcgtgggatgctccctcgactcactcactcccaccgcaatggtccggtgtgaactggccggaacaggtagaaaaaagacgaggggaaatcgaacgcatccccgattgctatgcaccaccgtgcagcaggaagttgttgcgaggtgttacgctatacttctgaacgggcgctaaaacatatccactcggcaacccgatttcactgcaactgagaacaactgcgtgtgtgtgtgtgtgtgtgtaaatcctgcgtatcccggcagaaaaacaaacccccgccacatcatctccatcaccaccatccacacagcgacgcacccttttattcgtcgcacagactgctactagccggctagctcgtttaaaaactccgggtcggaaaggtgcacctggtgtcagggaattgtcatccccccgcacgcggcgtctgaaagtgggtctgagacggcagggagtgtaggggggatgattgccggcgggtgaaccacatcaattttgagtgcttcactctttcgcctcttcgttgcacccataattctttcgatacattttgtatcgtttccactccgagttacgcacatcctgtcttttctgcaaaa

SEQ ID NO: 3534 - DNA, 3550 bp, Toxoplasma gondii
ctttctgtgtatttagagaactttgcccggacgcttgggtcccgagagcagctagccatcgcagcgtttgcagaggctctgctgatcattccaaagaccctcgcggtgaacgccgctctcgatgccacagagctcgtcgccaggctccgcgccgtgcatgcaaaggctcaggggcagttgcttgacgcggctgggaacggggacgaggaactcaagtggcatggcttagatctaacttcagggaaaacgaggaacaacatggctgctggagttatcgaggctgctgtgagcaagacgaaggcactgcgctttgctacagaagcagccgttaccattctacggatcgatgacttaataaaaatcgcccccgaacccgaacggggccaacaggatgactagagtaaactctacaaaatgatggtagaaaagcgaacaaaaggactagagaaccgcacgcgggacttggggagataactgacatgtgtgcgcttcccgacacgttctcgcgaactttttgtattgcgaggaaaaagtccgtcggttctgttgactgtttccaccaggaagcagcgggagatcgtgtccactggcacctttgttttcgacgcacgcgcgtggactcgtgcttcgctctcgactgccgagtcactcggtttttcttcccggtttgttttccagcttcgctgcttccgcttctctctgaacgacacaacggtgtagggtagttcacaccgaagaagtgccgctgcctcgattcctagctccgtaccatttcaaggacgcaaactgatcgttatcatgtgagtcgcctgtctactctttgcgcattcttggctgtactctattttcttacatggttcgtgaaaaactgttctccgaactcaactgttcgctgcgaaaaagaacatcgaaacaaaactccaaacttcgaaaacgtatagatacttctctatatatctatctatctatctatatatatatatatatatatagatatagatatagatatataaatatatgcatatagcgctacactttctgcttgagacatttgtggaagcgatgcggggccatcaacgtatcgtgtcgttggaatcgggtgcatgaggaagcatggtcgagcctcgccacataatgctcaatttgggcattagagtgatacgtgtaatcatcggaagtgcaaagaagccgctgcaactaagaaccggggtttcgtcgttactgtacacctttttcgggggggcgtatcgtcgagtcggacggctggttgagatctttaaggcctttgcttaccacatccaagttctactgttagcatcgtgtcgagaacagttaccatagatttaatatacgtctattttgagtacatgcagtattgactcggtacacttcaaatctaaatttatactgtcaccctgtagtatcgtgcggctgctttgccctgcattcgttctgaaagtttcgcttttgggagtggcgccccttgacgacattttgcgctttatatgacgggaatactaatgcatcacttccttttaacagcgcactatatcctacagcacaccattcaaacaagagacctctggatagaggtgagggtcggggagactttgcaattcattcaccggtaagaataggtcaacacgaacatgataccagtacggataaaaaacaaagtcaatcgggtttaatcttctgtgcaagacacccgatggtggcagctggaacacggaagttaaagggattgttcgaatacttctgcgtccaggcttccaattgactaacgaatggctcgagtagttggaaccttgacgcatatttggaaccgtgacgcagaggcggatgagaagaactacgcaatgctctttctgctcttcggcctacgccgttcgagtgtaggttccaagaaactcttctagcatccttgttgtccacacaatatatgcgagcaaacagtgcttggcatgtcttgtgtgggaaggaacgtttctacggcgttgcaactcccgagttttcgaagctggactcaactggagttccttctatcccaatcagacaggcgagttcttgacgccacttgttaagtttcctgtttctttcttgaaaggcgttgtgtgtcgcccgcttctcacccttggcgggacttcgtcacatgccaccagagttgctctgaatccactgttacaaaatcccggcactttcaacacgattctgctcacgctggcgacgaggtggaccgacatgccagcctgttcgttccttccaaggacagcagtcgtgcaggcagtgtaccagcaaaacaaaactctttactgacgctaagatctatggatcagtggtcctttgcttcctcacaccggggacacgacgctttgtcaagggcggaaaacttctcgagcttgtgaacggttgagcgaaagactggcttcgttgaacacgcaacacagcaaaagatcgcctctgacccataaaagacaagataatctgtaataccaagacccatttcgatgttacatcaggtatgctacatcaggcaagtaaatatccttcaagtagcccaggtaaccctcagggaagggtcgcgtgtttcatcatctctttagcatcgacactttagatgacggagagagcctacaagtcacaaaataattctcgcatttcgtgtgacttgatgacgaaaaagaaaagcatctctggttacatcaaaacgagaacagagcagacgaagaaaaatttgtccgaaccaggaatcgaacctgggtttacacggccacaacgtgttgtcctaacctctagacgattcggaccgaaagtcggtgacggaccagttgccctatcgtgtgagatgctattctgtcagccacactctttcaaattcatgcaagaaatggtgtacttctgcttgccttcaggtctgaaaaaactgtatgttcgaatatcaatgcaagccgaaatgaggtgggggggatctgcaggtggtgcacgcaaccgctctctgcagcacaggatgctgcagcgctactggcatggggcatgccattcgttttcgagaatgttgaagtgcctgctcacaggagattgctttggagagagagtgaactgtagatacgggaaaaggagtaatagagcagtggcattctaaaaacctttggagaggcggcagcaatggtaccctcgagaatgtgtggagacgggccgatagttcagttggatagaatgcccggctacggaccgggtggtcgtgggttcgaatcctgctcggcctacacttttttctgtgaaaagacagggattgcgtgaacttttgttcgttatggtgactgtcagctggtggtttactccatgaagtaccttattgttcccaagtaagggtttggaagcgaatctggacacaagtcgtggtcagtctaaatttataccttgctcttttcgtctgtatgtggattatcgggatcttcacttggttgtttacttgagaagagtgcattgttttcatgaactttcatttcctcttcgacgaacgcgttgccgcttcttccgcccgtaattg

SEQ ID NO: 3535 - DNA, 4432 bp, Toxoplasma gondii
tttgaacacggttatctgctccttcacttcggctgtctatccacctgctgtcgccggaaaaagacgaaacctgggacggaggaaggcaaggcgcggtgacacgcttcaaatccgcgacgctcggcgagtgacccaggcctgcaggggcatcccgcgtcttctccccggtctcgcgcgctgccacacttgcggtgtatatacacctggccacagtgtatgcgcacctcggccggttgtatgaacaccgcgaggtgtctgcgcgacttgaggtgtccacacgccgcgaactcgtagcctggggagccggcgggaagaaacggaagtcggaggaacaactccaagagacagaaactcggtttgactgttgagggtcgaatggtagaggagtcctcgatcggagacacgagagtccccgtggtgatagagagaaaaacggcagctgagaagaagaatggagagcccgcgctcccaatgggagacgcgacgaagaggacaaaggagaggaagacatgaattcgcgaggccaggagcgagaggaaggatggccctcgcgacgaagagccgatcggggaggaagtagggtgagaagcgtctgggcgaggcgctcggaacgactcacagttgacgaagagagacgaagcgaaggcgccttggaagcgacttcagcgcgggtcggacaggaaccaacaagtcctagcggaacaggggaaggcgacaccgacagccaaaggggaaagagagacggagaagaagagtaaaaagaggaaaataatgaatacgccggagagggagcggatgactcagtacggagggggcaccccgcggaaaaagaagcgcagatggatgaatacgaagaggggaaagaaaatgatgaggaagactgagcagaagcagacagagaaaccggcgagacagcgaaggagtgagaggcagcagagaccccgcggagactgcaagttgctgcaccgggtcgcctctcgaccggcacccgccctcctcggagccgccaaggaacactcatcgttgcaagagagaagagtttggtcagactgaaggcgaaaacgaaaataacatggcgcgtgtctcacgacagacgtgcatctggcgacgggaaataagtctgttcgcgagaggtcctggcagccgcaatcgacttgcgtctacatgtggaggctgcaatagacccttggagaattatcggaaacagagtcattggtagccgccattggaggagaaattctgttaacggaaggcgaaagagattttacgatgtctctcgcgttcgtcgaatcgccccagcaagacttgatctcgttcacgattttagggatgtcgggtacccagggtcggttcctgggaaaacgatttccgaaccacctacgtaaattggtacaacgaagttaccatgtcctccgtacaaagctggacacaatctgtggatgtaacggggaaaaatgtggagcgaactgtctgttcgtagtatgcatcgagacggcgacagcgtcgcgaaaaggcggcgagtacggcgggtcgagcgagactcagaagaggctggtggctttcacttatcagtgtcagcaaacggtcagagcagacgtgaaggtgagaagcgatgaaaaaatggcaaccaaagaaaccgcgttcctcggtgctttttcgcaacgtcttaagcttgcctctttggtgtgcatgcagccggcgaaggcgagacacaacggcgacgatcacgcgcgcctgcaacggttctttctcaagttgagagaccatacgggatttcgaggcttttctatgagcgataacatgctatctttcctagaaaataggaattgtttctcaacggatcaacagctggcgggttggcttcgttccctcgcaagaatcggcacggaaatcgggacccaaccccgtcggctgcacgaaacattctgagcgggcggtgagacacgtctgcgagccaaagctggaaagagcagacgaaagcaagttcagacacacagaaaggttttagtggatgaattgctcttctctgagtcaatagaaagggcgcaacgtttgtcgcaaaaggccgggctgcccccatttaagtaacgaggtctcgtttccctgtttctcagtccgtcacacaaactgccaggagagattctaggcagaatctttaaaggagttctcagaaccgcgatcagcccaagacaagaccggcaataacacgacttacatgtgcaccagaaagtgtaagtgaactcttaccaaatccatcctctttgcattacacagaactgcaagtttttgtttctcctgaagtaaacggaagaacacaagcaggggcaattcatagacctgctgttcgtgacagagatcgcgttcgttcttggggaaacgacgtgggcaacgctaagcagaaagcagcagaagctagactcttctttggcattgcgatattgccgatgacatgatagcaaacctgggacactgagtttgattcttgtatgagatatggatgagatacaggcaaccaagttctgtattattgctggacaccaccagcccactgcagtgcttaagaaacctaaaagtgttggatttcaatatcctacgacaggaaggttatttaacatctgttatgttcctggcggaatatatggattactgttagtttagatcgtgaaggtctttgtttaccgggaccaagatctagtgtgttagcatggtttcgagaataaattcacatggaatcagcgggctactacgcagaaatccgtccgtttaaagcacccacagaaccataaaaatttgcaggtgtctccctccatactctagtcgttccgcggtggcttcgctgctctcctacatccgatgtatccatgcgcgggccctggaaattttactcgcagacagtggcagaaaggagtgatagatgcctgaggacctgaataaaagtcaggatctgaaggcaaaactgctgaataaaggaaaagtgtcggggctcgatagtgtattacggtgacctggtatccagcaccgggtcaacgccgctgaagtctctgtccacaagtatgtgaacgaaacactttccttctatggatatatttaagctgctaagcgtgtgatgcttgtttttaaatgcgtacctctttgatgcagcaggagcgtctgtctcacacacaagtttctttccttgtcaggtaccaggtacgcgacaggcgaagagtcggactggtcctttttgcagtgtttgagactcacgtgttgtctgggtgttgtatttcgctataagctttgtcggtgccaagcgttcgtttgagaagccaacatctgtactcaagtggtacgaaaaccgtgatacttatttggcaaatttgctttctcctgttagtgcgtacagaaacccggggacttatgtgactccatgccagatagccggttccataaaacgttccacatcatatgcttgatcgtaatttgtgtctggttatgcagctctagccgtgccgagttgtgccagatacagcacgtctcaccacggggtagttcaccgcagattccagtaaggtgccgacacgggtttcattcggtaaacctcgacgacatagacatctacccggtaacgtggaagaccgatcctcagatttgaggcgggcagcagccacaaactgcagagatgtgcttgccttttacgaggatgtgtaaatgccggttgttccccgtaggactgcaccaggattttgttgctgttgtttgtttagagtactccatccttctacggtcgtcgccagagggtaacacttccaatctccaaaccactgtcaatgtgataacctcaatgatgtctcattcgtttgtgcattggtggttaaacagagtacgtgttaccgagctgctcacatttctttgttatcaacgaggtaggtagcccctattacggaagacggaagtgtcaaacaatcatttaaaaggatatcgtcgaccaactgagaaagaaaaagagcataattcgtgagagactggagacaacgtgaagaagccttgttggagaagttcgtccgtatcaaggaacagagtatctcgcgagagcttctttttttgccggctattgtctgtgtcagtcgccagtcttcagtatcccgggtaaaagctcttcggtccattccaccgtttttggtagtggtacgtgactgccccagctgtttattgagtcagttttatggttttgtcaatcgtttctccacctcacaccttctcccgacacaacatcctccgcgttttgcggcgtttgctccgtcagcctacgtgactatacagatccaggagcgtttttactgggactagaatttgtgaccataaccaacaaagctggacacttttcccgccaccagttggccaggtgccgcaagtttcgttgcagccttcattctctgtgacaagctgagctcga

SEQ ID NO: 3536 - DNA, 1181 bp, Toxoplasma gondii
tccaaaagcaggcagcaaaggtcacgcagtctcgactggacaggagtccagttcgtttgcggagtgcaacacctccttcactgtagaaaattgcgaagaaacgccgagtacgtgctctttccagttgcctcagcttaccgatctgaagctccacagtttccacgaactttctcttcttctcccgggagccctcgaggatctctccgatggccttcttgaggccgtctgtgctgagcttgctgttcacaaagagaaacagacagcggatgataaaaatatgcacactaaacgcctccgaagctcgaccacggcggcaaacacccattacctgcaccggattatccatcaagaaatatcgacacagacacttcataagggccgacccctgaaatgcgtgattgaaccactggcatagggaaaacccgagccgagctgaccactacaaacgctgttccgttccattcccgcctccgacattccctgattcttttctcgcctttcgccattatccctggcttcagaacttttcaccccaatcgagcaccttgggtcatcagggactaaatttcgatgacgtgctacatgcacgccactccgatcgcagggcgaaaagtcaagtatattctttgtgtttgggacgtctggagctgcaagaaaagctgaggatttcttccgtcctctgtgtcccttccctcagaagtactcccgattggaaacccgcagtcagatcccagtccaggacaatggtcgatggttcggcgacccacgcgacagcacctcgggaatcggggtttgaggcgaggaatcctttgccctcgaaaaagttgaagcaaaagtaaacagaagagatcgagctacaatttgactgtgtgagagaaaacggacagaaagagagggggaagtcgtgctaccccaggcaaaaacgattagaacgtgtatacagagcggagggatcttacctcattttgaaaggaagaagagaaaggggcgggaaaccgggaaaagggcgattcgcaaaactctcaaatgttcaacagagagagcaaacaggagtctacccgccccgataaacagacaacaaaacactgtgtaaacgcgaggaggtcttcccgtaaaagcgcccgcagtctccccccctaacatgctgcctttcgcgtcctcctgaccacgcaagccccaca

SEQ ID NO: 3537 - DNA, 3540 bp, Toxoplasma gondii
ggaaaagatgagatctgcggcttgcgttccggagtcagcacaaagacgtccagagtgaacatgcagaggtcgagagacagacagttcaacgctgttttctgtacctcacgtgattcctgttgcgtttgacattctctgggggggaaatgttggagagagacgcgcgactctcaaacaggagtctctgaccgagctcgaaatgagaaaaaggaatcgagtttcctttaactgccgagtggaggtctggcgtagatacagcaggaaattcacatagtggaaatcaacaatcctgaagagcttgaatgcgaatggtagtcagccgagcggaggggaagtttctcgcaggctggccctgcatctctcttctgcaaggcagagggctcgtgtgtcgtcgcaggcctctttcttggaaatcataacttctgcaagttcttgtgtctccgtcgttgttcgccgcgggtctgttgtcagcacgtccttggctgctccgctttccagcacctggaaggtccatcgaagaaaaacgtgtaaaggtggttttctgttgtcatggagactggccgtttgtctattcagtcgtttctttggaaaaaaaaacgtaattgttttggttttctcgaggcctcgaaggaggccttcgccttgcttcgagtcgtttgctcagtcaatcagttccaccgttgaacgaagaaatacagtttaaaagtatgtcaggaacttcacaggaagaaggctacgcactttttatcaattttctcagtaaaatatgcagcctcaggatacgacaagccgacgtcgaggtggcaaccctcaccctgttagtcggttggtcaccgatttgctctctgtatcgatttcactacttgtctccagacatagtcagatcactctctgtgcctcttactatttgcctgcatagagagacaaaactctctatgcctcttgcatatcttggttttgagcagtttaatgcggacagtatccaccggacgccctgctgaggacaacggttgtctatcatgggtggaccttgccgagttgaattcttcagagtctcgaatcgttccaatcagtgccatttctgtgggagctgagcacagtttgtggtcgctactgtagaaaatctctggagtaccgtgaggctcgcttcttcgagctctcggttgtccacacaagaggtcgcacgcaaaccggagaaaccatcttccagacctgccctgcaagaacagatctgacgcccccttgaacgtttgttccttcatgtggtgattccggaggcaaaatgcctaccagacttcattgaatagagttttctacatgtggttttagattcgacttcactcttttacagacggttatggaaactgcgcaatttccatgaagctccccaagaagtgtacctttctgtttcgctcgttctctctctcgcgcgcggatctcgcgggctttttcggtttcctttcgccctgagtacgtaaggaaaaggaaaggttaaccgctatttaaacacaacagttaccgtagctctgatttcgtgtgtgtccagggaactttcggtggatgagctaacactcagaaagccgtcctgggtgtctttgactgaggcgcgccttctctcgacgtgctctgtcgcggtaaagtctcactgacatgcgtttttttctcttcagcgactctgtcttgagctcttagagaaactgcgtgttaaaatgagcacttgcaagccaacctaaacacggttcatcacctaaaagacatcaaggttttgaccgggtggtccttctcaggcggcaattttacgggactcgcagttccacgagcaaagagtgccatttttgtttcagtggtttgccggcatgaaatgccgaaaaaacacgacacggaaataagtgtctacgcatatatatatatatatatatgagaaagggaatctgtatcatacagctgaaagcgtggtagggatttcgctctactgatttggaccacggataagatctgccttctcgtagcaacttccagagaaaaaaacacggactggtgacaaaccaagactgcaattggtcgatctgccgattgtagtcagattccagggtgttgtcccacttgtttcactcttttgtgcttgcgctttgctgcatttccacgttccctccaaagacccataaacgtgaccgggaaagacgtcacaacctcgtactttctcgttttctggagtccattttcgggggcgttggacaaagggcactatagattccggttttttgggggggagagttcgatcgactttaccgtctacaactcgggagagaccagcctatcagtgtacctagacgcacgtttatccgttaatcgacaatgctgctattttagttgtggcaggtcagccacccctggagggaactcgcgtcgaggtcttttcgggtgttcgtcgaagtcaccgtcacacacacacacctggcagcacttggtctttgcaagacaactgaacagcaagctcttcggaagcgtcacgggcgaaagtttttctacctgaacaagactcgtcgcttgcatcacactgcttccgtttttcctgtctgccctggttcccctagacaagacgacgaagtcctgagatgcgtccgtggcgccggtgtgcgtttgtgtgcggctcttgacggaaacgcttatattcgagagttttaaaagtcctttttaggtcacttcttggcttttgcgaggcagtctcttggtgtcgactgccttcccccaccaaagaatcagcccgcaacacagcgcaccctcggtggttcagggggaggacggtgattgacgcgaatagggagcgtttttcggcggtaaaaagaaacgcagatttcaggatctttcgagtttccttttcgcgtctgagccgaactggaaaaaaccggcacctcgtcggtctcgcggagatttttccgacccgcggcagtgcccgcattgcaagaaaagccgctctcctggcgtcattcgcggaaccccagaaacacacagatgtgaaggggcatgtgactagcggatccggttccgaatcttttgcgaaaaaaaagctgggaataggggagatgcagaggcagagagagcgcgcgtcaacaaagacagcgccgtcgtgactcgtggtttgtgtcttgcgtttttcttctctggtttctcgctgtgtgtgtgtcgcccctcgctcttgggactttgcctcctttttctgtcttttctctgtccggtttttttcgcaaaccgctttgccctcgctccgccccattttttctcccctttccgttatcatccggagcttcttgcggttctcccgcgagaccgtctctcggctttttcgtcgaatccccctcctctgtctcctcgccgccttttccatcatccctcgtgcctcctcctcgcccccgtccctccctcctgtcttgcagaaaaacgcgagtctggactgtctgttcgcctccgaaagaggtgctcttccccctgtgttccagcctctttccagtcaaagtttctcctctctcctgttaaacacaa

SEQ ID NO: 3538 - DNA, 2611 bp, Toxoplasma gondii
tctctcgttccgttcgttgttcacaggcttctcctcgttctctcggtgcgtgctcccctctttgtcccgccccacgtcccgactgtccaggagcttctctacctcgtcaaaatcgaggtcgcccattttcctggagtggaagagtgtgttgcaattataaaaggaaacgactggagcggaaagaagaggccacacacgacagccagacaggctcgtatacagaaaactaaacggttcacgtcttcatcggcgattcccgtgacggtttcacgactccccgtttcgtgacgacagtctttatgtaccgaactctttacaacagacacatatcaaagcgcctatttcctcccatcagcttacagattctcgaatttaaagacgaagaatgaacgtgtatctccgctcaaaaacaacggccacgttctctttttccacccgaatacgcaaaaacgacctccatgcacaccagaaaagagcagggagcaccttggccggggctcttgaaaaaagcacccttttagtagactagaagaaatggaagggaaaattcacccgtaaagcaacatgcactgtcgaggcagtgagataatcttcgagttgggatacaataggggatgtatagcatacataagggggactgaggggcggtggtagggcagaaaggagaggcaagaacagagtcagaggagacgagatccagggaagagagaaggagtgttgtacaacgaagatggtcgggggcggtggactcccgggaaagaaacgaaatgaagactttcgcctgaaaaagacgacttgagttagagcaccagaaacgccgtcgcgcaattcccctttgtgtagctggaacttgcttgagtttttcaatccgagaagagaagacggcgtgcagacaacgctcctgatctatatctgcatgtgcaccacgtcgaacccaacgactctttcagcaggcccgatgaattttctccatcgccaactccgtccccactccgatgtcaagttcctctttttgcacagactgacgaaactgagaggaaaacgttgacagaagtgtgccaggtaagctcaggaagttcgtgactgctgcagtgttccgctaatgcccccgatgtcccgcccggagaagaaaggcggaacgaagcccagacagaggaacaccttcgccctctctacgtctgccttctttcctcggaaaaagtgccctttctctcagaaaagagtccggcgcgaaagaaaaaccccccacaaaaaagagttggcaggaacgaacctcgcggttcctggtggacgagagatacgccaggacctctcaaaaacgagttggtgtacgccagacgagccaaaatcaaaaatcggtgcggtgaaaagccaaagtttggttagacgagagagaagtgagagcgaagagcatcttttcttctcaacagcctctttttctttttccacgacctttttggggcacccacagtccagacatgtaacggacgcgcgttccctcggcttatagtcgaaacgcccccagaaggtgcgcgtgcacgccgcacgtcgttcagaatcgagatacgagcaagacaagaataaaggaaggaaggaaaaggaggaaaaacaccctcccctgctttcactcgactctttttgtctctattccttggattgtcgcctctttgtcagtttatgcgcgccgagtcttgtttaccacagttgtaggaagagctagaaagccgcagcatgcatccggggggccaggcttgacggtgtctcctgtgtcgactcgtacaggggcccttctgtctctcccgaaaacagaaaacgtctagtttcttcacctaaaagttcaagtctattcgagaattgcaaatcaaatcatgttttggctatcaatgcagctagccaatagtctgtcttcactgttttaaccatctcagttcatgccctgtacaacaacgcttcttgacagctccagcctatgcttgtcacaaatatgaatgccttctgacgaggtgccttgcttcatcaggaatcctggagtgtttaacttgtaaagcgactctctggtctatagagttgtacagagcttgattctttaatggaggatacatggaagctacgctgtgcgaacttggattccttcaattctggcgtgtccgccagagtttttgcgaaaacagctggactgatgctgcgctcgactttttgtctcctgtgaatgcgccaacccacgagagcgaggggtgtttcggatgcgctgctccgtggcaaagagcgacgagaagagagcttttactgaacagcggctcgcaggcggcgtcaactgtttttactcggctgtcgtttccgcttgttaactcgaagagacatggatctttgcctggtcttccctgcgatctgagtctcgtatctcctacttctgttgtaatgagaagcgggaagcgtcggtgggagtgttcttcccaaacacagttttaatcaccgatcagcaacgtcagcaacgaggaagagaaaaaaatacaatcacttctggagcctccccacgagacgctgcttcctttcctgttccagcgtgatccactgtatcttcatccgacaggcgggagactgtttcacatca

SEQ ID NO: 3539 - DNA, 4767 bp, Toxoplasma gondii
aaacacattttccttcttagatctggctttcacccacctgcaggtgaagccttcaaatcgctctttgccggaggaccagacccttctgcagggggcgctttaccaggcggcagctttcctttgggaggtcctgcttttcctggaagaggacccgtttttccttcaggactccccgattctcctttagaaattcctgccttttcttgaggaattcccgccttttccttaggcagccccgtcttttcttgaggaactccggccttttctggaggaattcccgccttttccttaggcagccccgcctttttttgaggaacttccgccttttctgaaggcattcccgccttttccttaggcacccccgcctttttttgaggaacgtccgccttttctgaaggcacccccgcctttttttgaggaacttccgccttttctgaaggcatctccgctttgccttcaggaactcccgctttggctgcaggcggcggtggtggcgtttttttggccccttcgtctggggttgatttgcctttgggcgggagaggcgagttggaggcttttttcggcagcggacccttctttcccttgggtggcggcgggggtggcggcatgctgtggacgggaatggattggaagagcggggcagggcaacgcttttgagtatctgaataatttaccggtgctgctggctctgatcgaagagtacgctcacgcaccctcgatggagaacgagaataaatctgtccggtaggcagcgcatccgtgattcggggcggatacgctggacggggctgacagcaacgcgcagacgacgagccatgatcagtcccttcagattggctctctcgacagggtggagtgagtttattggagagcggaggaagcaaagagtggcacggagaggcgggacacgaacgggaaggaagcggaagaggaagtctgggggcagaaccgcattcttgcggtaggtcaaacgaaaaaaggtcatcgcgacggctgtcggtagccgaagcagtggtacgcgacctccggcacctcgtgcgtgctgctgtgtgcccagacaagcgggattccacacagccttcactgtgcgaagactcactccgagaactctcggagaagacatagaaggaacccttgggtgtgtcagcctcggcagagagcgaggcgacgcggcgggggggtaggaaacagcgagggggttctgtcgggatagaattgagaaagatgagaaacgacgaattggacagaggcccagaggcggcagcttgcgctttaacctgagattcggccactcgatgtaacgatagagattcatgacacgcgggagacgcgcactcgatgcgcgccgttgttcgagagaaaggcatgccaccagtcaacttggcgaatacgggcctctcaggtagagaacaagaagttgcggagcagagaggagcagagaaagacgttctcgagggtaatgcatttagtacggcgtttctatcgtcgttaacagagggaggcatgggaggcagcggggccgaacccccgcggcctcgcgggcagcttgccgggcaagacatgttcgacggaccaccttcgtttttcgggaactctttcgagtgcaaaaaagaaaagaaccgttagacatactaggacaaaagagaatggctagaaaagcgtacggatcgggctcacgccgttctggaaaagttctccgttaactgcaagacacaccggtcgcctgggactccccatctcagacaggaggtagacgccgctcgatacagcggcaggaccgagagcccggaagaaagaacgagaatggaacgattggtaaatgatgatttagtggaagataagcttagtgttaaagatgttcacggaaagatgtgtcagctcccgtgttgcacagtggaactcggctgttgacttcgctgcccctcctcgacgtactctctctgctcgctcccgccctcgtcgcttttccctgcgggtggcggttttcgctttcgttctttgagccagggggagaatggatgtccgacaacagagtgtgtgttcacgagaaatctccaaaacgtgagaaaggttgggaatgtgatttaaaggtggagcacacacctggaggaaatccagcgatgctgtgtgcgcaagagcacttcccggttcgagcgcctggccagtgagacacgcgaaggtccaggtggaaccccatcctcaacacattgctttctccactccctttgaaaaccactgtcacatcttctgtttcgtgtgtccccgattgcctgtccaaattcatacgtttcacggtcgcatctgtcggtaaaaacgcagccggtacctctctggctagttcgcagttcggtgcacggcgatcgaaacggaagccccagtaacgtgaagggttccagaaaggagtgcgctcatgaaaactgccagtatactacggttaaattcagcatcccaagtccaggatcgaatccaaacacagtttatatccgacaccgcgctagagagtgtccttcgtagagtgccttcgtgtaatttagagtgggagatctcctgtacagaaggcgtagggagcgcaaaatgtcgcaacttcgtttcttttcgtgcactgtagcaacgaaacaatcggcatcacctgtctaacggaccctgctgcaccgcctccccaggtagtagacggtcggcgtattctgtcacgtcgatttctatgccttgaatagtctgtgttactgtgtcgaatgggcagcagggaggttgacgtgccggccacgttgcagactaccagcacgtgtgtcaccggaacggctgtatcctattcgtagaacatatgccaggggattcactttgccagcgaatccgatgtgtcacagcagtcttgctgttcgactgagcatgtttagcaactcgttggacgcatcgtacgcgtcgtccgtctcagctggctgtagacacaattagtaaccgacgtaccggggtgtgcgttagtgtgtttgaccggagcttgaaatggatctactcactccgttttcacacaattcgtagtcgacattctgagttcaattgattccgaaagcgtatcagacatggtgggactagagactccaaatcggtgcttggggcatctctttggtaagaaacttcccagacagaggggggagagttgcctcttccacaagccacccgagcgtcctcggagaaaacaacagaaacattcctcgtatgccgaagtccagactatctttagatctcgactaaggttttattatcctgcattaccgcagtgcagctggcactgattctctccgtcagtgctgcataggcttctctattacgaatcccgtgcctcagttgtctgtggtacacgactaccatcctcgccaccccgagcagcgttcacgtcaccccatattcttgtttgacgcgactgaagctagactctgttttacacagtgtaaaaatggcattcctaggttttgctgaactacacgtgttggactactgattgagatcttgaatatctgtcttcactgtatcctatcctagctctactgcattaccaggaaccatgtatgcgagagcgattaaaaaccccccaaaactacgagattcttgtttctcgcatgtgcaaggtttacaatggggagcagtcgcttgggttcgtggttacaactcttcgattcttcgcacatggcactagcgcttatatgccgctccagtgaaactcctgatcgctccgcgggaacgaagagtagattgtagaggacctgaaccacctagactcccgcgatttccttgttgtacaattcttaggtctgtgcgcgcctcctacaaagtgtccgtgccccccccccccccgccccccccgcaccctttcaggtccagctcacttgaagtttaggaaacctagacctttttcattttcggcaccgttttgccgattgttgacaaaacgaagcacatgcaatttgacagaacaagagtgatgcttttccggtaagctttaatcctactggttgagacgcgtagactcgggagacacagtgcgttccctccccgccacgggagactagccactcttgcatgttgctcgtctcccctcgcggcagcacacacgcgaagatatccaatttcttcaaaacaagggatacgaataagcaaaaagcagcaactgcgttgcaagtcaccgcagctgccagctgatatcgagcttgagtgcggcatcggggggcggcggctttctgggaggtgacacagttgccgagctcttttcgcgccgccctccagcacgacaaagcggggaaaagcgtgtggtcagcagacacagaccgagcggcagacaagggccgtccgagagcaaatgcacaaaaaaagctccttcttttctgacatggaaaaggaccggtctctcgtgtgccactttctcgcagactgctctcttgaccacgtaccgctgcgttccggactggtcgcctctaaagcagcagcggctaattgggagtctcggtcctgcttttcgtttgtcgagtctttgctcgatacacacttgcaggaaactcgtgcagaatattccgcacatcgttgtacttactcttttgagaaactcttgcatctggacgatatcggacgggttacgccttcattcgttccgaagagccatctgcctcgggacgctgtgtcgcctctttccccgggtgtcctctgccgcgtgtttcgcgactcgggtttacacggtcctttccaccggcacttctgctttgcaccaggaaaaaa

SEQ ID NO: 3540 - DNA, 2900 bp, Toxoplasma gondii
ggattcactcgacggtgttcgtccttcagctgaaaagagacagttggatctttggggaaccgaaacaggaaaaacgccaggaaacgagcacggcggaaagcgcggggacttccgcgagagaaagaagtcacatgcacatggggggagactgcaactcttgtttctgcagagtcgagcgaaggaacattgacgtagaactgtttcctcacatccctcgtccttcaatgtgacagaacaacttacgcagacgcgacaccccggtcagggactccagcaaaagtttcaccaagtcgtttgcctcctcctctcctccccagaggctctgcctcacccagccccctgcctgtctcctcatgttcgccaggctctctccccgtcttcctcctctctctttcttcctgtcctctttatcccctttctccttcgttctctcttcttcgctagatcttgctggcatgtctcttcactgtgcgtctccgtcgtaggtcgagttttgtgttagcgagttgcagttgctgtgcatcctgaacttccgcgtctccgtcagcacacactgagacgtggatgatccgcgataacctcgccgcctccatcttttcgacagccgcttcagatgcccatgcgtctctcgagtttctcgtggatgccgaggccgggaccgaagcctgcgagttcgtcttcatcgggcttctcccggttcaagaagtcttcggcggcgacttcctcgtcgaggcgcatcagcgtctgtagtccccagagcgaggagggcagacccggcaggcgctgcgacatcgcgcagagctctctctccatcttcagacgcagtggagcgtgcaggccgtacagccgcgcagctcgctggaattctgttctctcgcgctcgcggaggtggagactctgccgggtctccagagggtgccgcggcgccaggcctgccggcggcggcgcggagacgcaggagacagccgagacggcggagacagaggagaccggagaggccagggaaaggccctggtgaagaagtgcgttcggaaagtgaggaggaaaggccactgccgccgccggcgcgcccgccagagccgccgaagccgcagacgccgacgcttcgtagtccatggtgtgtcgacgcgtcagggagcgcagtgtgagcaggagacgtacgggattccgagagagaagaaagcgacggagtagcggagagcggcggagagcggcggaacgacgcaacaggatcgcagcagagactggcgaggaaggatggactacgaagagaattgagggagggattgaaagagacaactgagaagagaggagcagcagtcgaggttaggcgagagaaagggactgaaatggaagagatggaaggaggcagagcgtctttgagggaaggaatacagagaaaatcgcggaacagcaccattcaagaggaaggcgttctggaagaagacacggggcgaggagaaaaagactcctctcaaagtggcttttcacgtcggagaaagacgaggccgagaagcgttgtgtctttgctttcttcacattgtgtatcgctcatgaatttcgtcgaaagaaacattttgaggagctcgtcacgcctcattagagaccgccgttgcagcctcgcagtgtgtacattttgtctggcaaccccctgaattttcggatcgctgcactcgaagataagccgatgtgtgcgccgagcctgccgccactgttgggagagagaagagaggcctcagtcaaaaaagaaagcgacacagaaaacgccttccggtgagcttcacacttcgggtgtacgtacacttgcctctctcccatgcacaccctttcgtcgggcgagaaacgagcgcggatttgggagaaacgcgtcgcaggttcttccgtctcttccagcctctctcatcatcgtctgttttgtgtctcggctggcttacgcttcgtcgagtggatgcacagcgttttacaacggctgctgtccgctttcgtgaagttttctcctcgacaccagacagatctgccggtgctcgtgacctctctctgctggtagataactttttctgcgtcccctgcctcccgtcgagctctctgcctggcgtgggcttcctgattttccctctttccgtcgtgtccgcggtgtatgtacaccatgtactacaccccaggagccgggatgtgagcatctcgagaaagcccccgcgtcggccgcttgttccgggaaggaagccccttgcgtctcgtgtgtgctcgcgttttgcgccgattcgagtgaaggcgcttgccagaagcagactgcgctttgtcagtgtctcgtttcctctctgcgttcgacttttcgctgtcgttgcctcctctggtttccatcccaacttagagggtcgagcgaatccgagaaggcatcactgtttctgtctgcgtgaaaaagaattcgactccaacggtggccgtccaggcacatcccttcctcgcgaacagtatcgcttcttcgtttcgatagtctcgcaaatataagcgtcatcggacaagctccttggatcccacggcgtgtatttcttcgcgaagccttcggcatcttttctccgtttttccgcattgtctccttgcttcgactcttcctctctgcgactcccctccctccgcgcctgtcaaaaccgccttcgcgcgtctcttttctctctctcttccggttctgcgcagtttctctgcctcatgcaagaccaagatgtctctctcccctctgtcgagactcttctctttccagtagcttcccccgcgatctctcgtcttctctccctctgatcgctcttcctcttcccccggtctctctcgcttcctctccgcctgcgtgtctcctctctgactctcctgcgtttgcgcctgccctcagatcgctcgctgcacca

SEQ ID NO: 3541 - DNA, 3806 bp, Toxoplasma gondii
ttctgcatttcgtctgttctctccaaagtcgtagagtctctctctcccttgccctctgctctctcctgtgacacagcgttctccctttcctgtcctttttcctcattgtgtcctctccttctctttctttcgtcccctccgtcgctgttctctcccgactcgtcgctgcttccccctcgctctcgctcttcctcggcgagttcttcctcggcgagttcttcctgtgccgcacctgtggcgcctccgccgatgacgaggaggtcgaatctttcttttttcattctctcgatcatcgcttctctgctgggcggcaggtgggcgagtctcccttccgcctcgccggctagagaagagtagtagcgcgtctccttcggcaccatgctcttcttgtggttgtagtacaaaccgccgtaggcagctgctccgcctaggccgaccagtcccgcggagcaagcgaagacgcgtccgaagcgcctcatggtgagagtcgaggaaagcaaaagcaggggagagtctcacggacaggccagtgggaagaaacggcagaaaacgaagaaaaggagggagagagagagaaggggacaaagctaactgttgaagggtgagagcgatagagcgatagagcaataatagagcgagggagaaggagaggacgagaagaggaggagaacaggagaagaggaaaagaggaggggacagctggaaacggaagcgacggcggaggagacagaaaagcgagagaggcgaagagcgcaagaaaagatgagctgatctgctccaagcgtcggtctgaacgcacagaggcaggccgaggagggggaaggaaacgaaagagggacgttgaaataatggaaagtcttcgtgccttgagaacgtaggcgagaggatcgatctcctctttgcttccaaaacgcgaaaacgcgctctccctccagagtgcaggcgcgtacgtccctgagcgcgtgtgtacatccaccgcagcatatgcagagtttgcggtgtgaattcgaaccgacgcggagacccggtttctcttgtccgtcaaccagagtagtttcgcttgcgtttcgcgcagaactttccagggcgtttgatccagagactcgcgagaagactcctcctttttcgagacagcgagactgtctagccagccgatacacacagcttgccagttgcacacacagaagacgcgtgtagtaggcgcgtctgtccacccgaaaggttgcattgaaagcgaggggatcgtggaaaacgtattggagacatcggagaaaagcaactctctctctctctgcattcgcaaatcccctcgaagttccacactttcagaaccacgctgactcgagttctcccaaacctccggccgtccctctcatatcgtccgctttgtacgagcagatgctgagtaacaggagcctcaatgaagagagaagcgcggcgcgccttggaatccttggctttcagaggagttctcagcagcacgaaacgcggacttgacgctggaagaaaatgagggaaacgctttctgcttcccggctgtgacgtatattatgcagtggcgcgccggtgctttagcgatttctcgcttccactgtctcacacgcttgcctcgagacttctccattttagagcgtcggttgtcgaagaagtcttcgtttcttgctgcagcacgaagttgcccgccagcgccctcgacatctccatagaattcagtttttctcagatgcggaaagcgaagcgtcctctcctcctggagatggtcggatccggccaacgatctttctggatttctttgggtcgtcatgagcaaaggcgactcaagggtcttgacagttcttcctcgatttctcaagtggcaaatgtcgccgacaagttgccgcatttaaagtcgatacacacacacacatacacgcagggcgtctggagtctctctcccagcttcactgtcgagcgaacaagcgacaccggagaaaaagtttcgctttcggactccgaattctgttcctctgagttgacaacaaagaaaaaagtgaagactctcaagagaaaaaacttccgtttcctctccggtgaacgcacgcaccgccctcgcagaacgcagcagagaagtcgaaagcgatcactgctcacttgtgtgtttcgtctaggaactctggagaaaacacaaatcgtactaaaggattagcacctctgtgatactttcctgtgggagtccaccaagggaaagagactcgagaagccgcagtcgaaaacgttcttccggcgcgtcacaaacaacgttgaaacatccaggcaggaatcaaaggaggcgtcacacatgctcatgcggacgcgcgcggtggcgcgtgtacaaacattcgacgaacttggcgagtctccaagaacaaagtacgaaagacagagagatcaagactgagccagggagacaaatcggtggaaatatgcatctctatatgtacaaatggctgaatatatacatatatgtgtctgtgtagatcaataggaaaagggaaatggaagcagagcgaaagagaaagagatagatcgacatcggtagaaagattgatatcgacagataggtcgacaggcaccgggagagcgaaacaactcgagggaagtagctaatctgggcagatcttttgactgtttttccagagtttaatcctgacaaaactgcttttcttctcgaattgagcagttccatgagtgaaaacggtaacagggttaactccagtctgtccctgagtttatctgcatccatgaacaggcaacggaaagcctgaacgagtcatggtaacggtgaatgtcctgaagtgtgcgctccccaagtacgaggcgaaccgctctcagtcgaaagagcgttccttgttttcgcgttcggagtgtatgcgcctgagactctcgaaagaactcgagggaggaaccgtttctaggaaacaaacaccctccggtttgtttctctttttctcttcgcagacggtcgctgcgaggctctgaagcaaactgccgattcaaagaaaaaagccgacaagaagtccgagtcgtgagaaggaatcctcacattctacacggttggtgcaaatgccgttttttcacttccagaaagcgcttgaaaaagggtgcctgcaggtgacagtcgctgtttccggctctcttagccttttcgctcgttcttttcacagagcccgtgagtctgtcgagttaccattttcagcctttcgcgacaagccgctgtccggcctcgaagaagtacatttttcagagttctagaaaatgcaggtaaaagcaccgttgcttcgacttgaagagacgtcgcaagggaggattgtcgctagctgtttttctgtgtctcagagactacgcagaaccgtacctctgcttcggggggacccctgtgtcggcatctcctttgaaaagaaagaaatctgcctctcttcttcagtgtgtgtttacaacaccgcgcacaccgattcaccgccactgttcgcgtccatcaaacgaagcattcaaagtatatcttcattcgcctagttacattcatttttaggattccctttgacggaaacgcgtgccttcatgaaggagatgcacattcaaggaaatacgcatttatgtgtgcagcaaagcgaacaacagattctgcgtgtgttttctctggagggaagaagggagcgctcgccagtgtcgtgaaaagcaacgagagctcgtgaaagtttttgtgttttctgcctcgacgcagaaatctaggccaggacctcgaaacttggcgaaaatgaaagaaaaaagactgaaacgttcactgccca

SEQ ID NO: 3542 - DNA, 2005 bp, Toxoplasma gondii
ttgattcgcacgcatgcgtatggactgctgagaggagatactttgacctgcggggtcttgtaaatcttttttcttctctttaacgtgtaccgagcagtggtggacctgcgagtcccctctttctcttacactgcgtttctttttttgtctcctttctaggtgtctgtgcctctcatgttaaaatcataaacttgggtccttgtctctgtcttgaaagcagttagatagggcctctggcgacatctgtgaagacacaacgttcctcccttccctggttccgctcttcacacgttcccggtgtgcaggcatgtacaccaacgtctgctgatcaatctattcattcattcatacatgcttttgttcatgtgtatgcatctgtttttgcatttgtatatgtgtatatgcgtgtatatgcatgtagagaaatattggcacttcgtcgaatagtgcatgtcacctgcaaaggtgaaaatctctgcgtttttttaacgagagcatgggagaagagaaacaaactgttcgaagagaaattgacggcattgcctcaccccaactggcggcgaaacatgaggaagggaattctcaattggtgcagattctccgtcgctctgcaagatcctgcacaacgactgaatcatttgcagaacagtgtacttcgaagtttctccaagtttcctgttttctgcctttttttcgtttgaaaaagcgggatgtccgtctcgacaaggcactgacaacggtccgctacaggaaacaaagaaatgagcaactgggaaacagagcgctcatcactccttaatgcttcaaaataaacagtgtaaaaaaagaaatgtattcgagatagacacacacacatatgctgttactccgctctcatgatctatacatgcacatgcaaatatatatatatatatatatgtagatatgtatatgtagatatgcatgtaggtaaaggaatttatttgggtaagcgtcttcagcagaaaggtacgtccacaaagagcatttgcgttccgtcattcgtggagacgaatccgtctctgagggcgttgtgccgtcccgatcggagtcgcttcttcagtgtccgtttacgcagaaaagcaccgtgatgtgtgtttgcctgtcactctgtggttttacccttcttcgatcttctctccattccctgaaagatgtctccaaagaagtctcggatcctgtgtttccgttcttcgttcgtctcccgcccccgtggaacctagagcgtcggctggtggccggcgttcttccgctttctccttgagttttcgtttttgtgtgacccttctgaaaggagcgttcgtggcagagtgaccggattccagaaaaccggaactttcgcggagagagtccagagtttgagagtggcgcctcgccttcaggtgtttctggacgccttccgcacccgcagtcctccttttcaaagccttttcgatgctctgtcgttgtcttttcgggaaataggcgagaaaaaagggacgcgaaaaagctgccgacctcccgtgtgtgtttggagccgaagaaatccgtgtttttctggcgcaaagagcgtcagctgaaacagcatgaaaagaagcatgtgcgtggctcgtcgctcgtccgggtgtacgtccactctcctgtttgagaacgcttttcgctctcgaaaagacaacgccgaattctacatcaaaacgacgaacgtgtcgagactttgaaatttcgcttttgcttctctcctcacggtcgaccccgtccagagacctttctcttgttctccccgtcgcgttcttctgctttcagtttcttcgtttctccttctgtcgtatcgcctcctatttttccgcttgacttcgtcctttcgtttctctctgatctctgcacgtccttgctctctccttcggtgcccagagtcgccacgagcaacaggaagtctgcttttcgtggacttcccccttctttggaaactttctgcggaacctgcgactgaactttcaactcaaagcca

SEQ ID NO: 3543 - DNA, 1475 bp, Toxoplasma gondii
atagttctggacatcggtcgatcttcgaggtagatcaactggtcctgcctccaggaacatggaattccgtacagattagtttaacaagcgctgctttttttgttcatttgggctggtcacgcgcttcagatcaatgcgtttagcatcaactaagctatcatttgtgaacgtttagagtgtagctgcttcaagctgacggcatacaagcgccacccgcctctcgtacaatctctctctctctctctctctctctctatatatatatatatatatatatatatgtatatacatatatatacatgcatatatgtaccagtctacatggctgtatatacaccactatatagttctgcatccatttttccaaacttgcgtcctcaactgttgtgtttcaataacggttaacctgcccttttccttacttactcatggcttgaattatcacttaaataacacctgaagagagctccctgttacatatcataaacgagcattcatcggtttatatgaactatcatttccagagtactagatacttatatctctcctgatatattcaatgtgctggggctggatcctacaagtaacgacgactcgcggtttcacttcctgtaggagcggcggacttgtcggtaactttggcacagacttccccattttactctccaaaacacgcagagagacctccaggaacaagaggatgatggttggcattatgttcccgtctgaaacagcttcattgtttgcgtactgatgccagaccgaagttttgtctctgtctcgcatagccgcttccgctttcgctggcttccaaagtcgacggccgtgtctgcgttttccgtgccagcactaagaagctcttttccctgtcgcggagcccagctcttctggctatgagctcacatcagccgcccccaaacatttttcttacctttgccttccgcgtgactttctctagtcctcaaatccccgatacatgcacatttcgatgcgtctgcatgcaacaaataaagaagaagacggccctcactcagccttgtttgaagagatgaatcgatccacacgtagcgtcgatgttttttccgacgaacaagtacagatgtttgctcgcttttcaattttctgttgcgggtgtcctgatgcttgcatagtcgaagcagccgccggtgttcgctcgttgctgacgtcaacacagcagagatttgcgctttccaacacagtgtcgctcttgccttgttttttacgctgtctgttttgattacgcaaaccgaagcttgcgtcacggtatctgtcgagccattctctttatctgtgcctgcgactattgttctctgactcttctccctctcaagcgtcagtcgctgctgtccagcagctagcctttttttcctggaatgctaagtgtccacctctctttgaatttcagtgcatgcaggcgtcttcgtttctcgagaaaatgaccccgaactgaaaaa

SEQ ID NO: 3544 - DNA, 2053 bp, Toxoplasma gondii
cggcagttcgtgacagaagaactttgtcttttcctgaaagaaacagagggagagagacgaaaagcgaacgcgttggagagacaaggacgcctctttcgcagttgcacatccgctcgccgaagaagcgtctgtcaaagaaaaaagcgaatgaggtcaccacagtctccgaaaacgaggagacactctcgtagcactctgctctcatttgtgaaacgcactctcttccttgctccccactgttctcgtccactcctgctccccctctctctcttcctttttctgatgtcttttcgttttccccttgtctctctatctctctctcaccgccgttgacggcgagctcgtagagtccacctcgctgaaaatcttcggcagcacccaggtcggtcgccgttcttttttctgcgcatgcagcgacgcgtgggcagcgtccgaaggcacgagagaaaaccggagagccgccgagtttccttccctctgtgcgggagttgccttcacctacagcaacggagacagcaccggcggcgagagccgcagcgcagagtcctttcgtccagaacatcctctcactcttctgctcccgcgtctgcgtcggagagacagagacagcaaccggcagaccttggagaccagaagaaaggaggggagaggaggaggaaaggtgagagaaggctctctgggcgacgcgtcgccaggcctggctccggaggcttgccatggtggtgtttaggaggggattcaggggaactctggagaatttgaaaacggaggaaaagaggatgattcaaaattcctgcagcgtagacgacgcagctgaaacaccgggccgtgagcatgcgttgagagaaccggcaccgtcggggacaccgcgcggaggttcggcgacggcgcgagaagacgcgtttctcctctcctggatgagagagaaaggacttttggagaaatcaggaagaaaggaacctttcgtccaagttgaaactcacgaaaatgccacgggagccgcgcccgctgaagaaaacgacaaagcaaggaggcaggcaaatcacagatcctccggggtggactcgaaagggaaaagtgagcgcgagacagaactgtatgcagtggagatttcgaaaccgactttcttctcagccttttcagagatgcagagcatttgaagagaaagacaaagaatcgaacggccctcctccgagtctctccagctgcgccgtttttttctctcggtgcccggacgcgctgcggtgttcgctggactttgatcctctcaacaagagagagagggaacacactgtaaaggcgcggcccatgcctgagacaggaagaagagagaaaggaaactggagatcgggacggagatcgaggcgtctttttatctgcttttttttgcgatacatcttcagtccaacttccgcgtcggcgaggaagcggaaaaaccggagactcgcctgtctcctgtgtcttgttctaaaaaactgtgcatgcgcagcgcacccgggagatcgccagtcgcaagacagaaaagacgcttttctgctctttctcgctcttcgcgcagaaggcaatgttctccccaggtttcatccacttcgacgacgaggttgtctctcctcctccgtaaaaggaatcgggaagcccgttgtgtgtctcctgtcgcacagccccggcctcgcctggagtagatatctccgtttcctcgcgccgatttcgtcttgttttctcttcctcttcttctcttcttctcttcctcgaagcgccttacgcagattcttggtccgaagaactcgcgagcgcaattctcagtatttccgcagtcgccactacgactgcggctacgaagccgtagacctcgctctctccctcaattcttcctctctgtgctctcgtcgtctcggtctttccttctctcgcgtctgaagagacgacgcagcagaaggagttcctctgctcgcgcatgcgtctctccagagagtcgatgtctgctgcaggcaccgaggtcttaacttcctcagaggcgtctccacctctgtgtgtctcgggagatcggccgcca

SEQ ID NO: 3545 - DNA, 2319 bp, Toxoplasma gondii
gtggaacgacagttcgcctagttcaaagcaaagggagtagatgagacaaaacccccagtgtcggagaatgaccatctttacaagccagccaacaacgtgggagacgaaccacacacttgtcaactgtcggtggatcgtgcttgcattgattcggcagtctaccactagtgtccccgcaaaaatttcctctctttttcctgcgatttcggggaacagcaactccaacgcgtgtcttcccgtctcttcgtcaacgaccagcagcaccaccatgacaatcaagtgaacgacgcacatgccgtgcaccacacgccagaagccggggtgcgggagaacgagtgagcagtctctcgcctggatgaaacagtacatgcagacaagaatgagaagcgctagcacgacacgcctgacattcgcgctctttggagagctggaaacgggagatgaccaatcaccaaggagtgaagaaaacacggaaggagttgcaggggttggtttcgccgctcccgcgtgttcctcagatggacgaggcgtcgcttgtgtggcgcctttttggcacgcggggtcgtcacctggtgcagactctccccccttgtccctcttccactctccctcgacacacctttctgcaggaagctctgcagaaccagcaacatcgccaggtttcccggcgccttcgtggacagagcgcacgacatctttcatctgggaaggcggaaacagctggtcccagaacccgagaagcagtaaactcaggatgagaattgaaccccagagcacgcgccggggttccttgcgagctgagttgtcagtggagacttccaagcttttatgctcaccatgggccccttgctcagtcggagcgacaccgcagtcgacaagcactcgaggcgaacactcggccatcgagggactcgaagcgcgtgtggttctcgctgactttaggctgcctggtgacgccgcattgttgggggttccggactcctttcttgaagggagttgcattttgcctttggatttgctcacccagacgtgtggaaaagacccggacgcagcgtttcgcgtcggtcctggaaactgcagcttggaaagccacgggaaacaaactgttatggaaaaaaatcgggaagggatatcagctgcccgctacacgaaggccgaaactgtgggcggaactctgccagcacctgggctgcgtgcaacgtggccttggactactaataagacaaatcctgcagactggctctctttcctcctgcgagcgacaagacagctggcaccgcagaaagcccccgatatcgacctcccccagagtcgacgtctcgtccttcgccctttgaaacaattatctttctgccgccaggagcagacacaggagaaagcaaagaaccgtcgaacaacatgcctcacacttcctggggcggaacgaactgtgcaaagagtagccggtcataggcaagccgttgcctctacgagctcacacgtcgtcttttattcgggctccaagttcgtgatggcatcagcggcgaagatctttttttcccacatattcttgaagttcgtccaaaccaaccagagaaaaaaaacagaataaacggatagcaccttgtcgaatgactatgggggatgacggtgtggaggtgaccttcatgggcgccttttcgcagacgtgagacagctggcccccttagctcgccttgtctccagcgcagacatgccatacagccgcccgtcagcgccttcttaatttctgtctccaagtcgcttttgtggcgctatttttcgtcagatctcgatggaattgcatgacggcggattctcacaggctggatttcacaccgcacgccgagcgcattcacaagacactcgcgagtttccgaatctcctcgttggcgctcgcctaggcagttgctctcaaggaatcggctctctgtttttcatttcagcggagcatcgaacagaggtaacgaaccagtaggcgcgttggtcatcgaacaacttcatcgcggtgtgaccgtgtgtgccaacgttttccccgataaaggtaatcctcgccgctcgtgggtcgatttttgaggcggcatggcgggaaactatgccgtccgcacgtgttgcccgagcctctgggaagaaacaaagcacatgcacgatggtgtgtctcagaatagtacaactggcattctctgctaaccacgctcgactcatccgtatctgtttgtctggctcttcggtggtgagcctgatggacttgtaggcctagtaaaagtgtaatcctcccccgacacaagtgtccatgcatcccgtctatgagaccagggtaga

SEQ ID NO: 3546 - DNA, 1930 bp, Toxoplasma gondii
aagaaagggaaaacaaagagggaacagagacgccgtggagaacgaaaaaaagactcaaacgagagaaagaacacaggggacgaaccaccatcgctcccgcaaaaggagagatagagaaaagacagaacgaaagacacaccagaaaaaccgcgctctccactgtcattccttttccacgatcccgacgaagagattatgtgaaaatccccatctcgttctctgctgtgaacctctcttcgctggctcaacttcttcatccccgtcctcaccaccatctgtctttcctctttcactcctctgcatagttcctttcctctccttcctgcccctctcacgtatctctcagctccctcctctcctccttctcctttatcacatatctcttctatctctctctctggttctctcctcctctatctccttgcctgtctctctttctttctctcggccgttccctcctgctttctctgcctttttgtctccttctctgtcgctgcttcctatcgtccattctctgcgtgctgctctcctcctttctccccttctggctctgccgctttatctctttcctcctctccctcttatatctcccgtctcggatccgaaggtctgctggaaagaggcgaggaagggagacctgagggccgcaaaaggccttgaggggagagtcgagagcagcaggagactaactacaaaaagaggagagacgcagaagacaaggacgccaaatcttctcgctcttctcggcgaagacctgtggcaacggcacagcagcttgtgaaccagctacgctggcgctggggcttcacctacacctggccgggaaggcggaatgaagtgagaaaggaagctgatttctacgtcgactgctggaaaaaaaagcctgaaggcggactggtgagaagggagagcagactacgaaacctgcactcgctttgcttcctttttgacacttcaaacagccattcggcttatactccgcgaggctgtctcgcacgagttttttccttcttcgcccggcagcaagaccctgagagtctctgcagacggacgctgctagggtgaagagatgactttgttttcttgaaaagcagaatttttgcggcaggttgcgcggggcagagctcgggcagcagttgccctggaaactcgtgcgagcggctgtctgcaggggcgagagaaaaggcgcaaggaacggaatcggcgcggagagagggacgcatgctttcgggtgtacgtacagccggcaaaaccaaggtcaggtctgagagaagcctcccggcgtccagcagacagttctcttcgttttctctcagcagttgattggcgtttggacaacgaactgcgaagacgccgcgagtggagaaggaactcttttcccggtgttcctccctcttcttcctctgttcaaggcagtcgtccggcggtccgtcagcgatttccttcctctttgtcgtttttttcagctttctcgcttcttcgcaaggcgtgtgccgaactcgtcgcgccttcctctctcgctctccccatttgtttccgtctttgtctcctcctcttcctcgctcgaccgccgctctcagcgccgcgcctcactcgcgcttgcatgctgcgtgcgtttcggtaccagttcttcaacgaaaacctcctctcttccttcctcggccctcagccgtcgttcttctctccggtctcctttgccttcctctcccctgtcgcctctcgtcggcgttgctcctgcaccctcccgcttcgacctctgtcctattttttttccctcacgcgttgtctctccctccgtaactctctcctctttcgagagagacgagaaacgttcgaactcaaactgagtctgtcctgcctgtccgtcttctctttttcgtcgctcctttctgttccttttcttctcctcttctctctgttttcctcgaga

SEQ ID NO: 3547 - DNA, 1785 bp, Toxoplasma gondii
gaatccatgaccgagtggaattataacgaagaggtgtttgtcgtcggaatggtgccgagacaaaaaacgaaatgtttagacgctcgactgtgcactagcggggggcggggtgcaaaagggacgagtgtgctcagtggttcggaggtaactgaaaaaacggtgcaaaacatggagccttacgtggatccgcagggggcagaacagatgtctcagaagaaagttcgagagaacagaagaaaaacgagaaaagtgatgggcgactcatgcagagtggcgcgacgagtctgtctctcagacgagcttaccagtgctgggcggaggtaaaggaaagaagtcaagacgcggaccttgaggggggtggacagcatgatgaatcgctgatgtatgtactttagaagcgcaggagttaagagtcgagcggcatggcaggacgaccagttgtcctttatgcttcgcagataggcaatatatctgctgctgagggcctcatttctggagagttgcgttgtccctgtcgtcgcctcaccctttatctccgtgtttgtctcttccagggcagccttctgactaccgcccaacgggcttccttcttcggattccatttgagatagccgtagaagcagaggaagagccgtcagaacgcttgccgcggcagaaaaacacttaaagggcgtcacaagattgatataggcaagaggaatggacgtcaacaggctgattcataagtgacgctcccagtaagtggcggacagccatgaaaatgagcggccgagtttgcagaaacagagaaagaggtctgcatcctggcgaagagccgccggacaccctgcttctctttcacagttcgtaggtgccaagaccaggaccaaattatcgcccttcttggcaaaccttgagccgagttaccggagaggttagccgaaaaagaatcgaaacgaagacgccattttttgtctccattgcacacggacggaccgtagcttgtctctcagcatatcttacgacgttatgcggctgttatcgctaacacaccacaaagagaaatggtttatcgaaaaacttgttagccggatggtaaagagatgcagaaggcagtccgcagtaattcggttttcgtcagttgtggcgtgctggcacactcacgtttttccagcgtcacatgctgcctgattcacgcagaaactgcatgtgcgctgcgtgtctcgcctgcctcaggatgcccttgtcggccgatagtgaggaaggaaaaacggctccagcaaaatgttggttctattcggcgagtgccggtattccttccacaaggtcgagacaccgtcgattgttttccttccggactgaaccccggaaaagtcactttgcaccgtagattccacgtgctccagcgcggctgtcaattttcgacactgcgcgaacggcttgccaacaagaccaggctcgcgcgcccggcttttcacattcccgacggcttatatacggaaggctttgccaggcgtattctggccgcgtggggtcgaaagaaagtcgaaaaagagcatgcttgtcaagtgcatgcggccatgtaggttgctaggacccctgttaaatttccagggtgcggggcaactaagtggcctctcttcgcgtcgtcttcggactgttctctgggttggcctcgcttcgccacagacacttgtcgacgcgtctcagggagtctgagcccgttgtatttttttcgctgtctttttggcggttcccgtttcccctcgactgccgactctcccctctcccgctccgtcgccacca

SEQ ID NO: 3548 - DNA, 4433 bp, Toxoplasma gondii
caagaaagcgtaccgagttcatctcccagaggaataagaacatgatttccacgctggagaagcgtgaggttttcctgcacttctcccgttactgtgaggaacttgcaaggaggcagatctgtagccaactgacacttgacctctgctcctgagcaagacaacaaaatatcgagtctctcgtctttatcgtttcgctcttctctcacaatcgatctcctctatctcttctctccctcctccatcgtcttcttcttccctctcttccgggtcgctctccctcctcttctggggtgtgtgttcgtcctcgatagcccgcttcggcatgcctgctaaaccgtctctgtccctagcttctcctgactttctgctttctcgttcgccgcgcgaggctcaccgtcggaagtctggagaactgcgtatccgtcctcgagttgcttgacccggccagtgacgccgacggtcttccccacctgctcagcgaggtgcgtcgccggaagagctctgcagagagggagaaaagagaagagtggaaaggacgtagaaagataaagaaaaaaacctgaaggcggacgcggcagaagagagcacgaggcgaagaaagaaacaaggacgaagtgaagcgggagggaaaaggaactggatgatggtcgaggtaaaggacaagtaagaggcagaagctcaaggaaagtgaagaagttagagacaaagcaagagagaggagacacggaggggacatacacgcgaagaaaaggcaggaggcgaaagcagagaagccgcagctccccgcagcagtgaaaagcagaaacgagacgaagagagaagcgaaggagagacgcagacaaggtcgaactgacgaagacatccaacgggccgacgagatgaaacagctggtgcagagagacgggtgaaaaacgcgtccaaagtcaccacaaccgcagaaaaacctactggcaatagaccgcaggcattgtgatgagagacgttttctcggaataaaaactgaagaaaaactgagcgccgagaccggcaactgcttcgtcgtgtgtagagttggcggcccgccgaactgtcaacttgaaacgcctgagatggcagaacgtccctgcttccagggaaaaggtgcagcaacaaaagaaaaagcaaagtttcttgaagaccggcgacaggtcagaaggtgtcgaactttcaaaaggaaggcttgcagagtcgaagacagagagtcgcgctgtgagcagaacgagacggcgacaatatgccagcgggtggacaaagaaagcttcaaggggggtgtgtgcctggtcttcggggtgtcttgttgctgtgtgcaggttttctcggcttttcgcgtgcagttctcgttgtttttaattcgtttctggtaccaaggaaacgacctgctgtgaaagacctcccttctcaactcccatcaatcctcgaacgactgctcgtgtctcctcgacttcgcgcatgtgactgtgcgaccaacaccccccttttcttcgcgcgtctgtttctcgtggcttcacagaaatcgagatacacgaaagacaggctgcaagtccagcctcagaaagctacttcccccaatagacttcataaaagttgccttcttgagtctggactagcgacttcctcttgttgtcaagagacgtcacaacgtccccggtgtacgtggctgcaaaagatgtttgcgtagacatacacgtatccgcgtagctttacatacaaccatagatgcatacaaacgcctgcatgcacacagagatacattcacacatgcacatacgtacgtagattgttgctggtctgagtagaagcttcctcccccagttgatacgagtgtaacggcgacccatgtactgagtgtcgagaacgcagtccccaggagacatggccaacgctgtttcgtctggacgcgcttcctgactttctgtcgtcctccctcttcgtggggtgtgagcaaatgtccaagcgtacatgttcagcgatggagagaatggccgaaagcgcagagaaacgatgaacttctggaacgccgtctaaacgagtctagatccatctggggtgatatcctcgtctcaaggcacagacacggatatccacgcgcgtctgctcacgcatatcaaggtctttgcctggaggtttgttacgtcccgcgcagctgtaggtaaaaagtatgttagtggcttagacttgcgctggagcacattgtttcattcgatagtccacactaccctgaattatttaactcagttcattaggactaggtttgatattctgtatcaaccgatctaaaattgtgatgtctttctgccaacgggacactttctacgtccggctgaacggcggagatgtgcttgtcaaatgcacgcatccagtgggcttctgagttcctccaatacaaagagtccaggaatctacggaattcctcgtgaaaaattctctcgagtttctctggtataggaattcattgcactcagttaggactgcttctgcactttcaccttaaagctatacagtttacggataatctatgcaaatccgtaatgctctgagacgcgatagtaggccacgagcgttccaggacgcaccattcaggaaagtgtatcgaaagtgacaccagccaatagcgacagaatgtcactgtgaagcagcagacattttcactccaaacccttcgcctgtgcgaacggccaaagagacataaaaaaacgataggcttactatctccaccaaacctcttggattctgctgacaggaggcgcacagttccgtttcgacggcgactcagctgaattgatgtacgccttagtgtgcatacatagtgaaaccctgctgaagagagttctgtgcgtgtgtgcgaggcacgaatcatgcttttctggaagtttcttttgcgtttgttgctctgccaccgacatttctccagtctgtcatttcaagaagacatcttaaaagccgcaaccttcctctatagatttgttgactgacgtacgtatcacccatttctgattttatccgtcgacaacgatgtagtaggacgcacttgactacgagtcacacgcaagcgaaagaaatgccgtcttatcaagattcagcgaaatggtggagtcggatgcttcgtccggcggcttccacctaaaagactttctgttgaacactggtacggctggagtatattcaaatcgttcgagctgtctgcttctcgacgactgctgacggcactgtaatgtatttgggtccacgactgtgctagcctgaaatggcccacggcatttgaacggcgctggcttctgccacgtccaaacccccgagaatccacgttcagtctaacaagagtccttgtattcgacacttggcgtctacaaagtgacacagatcgactgctacaaagtacgaacagatgaagacacccggacttcgctgcggtgtctacatcacttggcaagcctctcattcaaagcgccaggaaaatcctgcaatgcgcgctgctgcagtgagtcatcagagccttttctcgcgcgtagaaagtgaaaacgaccgtgcatttcgtaagtgtgccttgccatcgatcgatccagacgttcccgtgcaaaaatccgtacctccgcaacgatacactttgaaggcttatctttggcttgcggcattggtcttgattctgtccggattcgagccacaactctggtttaccgggttcaacagccctcccgaaagtgcgcactgaatagtgctgcacatcacagagacacgacagtttgccacacacaggttcccgaatttccagccgttaatcccccgtagttggcccgcaaaaacctggagtgcctccagtatcagaaactgctcgaggatcgaggacacgcgaaaagtgcagaataaaacaagtgacgactcactgggctggtggaaaccggtcttgtggtgtacagacacccgagagagtcagcggcgcatgcgcggccgcctggctcgcatgcgcacgtgtcagccttcttcctgggggacccgcgagagaagttgtatgatgcctgaattcgcgattgcaacggcgaaaaagaaatcgcaagttttccgcaacggagatcgccctgctttttgcggggtcgaaaaactgtagactgaccgccagtccttcagcacatctgcacatctcggtgcgcgttcccgtcgtatcccaaggctacaaagacacacgtggccggcactttcggtgtcctgcgccgtgtgttcttcctccttgactttttctctcgaattcccaaactctgatttgtctatcttcttggaaactgtttctttgtctttctgtctcgtttctgtctccgcgcgtcgccggcgcgtgccccgtacatcgcgatcaaggtgtacgggcgattcaaaaagcctttctgggtcgttttttctgttctctatctgttttctcgacaaga

SEQ ID NO: 3549 - DNA, 4045 bp, Toxoplasma gondii
tgtatgtatgagcagaagaggactgggcaacttcttgagagacaggggggtctagacgcgagctggaagtccagagacagctgggaaaacaggtttccgttgagtcgcaaccagcgctttccaaaggggcgaccaaagtccggcctgttttctctcttctctttcgctttttcgcacttgggtttcgatcgttccgtggagacagctgcgcgcccgcgcaaaatcgcggccactcgcatggcgtcgatttggagtctctccgacgctcgcttttggggaagcacctccaatgcaattgtccctcgtggacactgaggtcacgggcatgaaccctgcagatctgtcgtctctacgagcacaaaactaccgggagataggcgttcgctgggagcagctctcttctgaaagaacggtacatgtttcacacgaacgtaggaggtccgaagacgaagccgtcgagcaactggtttcctgtctctgagctcaccggacttccatacgcatttcgtgttcggcggtttccagctgagaagttcgcaggaaactcgagaacgctccgaggcaaacgacgcatgcaatcaacgtgaagagaaccttcggcggctgactcttcagcgcctccttcccgccgccgcacaacacttgaccgagaactgtccacactcccgagaggaccgagccgacaccggcgaagagacccgtcgcaggcgcacagcccgcccccgcagaagcagagaaagaagaagagagagaagaagggagagacgaagagcgagaagaagaggaagcggcgtcaatagcgattccgagcaacgtaggcgttgccagattgcaggagctgcaaacgatgagggaagagaaggcgaggaacaggcgcttgcgcgttctgtctgggcagaaacgactgaagagagcgaagagactcgcccgggacgtagccggggcctccggagaggaggcgcctttcgacaagacacccggcatgactgcagccgcaaaggagacagggcggagacagagagaacgccgttgacgcgtggaggaggggcgaaggaagagagagaaacgagagaatgatgacggcgggaagagatccggagacgggggcgcaggccgctttgggtaggaggcgagactggcagaacgagtcgcgggtggacgccggggtgagtcgaagctgtgagaaaccgcggggagggaaaggaaaagagaaaagcaagcggaaggacggagggataatgcttcacgaggaagcagcacgacgctgaagaagacccgcgaggctcgagcgaaaaaccagccgacaacactcaaacactcgaagcaacggctgcggtgtctgttgcctggacgaacgcgacacactcgagggggattcgttccggaaaggaggacttccggggggtggaaaaaggatgcagaacgcgaacttcgcggagaatgggtgaagacagaacagaagaagtcgagaaagaagaaagaaagagccgcgcgatcggaccagcagaaaaaacgctttcaatgccccagcccgctggaagctgcgaccggcagctaccagctgtcgatacaccccggaggcgtctgcgtgtctctccgcctcagagacacaaaggcaaggcaggcaaaaaagaagggaggaagacagatgaaaactaaagaaaaaatccagtcgttcactttttggaattaaagggtgcttttttaagctccctcaaaagtcaatgcatgcgtggaacgcacaagccgcgaaccagacgcacaccgttatctagagctgtactttaaagtaggtatcctcgcagcgcttagaccatactgatttgtgtcacttatgagataatcaagaaatgtaacatataaaatagacacgcacaaaacaagatacagatacagataacaatactccaataacaacgaaacctaaagatgcatatatatatatatatatatgtatatatatatatatgcaaacatccatctgtttggatctgacgattggcaaggtcccccacagactacaggacagaggacgagatccgctgcttcctcatggagggaaggtgggcgagttcacacgcgcagaaaaaataacagaagaaacgtttacccgtggagacacccgaaggagattcgaagcggaaaaaaggtgcttgcatttttgccgagacgcagacatccagcgatgaacgccgaaaacggatttcgtcgaggaagcgaagtcgtctttctggagtggacgagcacgtagaatcggtctcagttcgtttcgctgaaggactctttcaaaatttaaactatggacgcaagcgtagcacacctgcatctagagccatgcacagtgagcacgcgcgtatctacagacagaacgcagatgcagttatgtgggtagaacagaaaggcacacacacaaacataggtagcacgatctgtgaaaaacatgcacaaagacaaattcatgcacatatatgtatgtctatatgtcgatgtatagctgctcgtatgtatctacgacgctaacggctttatgtggggaggtgtcagtattgccagcaggtttggagtatggaagcgcacctttaggtgcttggctgcttcgattgctggcgttaaatgtcgtcgaacgctttcttttgtcgattaagaggtatagtgcctgcaagaggcttttcctcccgagtctcttcgtcgtagacacgccatacgaaacgccgttgcttctttgcatgtcccagctccgattcactgtccttacgtatacgagttcagacacgaagacgcacacatttcgatgtagatctaattactgtatgtgaacataattctgcgcagacacatgtatgcgacgtgaatctgtggtcatctctgtgccccacttcccctgttcaccgatgacgctggatgggtcagcgtggctagttcctccgttttccatctaaattctcacccagcctgtagtcagagcggatccatatctggtgtggctccgagcagaggctgtatatttctgtgaaagtacggagacctacacagacgcgcattttgaggtgaactcttgtttggatttgaagtgacgtgcagaacgtgctttcaagctcctccgcatacgccgctcgcgaagccccatgcggatgccattttcgctggtcgataaatgccacatacagacttgcttttcccttctctaaagatgcgacccggaaatgcaactctgcgtggggcagagacgcgtattgcgaaaaagcgctgctagactgtaaacactttcagtggtctacgcccttggtctcctcatgtcctttccgggaacgttttgtgtcaaatccgagttatgggaacgcgaatgccgagcgtgcttttgaaagtgtgtgtctgttccagggaaagagactttcacgaaaactgcttgcacccccaggagctggacaacgtgtcttggcgtggagactatggcaaactactcaagtggcgggctagaggcaagcgacctggaacgcactgcgcttcaggcctttttctccgcttctcttcaccagcgaaatgagtctttcctcttttctggatttgtaatttccgcggctcgtcgcccaactcatgtgcgttttctgcaaaccgttgttccctgaagaacactgtggcctgtgcgcgcagtccagtgtgaccagacacgaccattgcgctagttgcgcgaaggtgcccggcacgttcgcgcgtttcgcggctggactcgtgaatttgcgccccgtctgcgcgaaaaagcgtttctttgagtggaaagaggcttgttttttgtgttggcccgtgcgaggtcgcagatttgactcagaacccacgggagcgtcgcgcgccgttcgggtgtatggacacctcgcgaccaggcgcgcgcgtggcgacaggccagtgcatgagtgtcacttttgcgacattttggattttgtcggcgttttttcgtttctctccgtccgctcgcttttttcgtgtctttgagtcccgcaaactccaccgaactcctccggccgcgcccttgcttctcgcgtcctgaaaa

SEQ ID NO: 3550 - DNA, 4086 bp, Toxoplasma gondii
gacgttcgaagcgcacttcagccaaaacctaccctggatattccttctcacccccctccgccgttttttggtggagcggaacagtggaccgtgtgtgtcgcaattcgaagtacgaagacagggaggctgcaacccccagcgacgcacggtgaacaacaacgaaaggaaagaaaagcttcacgagcgacgctgcggcgaagccaccttcagtattctgtccgatgtcgtttgtgcgaaggaaaaagctagaggggtgcgatacacgtatccgatacatgaaaaactgactctcaacaccgacgaggatgaagtcgaccacagccgtcgcagcgccttccgtctctcctggctgctcttcctcctgtcctttaaaaagttgaactgaagcacagacacagttcatgcgactgcgccaggattatcaacgctcataacagacacgtctcatgtttcgtagagcgtgacaccgtgtacagcaatctgctgcttccgggccacaacagcctgttgtgcagatcgaagcaaaaatgcgaactattgtgagaggaaaacgtccgctggtgcagcaacggcaaagaaagttgctgctccagcggactagcaagctaaacgaacactcggaaccccggggggacggcgcccgaagaaacagagggacgctgtgtgccaccctccatggctgctagtgcggttttttgccccggaaatgtttggcaaggaagccaggaaggaaagaacagaaacgtctcagggcacagtctcacgcaaagaagaaaagttgaacacccagacttctccaacaccggagtcggcccaccaggctcggccttcggctcttcggaaagaaaaactcgaatgcctcgggggaaaagtgaaggatcgaacttttccaggaaagaaaaagttcagcctaaagaaacgtaagcgcaaaacgaagagacgttgcagcagcccggctcagaagggcgctgtgtcggaccatgtttcgcgttcgatttttcaacgagcggaagttgcaaatttcgaatcatgcggtcctgtcgcttactggaacgttcgactaagcccagcgacagttagaaagcagtagtatgtggaaagcgactaatgtgacaactaaacaagcggcaaatcccattcgagtaaagcctgtctcaaaagctgatgtgagacagctgactgcgctcagcgtcgaggctcaacagctaaagttacggattccgagtgccacccggtcacaatacagaaatgtgtgtcccgagagcacaaagtcgatgttccactaagagaaatccccggcaaggcacgaaatgcgctttgggaagatggtgacagtcccggtgaaacagttacgaatcgccaaggaaagaagtcgcttcgcagccggaaggttgggaatcttaacgcgggggaacaacaccccgccgcgatgtcacacgaaacgcgaaagtcacactgcaggaacgtcgctgtcagaaaagccgaatcttcgagatccttctccgggtaaagcaatgcaaaccgtgtggctccagtgcggtgtttctattgtcggaacagagatttggacgcggaaggcccgtgaaaggacgcagctcttgcacagcagtagtccagtgtcaacagcacacagcatagaacgactgtcagtaatcggcgtagtgcagatgatgatagttactgtataaatagaaccaggagaacatcatctgtatacgaaccaccgtcttcgggagaatattaggtacaagttggattgttcacttatgtcttcgttggccgggtccaaatgcgagttccgaaacggcaagcacgaatctgagaccgcagaaggcgaaagcgttgtatgaatgccttttaaaagtctccttcgtttggaaagcgttatcctaggcttgggtatcttttgctaggaaagacagctacgctgggacgaggagtgcgtgccgttccaaaaggaggaaaaccttttggttttagctggtgtgatctctcggttcacaacataaaggtgtcactcgttgtcactagcttgctagttgccattgccgtgttagtgtgtaacccgtgtagagcggccttattcttttccgccttcagccagtggaatgacctcagcagaggtcacctcgagcgaatcatccgatcccagttgcccctctttgagaccgtacaggaaaaagcaagcagaacactcacaatggtgaaatgttggcggaagtgcgcaacttcagtggagtcactgctgtaaccttccctgagaggctacacactacggaatctgaggctgctgcctgtaactgttgattcgcagaaatgcacactacccatgtacattaccgtcagtgtagaagatcagggggtcgcatgaaacagaggaatattcctcctagttctgcccatctatgcacttcagaaagtgcgaatcggcgacaactgctagaaatgtgaatggttcctaaatcttgtggggcctcagtacggatttggcgagcgctatgcatgtgctgcttgtttttgagaagcgataatcagagctattgtacctcttcctactacaggtgttgcaagcatttgctgttccattgatcgaggacggtggtgtaacatcgatgcatcgcctcccaccctcgaaattcccggatccgaatctagaacaaatcaagttcctactaactcgaggatgaactggagtgctgcagaagctgttaaacacggaaataccagtgcaccagggatataccggtgtccattgagcactctgacaatgaatggcggttcagctttaaacgacagtcaggttacatccgacgatgatagtcgcgtattcggactgaacctttccttcagcactcgtgaatgtgacgttctacgagccgcaatctgccttaaatgatggacgctacggaggtggctgctggggctagatcagcacacatgtaactcgcagctgttttctggtcaaaaattcgtgacactcacggaactagtgaggaagatttactcccgaaccaaccgattttgccaccctctttctgtatccacgctaatatcaactagacgccagcacaaagcggcgcatgttgttctcgggctacttgcgcgagtgagtagtcctcatattgaagaaagacaacagggatgcacgcctgcgtcatcagctgaattcgcacccgacattcttccgagacagcaaagatactgatgtcgggagttcacgacggttaatgagttaatagcaagctttgcgatttcgcgttgtaactgtagtgaaacattggggttggcaccgaattgaaagggggaagagtcatactgactagttgtccgtccgcaagttcatgagtttttgtgcttcacgcacatgtaaacgcagtgcactatggcagttgtgtttgatgaataggcgtttgatggacattgggaagggccaggatcaccgggtctaagttatccgcctgcaactacctcttgattgtgtgtgtgtgtgtgtaccgatggcgccctgaactcacggaagcaggtctcgaggtcgcttcctctacgcgttcagcagcagtagctttcattcatgcgtcctctcaccttttgcagaaacaatcgaccgtcagtctacacataagagatcccttattcgtgtagtggcgtttcggcacatggggtaacgcacaaaatcttgctgtgaattctacgcttggcccgtggtatgctcgacgtgttgcacagcgcggggctttcaaagccgcgagaattttagacgagtctcatgctgatttctgcttcgtcagttcattccttacgagaaaactgaagtagcatattctactatctgtttttctcgtgtaaagttgaagctttaacgtggttgatcaggaaacgagaagcgaaaacctgtttgacgtgctgttgcctcgtccgtcacgcatttgcgcaacggccctttcttgcgtcgtgattttgcggcgttttccctcatttttggttccgagagactgggcgacctctcacttttaaagcgctcgtctcactgggcaagcttcccgtaggattttggtccgtcggttcgaaacatccgtctattcaaga

SEQ ID NO: 3551 - DNA, 4052 bp, Toxoplasma gondii
tggagttccaacagagaaattggaggtcagtccagacaccgtgatagctgagaacgactgtcggtttctaaagatgtctactgaacatgcccacgtgccagttttgtcgtggtaggcagttgaaacatttttagcggtcctacaggagatttgtatgatttgaattctctaaacatggtagaagttaccataagagtttctgtaatcccagggtaccctagtccatgagggccattctaggagcaacgatgtctttgtgttccaagaaggaagtgtttccgcagccatcagcgtggggtacatacttcgctaagctgttaacagcagtcactctgcgatgtgcagtagagccgggctcttcttttttatctcccttgtggcagatgaaagagtggaagcccgtgaaggaaagtgaaaggctggctccaaacgacacctgatcggactatcaagacaagcggccagttctaggtacggcagacgtctaagttatgcttgctaatcctcatgctccgtttcaaaagcaaaatgcaatcgggcgagcttcctgttgtcgcccacgatcttgtcagcggttgttcctcagttgcagacaaaatcgaatatagccgtcagcccgttcctgacgtctcgtgatctgatgagcgagcttgcaagcaagtgcctaaagcggcggttttgtgtgtaagctcccccacagcaagcgttaggtcgagcaaattgctctttgccgccccaaatctgttatactgaatgaactaggttcctgctactggaccagcgggtgccacttgcggaatcccgggtcccgacggtcgaatgtgtactgacacttcaggtgctcaccgagttgtgtttccgactgttttctgcgctagcgacggaagttggtgaaccgcacgtcgtcattgatactatcgaggtgtttcatggctacctaaataagttgtctcgcctcgctaaagagcaaggtagtctatgctaatggtgatatcctcgcatcaaccgtcccagactgctacattccaccatcacttcagggtgtttaagcactcattcacaagcatgctgttcaaagtcggttggaccggtcttctctagagcggaggtacgccgccgctgtacgtatgccgacctcataagaaagcctgggagcaaagatccggtatgcggcgtgcacgtggaattaccgttattgccacatgacgcgggaaaattgcaacgcggcagtgaagcagaagtctccagagtcctatcggggttacactgatgccttgcgtttggggacagacagtaaagccactcttccgtgacaccagatagttccagcgaaccctacaagccaaatgacaagaaacagggatcacccccatcacctgtgggctcctctaaatacccactgatggcttagggtaatatcaagtgcaaacgcatcgctatacgttaaaaacaactcgcgcacagaacaagaggacagttctcggtgtctgctaaattccctgcatttcactgcattcatttgactaaacggaaaacgaccaaacagtcaacacacagatgatatgaaggtgcgcattacgcaacagatcacctaaaaaacgacgcagcatagtttctctgggagctgatggtttccgtcggcgatgaggtgtctctaaaacatcagtccatctcatttgggatgagtgcacagaagccggcctcgacacagcagttctttgtcggcaggggaagtcaacaggaactattatcatacatgtgttttgattcgggggtgacagaagaccgagcacaatgtccgcgcttaaaagaagcggtgctcactactcgcgtcacctctcgcattgcagctgatctgccagcgacaccctacattgtgaagtctcagccgagaacgtgttaatcccatgttttgctatccaaatcaacgaggacttcgacttcactggcctctgcagcctcgatacccctctcgtattctatctcctcccctccaccgctcccactctttctcatgtatgcaacacccgctccggcagcgctcagaagtaacaggcctccaataactcccccagcgatcgcaccagcatgtccacttccttcctctctctcctttccttgttcctcgctctcggtactgtcgctaccagaaccacctcggctctgctgactgtccggggtgcttccttccggttcctggctttcctcaagtggtgttcttctttcctgatctctccccggttctgttgagtcgctttcaggctcacgactttcaccttcatcttccctctggcgtttcgatggttctgagtccacaggatgacctcccttgccaaattcgaagggaggcttcctataatggggaggcacacgcttgcaggtgatatgggcactggcgtcgattgtcgctataaagttttccttgcatacacatagtcgacctgccgtccctgttagtcggcggcaactctgtactgcatctggcggcccacacccgttttcctcacagccgctttcctgtcttacaatacatgtcacgtttcctgtcccgtcgagagatattctgtagccttgattacagcggcaaatgtaaccactgtttgtctcgttgcaggtgccggctgcctcaggtccacaagggtttgagctgcaagctgcaggcttttccgacagctgtacaaaattagccatgggtacacctgagggcatcatgcacgtgacctggtcattttcaacgcccagaacgtagcctggttcgcacctgcaatcatatccagatggtgtgtttatgcacgtaccagctgcggtgccaccgcatggattcccagagcagttgtctgcaatctctccattcccaggaagaaaggcaaaaaacggggagccgttcttcagccacagtaacgattcggccgccacaacggccgcagcacagcaccggaagagcctcatagcagagacgcgcggcaggaagcttactggaatgtgctcatccaatcgaaaaaaaacacatcatatatcaaagcacagtcgatgtcatcacgatcccaaacgcccacagatgtcgaatctcaccctcctcttgcagcgaagtacacaactcaaaaaaatacgagaccgacgacaacagagtacacttcgtgctcccacgaaggtcgtggtggagctacagtcctcttcagatacgccgtcgcatcactgagcatcgacacacctctgcctgttgcaggatcggatcgactgccgcgtcgctgacacacactagcgcgttactcctctcgccgtcacacagagaattgttgtatggagctacggaacgaccatgcaggctcgaatctagcgacacctggactgtgcttcttgttgcagcgttttgggttgcccagtaatcctcctttaggtggttaccggaagaggtccgtgacggaagattgggcattgtgcgcagcatggcgggaaagcttcggtaacatcagtggcaatgcttttgccttgatgacgcggaaggaaacatctaaagcagacgaaacccgtttaatggtagcggagcttgcggtgcgcgttttcgtggcggaatactgcatcgtgccggtggcagttcaacaggagcgtctggtggcggaactggaaagtcggcaaatctcaaaagaaccattcttaaaaaaaagccgtaaggcatcaaagtctaataggactcggagaaagccggcaaaaccagacggcgtcgtgccatctggcaggcattttaaacggaaacaaaggatgcttacaggactctgatggtggttaaagaccacagtggagtcactgacgaatcacgcagcgtgtattcacgtgatgaggaaagatttgtcagaggctcaacttgtgcgctaccgaatggttgtccagtagtgttttctatggaaaacaatgaatgcctctcatgtcgcgcgatgtacgtacaccggaagtgggcaagtagttttggatcggctgcgaaagatcattggtgaatccgccctacagcttcgtgagacagtccgagtggttatgtgctgtgtcgtttcacaaaa

SEQ ID NO: 3552 - DNA, 2290 bp, Toxoplasma gondii
acattctgttccgcctgaaggagtgaatgacagccgagcaacaattgtgttgatgtacaaggaggcgaatgacatctcgtttaaactcctcgcttccttttcttctcgtttccttagtctggcacttcacaatttgtacctcgacggctggggggcgccagaaccccgttatcagagcatcagcaaaaagttcagagaaggtgctcgaaaggctttacaagaaatgaaggaaaaatgagaaactgtacagagcaacgcgagctcaccgggtggtgggcgtcgagcgagtgtcagctcatatataaattctcgagtcttgtgttccttaattcttttcatcacctgaatttcacacctgtgagcacggcagtcagacgctctcgaactcgcctagttgcaagtcatttcacgctacagccacgcggatgactctaaacgtttccatttttttcgtcacaagctggtgactcctctattttccatatatgagcattcttgtcccaagaggcaggtgcttcgtgcgtggccgttcttcgtgcaaaactacacgcctgcgtcggttagtttacaaaagtcagtctcgccggctccactatttctacggtcagaattccagagaactgcctgagtctacagcctgtgaatgatgtggcgggtcttgcttttacatacgcaaagagctaaatcgaggtttactcccaagcgcgcctctcgcgttttcttcacgggtgagtgggacggcgcatgacgaaatgactataactcctactagcagcatacacacaactgcggaaacccctggtacaaacaaatctgcacgtacccttgtgaagcagaaagacacgcaatgtaatactgtacagaacactccatatgattctgtcatacatgctctttgttgcggcccgccaacgaccctagtctagcaggctgtaagtaggtacgatagtcaatttcgggcggatcctgtgcgtcccgatactgaaaacgtgattcttactctcggctcgtttgtatgacggagcgaggaagatgtcgaggtacactacggaaggctttgcttcgaagaagcaagccagagaaccccggattttagtgaggatcgggcacgactcgtcgcagcactacaccgtgacaacacacctacactttccatccgtacaggaaacacacacaagcacattcgcaaaccagagacctcttcaaccttcagtccgaaacgagaaaaatgcacaaaaacgccagacgcatatttggtagatgcaccacggacgtccaagagctgcgaccatcaccataataggaacaacccttgcaggcagctggtctttttcttgggagcttaaggagcggattaacgctctggcaatgtggaatcgtggtgaaacggtggtctcctgtagatgatgtgtgattcgttaacactgagaattttttcactctcaactcaaccatcgtgtcttcgatatcgaggcgcaaagcgggcctcgcgtgtctcctggggtcagctaatcacaattcagcgcaacacatcgacacacttctcacttcttggtggctttctcctttcacgctccacggactggatggtataacttcaagaacctcagcctggatgtggcggggccattcagtgtgtttcatgcaaaaagccactcatggttttcattttctataggatccgcaatgcgcccgagactgacaacgctgctgcggtgactgccattcgcgcctcacagccgacacctgtctgcaggatcttctgtaaggaagtttcgaacgtcgagtcatttgcaaatcggaagaaagcgcacgctgtgaataaaaaattctgatgattggtaggctttttctgtgggtgatttcctagaacgagcaccacctggtgagcgctgttaggggttgcccactttcggacagggagcagcttcttcttaatcgtttctaaataacgttacagtatactgctactgaaggaacgcggatcgacttcgtgctgacagcaatgccgagtctcggcaaaagtcagtattcaacggattctcgggaagcgcggcggtaccgacgcacacactgttttcctagggcttttacattttgcctccgttttattaatatggacaaaagggcgccgccaacccagcttcacactttaaaaatatccagaaggacttgagcgtgttttgaattcaagtatacgcaacagacggggaaaaagctctgcgggtgtttgcagtgtctggcttctcacccctcttcttgtgccactcttttgtactggaaaccgaaa

SEQ ID NO: 3553 - DNA, 4470 bp, Toxoplasma gondii
acagtacgtctatggtcgcagtgtgtcgcctacagtgctgtggcaagggtctcgtacgtagcgtttcacctccgtggtttgagagaatcctttcgacgcaaagtgccgtgatatggtggggagtgaggtccgacaacagaaggcagaaagccagatgagaaaccggggtgaaaatgacggtaataacaacagccagcactgccacttatcactgtgttgatatcaagaggctgcatgcacggaccggtgtgtgactattgtactgacgccgatgggcaacaaatgatgccatccacgtttatggtaaagaaaatgtgtttccgttcggaggatcacgactagaaaaaagaacgccagaagcgttgccagatctgcaggggggggatcatttgccgtcggggttgcaagaatgaaaagcttgaatctgcaattttgagtgtaaatttcttgccatgcctatctgtggaagccacttgcggattctgtaaacatatacataacggctctttgctgcgcgccagagttgagcttccttccctgagattggctcttttgctaaaaaagaaggtagtccacagtcttccgttcatcgcatgcagacggaaaattagcaagcggtcctcattgccacctacgagggagtcaggaatgtcttatccctgcaatcactgaagcttaggagaggctatcttaccatcgaagaagtgacagaagtcgctctgtccgtcaacatagataaagcaaccctttccttctatgagagaaaacggtctgatctgttctttatacggctttttttgcttccaccgttcttcccaaaagcaaagtgagctcgagctatatcggcatcatgcttttcaacgtaatattcacaagcgtgaatctccaggatgctcacagtctgttaatgatattcgaggaactgagaacctgcagcgactacgagtagattttcgtcccccacctcgacggcagaacaggcctgaatcctcgacgaaaacatcgtcaactcgtggcactccagggaaacaattctggaagatcattgacacaggcttgcttttgatttctgttcaagtcaacgaatgctgtattttttgttgcgtatgttgacaaggccatgatttcctttgactgcatgccactacagtgattcaacggtgaacacaaggtgtgaactgtgttaagcaattttcggcattagcaaatctagctcgtgattcacagttgtcttcgatctatgagcatgaaaactgcgttctctggcgtagcatgtctacaagcgatcaaacctggtggtttctctcgcacgcggtggggcccgcaaaaacggtgttgtgcttgtttcttgaagaaattgtctagtagcctcttcgactgatttcctcgccaattcgacctctgtatactacatttgtccgaaaagttcaacttgggacagaaccggtgacatctaaactttatttcagcctgtgaggaactgacgaaatccccacattccctttttgaggttgccgatatgacgcagagggacgaaataagtctctcgatgtaaactccatgtgtatgacgtaccttgtttgatgccgacgacattactgagcttcagcacggcagcagtttcctcaacacttctacccagttcttggatccgttttttctactctcgcgctgcgattttgacttaccaaagcagtatcagcagtcgcctcctgagcctgctttgcagtttcgctggcctcatgacctgtgatcttcgggtccaaactctccgcattccgtttgtgaacaaactcgtttctgtgtcattctcagggggaagcagcgaacgctgcaagtaggcaagaatgcgttcgttttcccgaggaaaacgcaagcgaatctgccacgtttgctccccctcgagccgaagaataacacgatacagaaaaatgacactcgtggaaacttctgctctcaatctcggtcgagagagccgctccgaaggcgggtatagtggtgacgagcatccgcccagttcaggcgaccatcgcgatttgtacgaggtacgtgcgcctgcgttcctttctgagtttcacagatcttgtccgagtctctgccctttacagcggaggtcctcttcacgtccttctcgtgtgacaagaagcttggcagcaccgagatacactgatagggtaccatttccttctttgccggaaaggctgcgacaaaccggcgccccgagtctgacacacacacgcaccttcacttgacaacaagggctcgtcgtgcaattgtggttatttgtagtctacctaaaagtgccaagatatataatagaatgaggcggccctcgaaattcgatcatccatctctcgcgctgtttgctaccgtcctggtttcctctacgggtgtaacccggtcctagaaaacgatacttcgccataagcgagcctgggctcagcaatttctacgcaagatgcttggtcccttgaaaaccaacgcgctcctccctcaaatgtgtgtcctcatgtttgacaaagggagaaagcgatccggagtatcgcggtcgagccacatggaacgccttggacgatgagttctgtctgggtctcgagagcgttcgctctccaggcattggaagtgacctccaggagcaagtggacgctgctttaagagagagcacgacactcgttcctttcatgtctacggccgcaacatcctctcaggacatcccttttccatcaagaccggtctttaatcagcaagcctcacatgcgtccactgttgcgtctgccctcgagagcgatgttcccccctggtcggtggtgccgtgagtgtgcatgtgtgcaacttccaatcagagccgtcgttattctagtttaccacgtctagcggtagagtcaccagaaaaaatacagctcgcggccagataaataactcccagtcaggtctccacggaggactaccacagaagccactgccatgtgttcacggcgaaaaatagcctggagacgaaagagtagaaaacaaacggtagctcaactgaacggaggggtcgcggtgtcagcaacggtgagcctagtgagttaaaaactccgtggtgcagtcgaatcccagcagagctcgttcggatgtcaattggggtgtcgctctacggaatttcctcaacacagttcttccacctgtggaaaagcgatgtcgtttcgcatacaattggcagtacgcagaagaaatatagccccccttcgtgcgctcccgtcactgctgaaccattaagacccgtccagtcttgcagtgccgacgctcaccggaacagtatacacaacagagtttacgaggcacacagcagtgcggtgtcaaatagactgtgacctaaatgcgtattgtttctgctcagacaccgcaacagacaaaccgcacccacaaacttcgtcagcggtatcgatgtgctaccacagttcacagtaagaaacttggcggcgtgcagtcagcccgctaatagttcaggattaccaaacccagaacatcgcgaggggaagtgtaataacctgaatgtcacaggaacttgacatccgtgttagtgaacatgctggctcctgagaaagagatttgcctcgatgttgctgagcgtgaaactctgtggcacttcctccacaaagaaaacagtggcagtgcagactggtttccatgcggaacatgtctcagttgctcagagtgttcgccatttgctttttgatgggccgtcagagcgaccttctgcccaccacagaacaactggcatatcaagaggatggcagtgtgttcgcgtgttgtcgctgtcacttgccagaaaagaatcttcgatctagagaacgagaatacgacgctacgtctcgagagggcagctgatgcacgcaggcaagttccctcggtataggatgacaccatcgtatcaggaccttctttgaatggaaggcaccgggactgtattcttgttgagtccaggtttcggtgtaccctgcattactagagtatcagagtctctcatcgccacctgaatgtagggtgcctagtcggactattactgttccacgttctctgaagaaccacgagaaaaacgtgaaagagacgcttggaatgaactctcccttcgagcacccgttgaaatggcccgagacagatgcagtcgactttgggaccgtcgaacacttcgctgcgctggcatattcttacggcagtgaaaaaacctttcatacgacactggtaaaaccaccataggaaaggctgttactccatatgaaacaagccaccagctgtgtttctgccgctgtccaggttccaggagcaacttcgggagcaggccgcgggccatgacgaggagttgatgaagtttcaagaagaaaaacaatctttggaggcaacgaaaagtttcttcaactccgtgaagcgccaattgaggtccgtgtttctggaagtcctcgttgactttgaacgtgtggagggaaaaca

SEQ ID NO: 3554 - DNA, 3940 bp, Toxoplasma gondii
tcatgggagccgcagaagtcgacggacttgcatgaatctagtttttgtcgaggttgttgctgttcatccctcatccttgtgtgcggaactggatagacgagcatacaatgtgcgtagggtactgcgttgttgtcgtgcatgcatgatgctgacggggtctttgttgggtcatggccagaggttgcgatgtgacaaaccgctgtttgaggtggtcctggttgcgtcggagtgagcgcagtaggcgccccagttcagcaacatgtcgtgctgtgggagaccgatgagagaatccagagatcctacgcttgtgccgcaggtgaagatagctcctcaacatcggcccttaccgctgttcgtcttgctctgctgaggggactgcagccaacaataccagcaggaccacagatcggaattagcacacctcctggcggcagatcactcggcagcccgcatagctcccgcagttctgagagctcaagcaggtctgagagctccacgaccgccacttcgtcagacgatcagggttcgggagggcgcgaggagaggacgctagcgggcgcgacggctgtccctgcatctgctagtcccccgggtgcgcggccgcaaacatcgcaaccaatgaaggaaatgcttttgggtgccacttcgccggcggtagagctcccgcttggcggtgcaacaccgttaggcctttctggtggctcgtcactgggaacgccgtcgctaggacatcctccaagaggtccttcgtttccttctagcctgtcgctatttttgcgcggaaggcgaattcccttcagatgcccacgacctgaggcgtcggaacaacccgagttcccgggagattgtaatgactgactggccaataagacggaggacacgcatgctacacagagcactatattactcaacgcggggacacctagtgacacgaatcaaggcgtcccgcggacacggtcccgacgcactgcctgtggttttcgtcattactggaagatttattcgtagtccttgttagtcggagacgcttcttgaacactggtgggcagcttgctcgctcgatacagtcgatgcgatgctgatggcgttccacactatatttattttgcccttttcccgctgatgtttcctggcagaactgaagagcgcgtcagagtgggggcatccaaggaaagccatacatgcgcatggtttgaaggaaattttgaaggtggcggtagttgaagtggaggcggcaagtcgctgactacgagggggggagacactgcacttggtggggacctgcgagcaacgtgattctgcgttatcacgcataccacgaccccatgtgagagcatttcccgtcttgatctacacctactctgaatgtgcaaacacaccaaacatcgcttgagaaatcctcactcgctggtgtgcgtcccgagcttccttgtgttccgcattgtgagcacacacggcagacgctgaatcgacgccgcgctgtccttctgacgcgacacaggcgtgtacgtcttttcggggactttcacaagtgcaaaggtgtcgggtccggatggacgacctgactggcggtggcaggcactccgaatgagcagcgaagaataagccttatttgctgatgatagatccattagaagaatgtctactcaaatgcccccacatctgctgttgcggttacttctcccgtggcatatatcgttaggtagctgaactgacagcagtcggtgctccttcacatatcgtttcgtcgactgctttgtttagcctcttcaggcgttcaaactttgatcagcttgtttcttcttgtattcatggataggtaggtgggctgttgctttaagctagtcatcgcactcaccttgttatgcttcatacctcaaatgaatgcattcctttctcgaaaatgcacgacgaaaaacggagtcgggaagggcttacattgaacaggtcttgtttgtaaaaagaccaaagcgcgaaccctgcaatcaatcccgaatacaccaggtgcgttgatgcgattgtcggacaaaaaacacaacgtaccagttgtcagcgagaggccaccagtgcagacagaagtctccaccgtactgactcagcagagtacacagcttctgtgaaagtacttgcgctctgtttgatgttcttctgaacgttagcttgagacattccgtcccctttatgattatgaacccaggcccaggcgaggtgccagtttccgattaactgctcgaaagccctatcagtatcttgccagtatcgtgccttgatccaacactcttttccggtgggcttcgcgtcgcgaaggcgccgaatgtatatattcggttccaaaagacaagtagcctgctacagcacagcttgacgaaccccactccccttccgatgacgagttttcgtcgctggttgagcaaaagcgagcggaacctttgaacaaattgttcagacatgcgctgcaagtaagctgctggtggtctgctgaccgatccagaacgagcgggacagtgttgagatacaggtattggagaacgaaaggaagagctgacgcctagggcgtcgacagtatctcgggcactctctggaagtcgtaatgctggtcattcatcctgtagggcgaaacggtcgctgacgttaccacaaagatgcagtgatgcacgggtgttgcacatcttctcgcaggtgtggcaggcaacttctgcgtcctcgggcacgcaattctcaacagttcttttctacacattcacttttctctaatcggagaccgctccaatggccttttgagttcgtctctcgcactgtttcccccaaaacacgcaatcgcctcccgcagatgagaggcgtctccaacagccccctaaggtcaccctcccttcttactcaaatcagaaggccatcggaacacaccggaggaaacaacataatgggaaaaagaaccatgggaagaaccccccttcgctttccctccctgttagacagcctctagccgtcttcgtttgtggatgcgagtggggccttcccaaaagccaagccaccgttgcaaacaaacttgtacgtgatcgagaccacacgctacttgctgttctcccggtcaccgccttctggtggtgccacggcgagcagcgagctcttcgcgagaatctgcatgctcgtgtattaggcgcgttgattcaattgctcctcgcgagctgcagctgccgaggcttacgtgaccgggcagacggcagcggtaaggtgattcggtttctgccgcgaaaatgtaatggatgcagaaaggaagcgcattacgttatccgctctccttcctctctgcaagagcaactgggatgtaattttttggctggaaatgatctcgcatccttttcaggtctgcgcgctcacgtgtctttttccccaactgggggttcagctgaaacacccgctgcctgtgcttcaccattggcactgacgaaaatttcgtttcggtgcacaggtttctttttctgtgcagtttctatgttccctatctctgtactgtgtcgtttcgtcggttcctcaactattggcgtgtccgctgtccgggcatgccccgtgccggtctaccacactttcccgtctttttttacgttcacctgctggtccattgcctgttcttccgtattagttttttcatgtgctttcccgttcgcacgtttctctccagtttccccttgggatttacttgtctctcggaggtccgaacgcttgaaactgccagtggcagcccccccgcgtatgcttcgggacccgctcgcctaaacacggcatgtccagtgtccgccgtgacaaaatctgtcaggtgaattgtgtcacaggcgtcgaattggttactcgttgtcagcaagtgcactgcctccctgctgaaccttgtctttgctgtgttctcctacgtgttaccccctttctgatttttccgctcaaacaa

SEQ ID NO: 3555 - DNA, 1364 bp, Toxoplasma gondii
ctgtcccttgtggcttttctgtgtcgagtgtcgacgcatgcagaaggcccttgggagactctgctcgcgcgccacagaagggtgttgcggagaggtcgaagagaagcagttgactagagcaggccacgtagagaagccggcaggattcagggtggaatttgacggctccgagattcgaggtcgagtcctccgaggcgcctgctgacaggaacagcggatgccggatgcatgcaacggctttctcttcgcgcatgtcccacagacgaacggtcccgtcgtcgctggcgctggcgaggagcgacgaagaccaaggcgtgaaggaccaaggcacgtcaccctcgaattctgcactcggaggccacaggctttcttgcgtgagcggcaaggcctcagaaaactgaccagcgtcgcagggacatgccggtgtcgagtgaggtgtagagacagaggaaggcgagggcggggatcctgaaccagcggacggcgtgtcgactgctttaagggcacctggacctggagctgcatcgaagggggcatctgtccgtttttcacaactcgctcgacgccggcaggaagacacattcccttcgaacccacacctgtattctgcggcttctccctcgtcttcgctgctgagatactgtcgcctgcgaggccagcggcagtgggaattgcggagagagaacgtagagcagaagaggtcaaggcctacaacggagtcttcgtggcccttcaggacccgacaagcgacggagggagagcttgcaccctcgtgcaaaggagacgcggcaggacctcgaacgtgactcatcttgatcgcagccggattttctgccgaagaagtctggatagcgggaaagaaagcctgcgaacgatgttctctgtgtatggcaagcactacgttgacatccaagggtcaccgagcgtgcaagtggctggtgtaacagactcgcagcgttcccagctacttttggagaggtgactgagaagcaaagcagtgggatggacgcaagcgcacgcgcagcgtcgaggaactccagatttcattgaaaacagaagaaaggggctgagattgacaggggaagtggcctttcccacgaaacgggcggcttttttgtaactccgcaaagcagcatgcctcatcggccgcacgcacatgtgtctgcgcccgatgtacccgcgcgccgatgacaagaatcctggtcggaattcacgaaaatctttgaggatgaagttctgttctagattggagtggacgcgggccttgaatctgatctttggtgcggcttggaagaaaatccacggcatatcatgataccggtgtctcggaaaactgcagacgcggccgtcgattgacgcacaca

SEQ ID NO: 3556 - DNA, 1707 bp, Toxoplasma gondii
tatatgtatatatcgcccaccaaacgacagattcagtcttgaaatatacatgcagaagcatatagctgcatgtgtacgcacgtatgtggaatcgcattatatatatatatatatatatatatatatatatacgtgcctatgagagtagcgatacatatatacatatactttagctctatgcggagagacattttgaattcaatgcagacattacaacgaatccttgtcgctctcttcaagtggcaaagaatctgacaaaggtcgaatccttccagcattttgacgaaacagtgacacgtttcaccaacatttatgtacatgcatgaaatgcatatttcctccatctcgtgcgtcaaaatcatatatgcacagtcatactttttctggtgtaagctatctcctttatgtacgagtattatatctgcttcgtttgttacacatattaatagcaaagcatggacacgtctctgaccgcactaatcatcgttgcttgtttccgcttaactctcttccagaacaaacggagaattcgaaatgttatcggattcctgtcgcagtggtgtcttcgccgctcgccctcagtgtgcgcaacaggtctgtccgtgtgtgtaagcataatatttgtgcgcatgaaacattcgtgtgagaccacaacgcgcgcacgtttgctccgttcgtgctcatacccaatccctcagaagactttgctgagaaagatctctctgtcttcgaaagaatgaagataaactcgagaaacggtaacaagctggtcacacgaatttgaagctgcatgctccctcctgcgacttagacctcaggtagcacaccaagctgagacgtgcaagcgaatatggcagtgcttgaaggcagcaagaaacgcgtaactatgaatatctcccctgcagaagtgatctcgtgaggatccacaaccagaaatgccgagttttattgctagcgcaaaataattacagaacaagcgcgtagttaaatgcgacgctgggtgatcggagttggctctctgtccactttgacgaggaagaaagcaataagacacgccgagaaatcaggaggataaagattattgtcttcaatgctgatatccggacttctgtatttcccgctccaacgctgttttccccttttccatggttgacagacgattgcacagaccttcaagtattcgtttcttcgctgtgaacctgcgacatggtttcactgaaaacagaagagcggttccagatccaaagcaggggcattcattttctttccaaagaccgcgtcaacgaagaataagcaccctctgcgagagaggggcaaggcaccaagagacgaaaacagcgtgtcgtggtacagacaccccgccacaggtcgtgacaaccgtgagtcgtcggtcgggtgctgtttttttgctcttggccttttgcgcctgcggcgttttttgaggcctataggaaaagaaaagtgtgacatctaattctttctgctattgtttctgcgtagtgttttcgtgttcgttcctttttcctttggctttcgatgcgtcttcacacatcagtggaaatccaggaacacaacacacggtgtagctctctttcccattctcgtttttccctcaagtgtgtgccattgtccgttttggcgttcgtcaagtgagaagaacagggagccggcgaccgccctcgtgcctggccatagcgactacagaca

SEQ ID NO: 3557 - DNA, 2024 bp, Toxoplasma gondii
ttaaatcaaagtttcagacgtggcacgctacagtttgcggttttctaaaggcagtttttctgggccttctgggtgcaagcaagatccactcttgaatcgctcgacactctctcggctttccttcagcaccagaacttaactaactgtttcaccttcttgtctggtagtacactgtgaactggcgtgctcctggtggaggttggtgactaatccgagctgaaaagtgaaccacgatgggtttgagcaacagggtttcttttcttggatgcttcctacggtgtatcggcacaagccgacacctcgcctgcagccgaatgcactcttcctgtagcatcatgacatgcaaatcgttatcaggactacttatgtccatcttgtgaggaggacctcgaagtcccagaagcctgggggtcaagggtttttataaccgttttctggagagtacagactgagagtcggacacctgattagatcttgggtactgctgtgtgagcacggtttcgagaacatcactctatagagtacaacaaatgcgaatcctcaaactaaaaaaaaaggcaaaacagaccaccaggaaaggaacttcctagtagtctcacccagcaattcccttcacacacaaacagccgagcacaaacgcaccctcagtggtggtttcttggagaaacctgcacagccactgtttgcacagagcatcgttcaattcagacacttttctgaaatttcacgcactcttgttcaccaggtgtctcctacgctgagaacggtgcctcaagacaatgatgccgctaacatccgtagatggacgcaaaaacacgagcggcctcgtcttcatcttagtgatgaacaactgaaatataaaatggaataggaatgtgccgctcaaggaacggattcatcgaaagatactgcgtggaagcagcggtccccccgactttccttttatccgccagctacgtcttctctgtgtagcagtttccgctggtaactgtgcagccttgagcatgataattccgagaaaaactggcagaccatggaggcacgaaaattttgaacatcgtcggctttacccggaagtgttcatggatgaattcatctggtttaagggtctgctcacttcaggggggttgctccaaatggctgtatgcgtacagagatgacataagtgctaacaaaccatcggtttttgatggaattacttttaacgccgaaccttctcgagtcctcagtttaagtttgtgccgttacattcaggagcacaccgttatattcgatgatcttaagcgtacaacgagcggggcgacacacgttgaacgttcacaaaacgctgaaggccgtagcccctcgccgttttcgcggcttttcggaagacgctgaagttcttctctaaccctttccattcgaattaactgtatcgaaagcacgatttgctgcgttccgaggtggcgtcgtttactactggtggttcacgccatcttacaactcttgtatgagggcaaccgttgtcgcgcactcgagcaaaccaaaaggtacgaaggcgaaagttctggagattgcctctaggaattgtcatcgaacaacagcagtgtgcattccgaaggacgaggcactcgtataccggctttagtgcgtgcagcacgcaatgaggttcacagcaaggcgacgctgaaaaaagtatttgactcgcgtctcgatggcgttcacacacaccgcgttcccgtgcgtaggcggcttgtcgctagtcttcggcatgcgccgcgattcactgaatgcccgtttttgcactcgttgcgccgaaagaatacaagtttggtattatgtgtcgaatctccaagcttgtgtaaggcttatgcgtgccgtggttgtacaaggaatccgatacaaggagtgaaaaatctgtgaggcacacagcagctcgtggttgcacgcggcttatgactcgtgactgattttgcctcgaacctgcggtgttgccgttgcttttgctttggttctcgaaaggacatctgtacgcgagttcacaa

SEQ ID NO: 3558 - DNA, 1454 bp, Toxoplasma gondii
gattggaacagtttcttctggcttactgtctgttgtttcgttccagagtgttgaactaaatctgtcaataacgcggaaggaaaagaacgctctgcaggcggatatccgatttgtgctggaacgcttgtgttgtagaaaaccgcaagtcgatttccatggagagcactctgtccgccgtatcagcagtgtgatcttggcgaaaagaagcacccttctggtttccttcgaagaaatgtggatttctaatgttccaccagctacagatgaagtttccgggggattacttttcgtatttacctttcttcattggtggtgcgaaatttcaggctaccggccgcattgctagcgtgtagcgactcacctcttgacaggtgtttgactatttgcttgaacttgtatcacaaagagttcaccacccgagcgctaaagacaagaactgtgtttcacggtaaaattatccacttgctttactgcagcaaagtaaaacgaaacactccgtcctctgcgtgaagtcgctacacacttcacttgatatgtcgccgatataattgtcgtagcatccctcatgctttcatctatcctgtgatgacgcccgatgtcaagcttgcgcgtaatgcggaattttcccgataaccaagttcagagaacttctagcgcagttctcttttgactgctgtgcaccgccaccacctgaagggttcggttcccgtcgtacatgagctggccagctgaattttagggaggatttcagaggcatgctcacttcttgttctctgaccatccaatcaagagaaaacgttcaacagttatctgtcgtgtagtctgacgcttgtcgcctcttatgctggcattgacggtcgaccgctatccacccggcacggcgactctactcttgtctgagcagctgccgcacaaaaagtcggagaaactgtctccccttcgctttctgtttgtgcagcccatggttgtcagtgaagcatttttgtttgtaacgtagcgggcaaagtccgatctaagttttttttggttggtgtggcccccagttgcacggcatcgaacagggggcctccgatgctagagccgactaacacaaggagggaacgcccttttcgaaaaattctcatgtttaactttggagaagaaggcgctttctaacggaaacgcggcttcaccttgaaaaggggaaggcgctttctaacgtttgtttactttgagagggacacctgaggctttcccttgcatttctacgacaccctttactgattaaaaccgggccaccagcagtagcgaatgtgcagagagagtcagctgaagtaaataattcaaactgaagcgctgaaactgtgtccccctctatgcagaccgccattcatcattaatttactggcctccttcaactgtttgaaaccggacagcaaaacgttcccctccggaggtggactcacacagctcga

SEQ ID NO: 3559 - DNA, 2798 bp, Toxoplasma gondii
ggtgacttccgaaccggatatttcagacatcgatctgctagaggatcgggacgaagttgtgatcatgtgcacggacggggtgtgggagtttatgactccagatgaagtggttgatatagtcagccgctatagcatatatcaggtatgttctgaatttgagatgtcggtgcgtgatctttggcctaccgtgaaccacgttcgccttctccaggaagctgtgttaatacgcagccgtcaccctgtgtgacgcccgtgcttgtcctgtggctgcaggccgacgaagctgcccaagaacttagtcgtgaagcgtggaagcgctggttagagcaggacggtcattctgttgatgacataaccgtccagatcatccaccttttccctcctgctgaagaaaagcatccgcgatggagctgaaacgtggggtcgaatgacaggggagttagcgaacgcacttttatttatttctgtcgtccacgtagaagttccttgattactaggggacaagtgtgatttcgtccaatttcccgtgtccagtgttaccaagaaacatgacgcatgaaacagcttctttctttaatcttgggcgcccttctcgaaattgaacttccacacaacaggagatacgacatagtccccacatatatcgggtgtggacttggcgataaactctccatctagggacagtctagctgtaacatggaattttctttgcatagcaggagagccccactttttcgcagtatagggggagacgttcgtcacggggctgcggtgtaggcccgtaggtccccgaagaaacgctttcgtgaacgactgagtgctctcagacgtgacttgaagagttaactgctgtaaagaagtcgtagctcccgtaacaagaagtgaaagctgtagacttattgtcgtcactttcataaaactgaaacgaacgtaaatgaactgcaatgcgatactacgagccagccgttgtggagtgctggcgctgcggcacaggtgaaaggaaactcctgtttcactgtggagctacgtctacggaaaccgttatgcttgaatgtatgagcatgcggtagcttttttgcgattcaagagaggcagtaagttagatgtgaatactgcggtgaagcgtttgacgggccgccggtcagtccgcctttcggagtcagatccgtgagtgtcgttggatttgcttcgccttcgaaacctgaaggctttctatgaatttccaagctgcgatgctgcagcgagtttaaccccactgccttagagaggtcgcgaaaatagctgtagcctgaagctgcggaggtgccttactcgcatgtactaccaaacggcaaaacgtaccacgagccagcaaatggtcgattagagatgcagttaccaacctctggatcacttatattcgaggaaacacaaacaccaagaatcacggaattgctcatgtttccttgaagaggggggtgtcccagttgaattccgtttcatcttgctaaaaaaagttatcttccgtgtccattccactgggggctgaacagcccgtgcccccgggcacttcacgtctcggccaggggtgtcgcgcgaccagcactttgtcctgtcgaaacttgccagtggtgtctctttgtttttcttgacgttcctcacagactgtagggagtattgtttccttttgcgtaattcatctcatctgtttgtgtgaggtaatccactgaccgctgcagctagcccatttaccgtctcacttggaacccaccggtccaaggcaccacacgggccacggcggtcggcccgcactcgtcaacttgaaatgggaaacacggcgacatctgggtggtgaggtccgtcgacgttgcgcctcgtctgacaatttgtgtcactaaaatttgcgggcttcttccctacgcctcatcaacttctctattttctcattacgatgtggtggcctcactatttttgcctgggttcctttccagtttgagggcgatatactgcgcggggactctgcttctcttgatagctttaacgcgcgatttgcgtaggcgtctgggacgtcgaagattaaaagcgatacttaataagttgtacctcgattggtgcagcagtggcgtgtcagtccgattttggtgtccgaactgagtgagtcggcatccggttggtcagatatcgaagcagtcgtcggggtaaaatcccctcgctgaccgcgcacgtctggttgcacgcttttttgtcaccgtgtgcccgtcttcaggttgatgaagtcttcctaagattggaaagcgttcacatgggaactggcgcctcgaaagttccatatcttttatagaaacgtggggtcgcgaaagcaggggtatccgaaatttgtagtcagccccctgtgatcctgaatgtcttcggttgcaacaggtgtacgtggataacatgatatgaggcttgtgaatcatgaagtgtcatctgtaggtgcttcaacccattgctgtgattgtattcaatgcggcatggtttttgggaaccctgacgcgacgccgccttacggacaccaggcctccctaaacaaaatagcattacggggctttcgtcctcgacattagcagcaccgccaagagcgctttggtaccgaaacaatcgaatcggcaggatttaagctctttcgtgtgaatggatctcctcgtgagctgccctgaaaatacgtgagtgacttcattacgtgggtggcagcggccagacccggtttccgcttcgaacggcggtcaaaaaacaaaaaaatcaactcgaaagctgctacacactcagggttctgggta

SEQ ID NO: 3560 - DNA, 2791 bp, Toxoplasma gondii
tcttctttggccaacactctccctgctaatctgcttttgaaattgaaggaaatacgaactttcgttgacgagctcctgtctctctgtgacagagagaggcggccagacgcgaacatgcttgcgccacagtcgaggccttcaccgaagcctcgagagaggatgtgaaggcgagacttttaaatccgtttttgccgcgacagagtcctgcagagtttctcgcgacttctgtaaaaaaagtaaatatcgcgcccggacacgagatacgtttttcgttctctttgaaaaatgcacactgcagaagcgccgcagaaacatgacggggcaagtgctacttctcgaagcagttgttgaacgcgagcaaaggcacaagatgcgtctgaagtctttctactcacgagagagaggtagaagaggactgcaacgtcctcgcaactcagagacacaaaattgtatgatgaattcagattcacacttcgcggatgtaacgcatggctcacccacaggagacaactcacaggcacagtagcgcgagccacgaagaagctggatattgcaaccgatttggactctggtggaaaacagagttgaacgcaaagaagcgtttctatttgtttttgaaagagcctcttggatttctacaccgacttctgtgtgtgagagcgacttcgcaagcgtcaggcaaccgcgtcctgacctgtatctagaggtcattccaaaagaaacaaaggcggaacaaagacacagcaagcgaaggagacccgaggagaatgcacagagaagcaccaaaaacgaggaagaacaaacacaacgagggagcagaaatacgcggagagaaactgaaagaacgtgtctgatctctgtgtcagagcaaatgtatgtttcgcactctacatatactctcgcttacagtgatccagataaatagagaaaggtagaactattcagaaacgtatcggcatgtttatatcggtatctttcttcacgtataaggatacacactgaactgtattgatatagttgtataggcgtagatatagagagatattggcagatagatagatgatagataaaaacatctaaaaaagtcatacatggatatttgtacaagtgatacatataaatatgtatatgtgaatacgtatagatatgcgcataaaggtatgtgacatacatagatgcatacgtagggttgtggcgtttccaggtttgtgagtgtttttttagacagtctctgcgaccgcgtccgcaatggtttgcatggttagcaactgaaagaaaggaatgcaccattctctcatggagagacaaagaagttgatctctgcggtctgaatgccgaattgtcggagcttcgttgtacccagggtgtgagtcctgacacagcttctgtgtgtgccgacgtctctgacccctgcgtgtctgtcgctgtgggcaagaacgtcgcaattctgagtgaatctcctgagaactcttccgcttttgactttcaaatctgtagaaacgcaaagttccatcattgccgtagtgaatttgcgagagaaaacacaaaggcgagagggttttcgcctccggctgcagccccgcgtctgagaccgttcgactagccggcatgtgtgtatacagcacacagtgcaactttcgcatttctcgcaaaggcgggagagcaagctcggcagtttttccagcgactctttctctccactttccctgccctcaccagaaggaggatacacgaaaaaaaagcgacagaaaagaagtccttccctagtactggcgttctacagaccctgcttttgcgtagccgcgacactcgacttttcgggtgtacagacaacaccgggcgcttctcgcatggcgtcaggcgcgtcccccggtctggttttcggggtcacttcttcatttccttttctttcacggatcccgcttttttctctgcgttgctcttcgttccttcgcttgtctggcgcatgcctcgcatgcggcttctcttcgggggctcgctacgcgggtcgtcaaaggcgcgcagccttcgcgttttcttcgacttcttgcgcgtcttctgctgcgccacggctcgttcgttctctcactctcgtgctctcgcgctctcgggctccgttcagatggagacaggttgcaattcagtcgccgaatcgactagccgaaaatgagaaccgcttcacccggcaccgctgcggtggcacttgggcgtcgtctgggcttctggttggcggaaagcgaccccgaccgggggcaggtgtcttggttcctcacgcgagatttgcagaacgacgcttgatgctgcctcttcctggagaccaccgagatcaccgtccgcaggtttcagcggcgcgtttcgcgttcatatccgccacccgcaccagcagagagggggcttgaccgctggggggagcggactgggagcgaccgaggaaagacagaaatcccttctcagatgcttatcgctgacacacgtccacttctgggcgattcttgcgaacccgctcatcggctgcatgcgtcagtcgaccgcaagggtggcgaacactgaccttttcaggaaatcgctattttgcgaagtgcagagaaagacgcacggcggtctcgcagccctgctgcttcgggcagatcagtggttctttcaggccttcaccgtcttctcactgtctgtttctcgcctctcctgagtcggctttccaaagacactccctggcggcttctcgacatcgcctttaccctcacaagtcgggacccaccgtcccctgtgcggccggtcgcgcgtctcaccacga

SEQ ID NO: 3561 - DNA, 2936 bp, Toxoplasma gondii
gggacttatccatgtaatcaccagccgcatcgtaatacaacttgatcaagtccaccttgacattttgtcccgtcctaagtcgcgttaaaagtaattcttgtcaaaaaccgtgtctcttcgatacccaaagaactgcagttcccttatatatatatatatatatatacgtatatataacctatcaccctgcgtgcaatacggatgttagatgactgaagtctgtatttcgattgccatgactctgtgtgtcgctggaggtagtttcgtttgactatttcttgaaaatgcttcgttcccttctacacgtctgtggctggtgtgggatgcgcttctgtgctttggaacttctgcggttgccggcattggctacccgaaagtcatcttaaatgccgacttgcaagacccctagttcgtgtcagaggacatcgcctactgttcacactttgttccacgtggcgtccgtgtcagcatctcagctgacgcagaagtcgtcccagacgtccgcagcgtcggaagagtggcttccttcgcggttttcggagttttcctttgcaccgcgcaagcgtcgcagaaacctgcggctctgcaagcgtatctaggtgccgccagtgtcctctatgaatcccgagcttcgggacagaagaaatgctcggttctgcgacgtcgctgagcctccggtgcagccttgtgcaacctttcgcaggcgcgtacgttgtttcctctcgagtttatttattcgcggaaggcagagacgcctgcacgagtccacagaattcctcgaaatttgcgcaagtttcgttctggccgcgattcaaaagatgggcagcccctgcttcgcttaggttcagacccagacgggctgcgaatccctgcagttcgccggcggtcaattttccgtctctgtccgtgtcgacgtactggaaaacttcacgaagaacttcgggaagcggcttcatgagctggttgtcgacaaaacagagaaacgtcgggaagtcgaccggcgaggcggcacctttccccggatctgccgccgcacccggaccacgcaactcgacgagaagcgctttcacttgatcgggttccagaggaaacccaacgcggtctttcatgaaagccatcacgtctgcctcactcaacttcccatctccgtccgcatcgattctggtgaaaatcgtttctagctccgcggcgtgcacacgcagccgcggcggaaccttatcgagtgctgagggtttcgcgccagcagaagcgctgccccgaggcggcattgtgcaaataaggggaaaacacgtaaggcagaaaggactcccgctaaaaacagcgcagagaagggatctttcggttgcccgcgggaaagcaggaaattgaggtggaacgcagagctcactacgggattttcggccaacactacgctaaacggaaacgcgggtggagaccatacagaagcgacagtttccgccacagaagcagaaggaaggacgagacgaagaaaatgccagaggactttcgatgaggagaaacaaaagccaggaataagcatagagttccacgtgagttgtctaaaccacgcacagatactgccgacttctgtgtaacagggacagacgccgtcagcttggaactggtagacctgcgtgacaaaagaaagttttcgttctaggaagaaagtcacggcgaaaagaagaatcacagtcgcgacacattcgcgtttagggtttacatgtcttggtcgtcgtggtgcgagcgagaggaacaaggcacgccgagtgtggagagacaaggaagttctttatgaaatctttgagcgttttccctttggtaaactctgtatatatcttgtgtatacatctttcattgagatggaaagcaccccagtcgatcgccgactcgttttccaagttctctctttctcacgagaaaagagactccgttttcgatgctaaaatcgtgccgctcagctagctgctcccccgtgagtcctcgctggtggaaacgcgagaacatgaggaggtgtgagaacgcaagagaggcgctgtgttcgacgacgggggtatcatatctcgtggcccacgtctgagtccagatttcacgttgtagcttccttaagtcgaaacaaagcaagactttcaactctcactcccttaaaactcggcgatcatcagccgaacaaccaggttacggacaggtagagtcagcagtcgctgctgccggaggtacaggcgacgcgttttgccaattctgcgacaggctcaacattctgggcaagcaaggcggccgtctctgtgaaggagtccgccatctgattctcaaacgaagtcaagatctacagtaaatttttctgagacttctgcgtcgaccacagtccagtgacaaaagccaacggagcagcccgacggctgcataggctgcggcgtctccttcaatgcgcgttgtggtgttttccagtgctctggggcgagaaaacgaaagcaaagactgcagccgatttcgttagagtgtcttgaatcgctgtgcctttttgagagttctgtggtggactatttcaacttctctcgggtattctgtgtctcctgcgtgacagttgcattcctgactctggatgggggggagtcggtaactccagaggaaaagtgccgcagtcccaccgctttttgtctttgttcggcggttcgaagtgggctttcatgtgaatataacgtgggctttctcttggtcagaagagcagtggaaaacctctactaaatgcctgcacctgccgacccgaggcgagctaggttgagtggtgcatttcaacgttccttcccggctggtttcgcgtattgaaaactctggagacaaagtaacagtcctgggcgcactgttgtacgtttaattagcgtccgttaagactttctcaaaaacgcggggattcccgtcatccatctctgccggcacta

SEQ ID NO: 3562 - DNA, 1706 bp, Toxoplasma gondii
ttatatgaatacctacggagtggaggaagcataccacatatacactgatacatgcatttatatatatgtatgtatatatgtatgtatatatgtatatatatgtatatatatgtatatatatgtatgcgcatatgtataaagaggcagggcagtgttttgtgtgtactttggatggttgttttttgtggacttcgttgtgtcggagagttggctcacctgtgcagccacccttccttgaagaattctggagcttgagaagctctcgcttgtgggctgatgtactcgcgagtcggcacagaggtctgcacaccgacgctgcgcctcagaggctgagaacctctctcctgttcagagaaggcgtgagaggcgggagaaaaggaggaagcgaacgcggcagagacgcgcggagcggcggtccccgacatcttgaagagacgggagaagcacagagagaaagaaagaccgagagaggaacagagacagacagaacagacggagacagcgacagaacagacggagacagcgacagaacagacggagacagcgacacaaacggaaagaagtcgagatggaggcacacagacagaaagggaaagaggcagaaaggaaaaggaagagcggcagctatggagacaggacgagaaacagaggaaaaggaagggggagcgaagacccagaagacagagtaacaccgagtgtttcaagctgaaagatgagagcaaaaggatcgacgacagcgtttctccccgttcttctcctgtcttgtctcctttttctccgttccctcttttcctgtcgccgagaggatctttccccgttctcgatctaggcgattcgcttttttcctccgtcctcttttctacgttcttccgtcgagcttcacgacgcgaacgctcctcgctgggccgccgtaattgcctgtcgcttgaaacgccggcctgtcgccatggcaggcgacgcacagacagggagcagaagtctctgcccggtctggaaaatggaggctgttgtcttcctccaggaactgaagagacagaagaaagagaaagaatagacaaaggcgatgaaagcactctgcttggccgcgacgccgtcgcatgcagagagccgggagacggtgatgtcctctgcatgcacgacggagagagccggtgcgcagtcgagtctcggagatcgacagaagcgaggaaacaagtggaccaaagaaaaagggagaaggaaggggagaagatccaggaggagacggaagaaacagaagagccgcttttcaccatcgacgcgcctctcagagactacctctgagtgacgagaaaacgcgagaagagagaggcggggaagaaagcaggacaaagtcgcccggagcgccggagacgaaggaaagagttgaaacgcggaaggcaaaagtgtgtcaaatggtcttgcatttctcactatctcaaatgccttgaagttgggtccactgccgggggaaagatgacaatcacttggtcgcacataccttctcgctcttcctcgtcagtgtctcttcgattctgtctctgcccccatctcacgttcctctctcctcttcgtctcctgtcctgtcgcgccttcgctgacgcaccttcgtcgtctctgtcttcttcctctgcttgttcttcctctgctcgctcttcctctgcttgttcttcctctgctcgtgaggtctacgcttcaagaactcacca

SEQ ID NO: 3563 - DNA, 2003 bp, Toxoplasma gondii
caaaaccagactttccactccagtgtggctgcgactgctacgctgatcctcctttctcctcgcgcttgcgccgcttctcacttctccccttgtctctcgccccgctctggacgccagcgcgaagagctccgccaccgggagagacgcgagtctctgcagtacctccgtcggctctcgttgcagctcgtcatccttgcacgctgcgctgcatgtgctaggcaactcgccctgcgtcgcagcggttgcgggagaggaggtcctctctgactcgccggggcctacgctgtctgagctgcaggcgggagcagagaaacgcctatggacagcgtagagaacagcgagacgaggcacccggcgaggcggcgaggcgaggagtggagaggaagccaagagagaacgaggcgaagcgacagccgattgaggagacgaagaaaggagaaaaggctgaaaagaagaagaacaagaagaagaagaagaaggcgcttgggaacgtggagaggagaaagaagacagaaacctcgaccgagaggaggaggggaagaaagagaaaaacgacggcgaggtagaaagaagacccgacggggggaacgttggccgcgagaaaatcggagaagttacagatactacaatggttgacagcgatgtctcgcgagactgcagctcgtaagggtggagaaaactggaagacaacgtgcaagcctcacgcagggaagcagcaggagccccggccctcatggtctgttgagtgtacgtacaccagaacgactccagcggccagttgggggcctcccttctgtctcttttcagcttgcattgattcacttttctccctctctctttctctccctctgtgcctcagcttagacctcctgtgttctccgctgccttcgctgtctctctcatccgagtccaggggcgttcttcttacgtgtggacttcatctactctcaaccttcctttacttttttcgcgcgagatgtttttttcgcgtcggcttccctctgacagactctcgctctctctctccgaccctgtcagacattgaggccctctcctcggcgtctccggacgcgaggcttttacttcctatcggaggcgagccgacacacaagtcaaaggaagctgtgaaaaaagtcgggggcatcaaggaaaggaaacgccccgagttgtttgacactttcgcgggctatttctgcgcgatgcgcgtgcatgcaccttgctttgcatgcatgcaaagaagcaccggctgaccgaggacacagaaacctgtagacactttgcccgcggagtgctccgacattcttcttcgcagttccattcaaagtggcacctcttgtcctcttttatttttcttccggacagtgctgcaagggagtttttttccctcgagagtgacaactcctttctcctgtcgcgcgtgccgggagttgaactggccattggctccttcggcgctccaagaagcagaaccgtcttcatctgtgatttcgcgagttcgttgagtcgtttctttcgttgattcatcgttttcttccacgctgtcttcgccgtcttctctgtctcgcgttgacggctctccccgctgctccgtaggtctgtcgctgcctcagctgttgtccggaagtgagagcttcgtttttccgcgtcttttggttttgtctcacttcgccttctctccggttttcttgacgtctcgttatccttttgtctccacatttttcccctcttgctatctgtttcttgcttccgcctgcttcgtctcctctcacctctgatactcacggcgccctccctttctactttcttgctcccgggcgttcctctcttgcctctgttcgtacctctctgtctgtccactccgtccctcccgtttgctctgattttctgtcgtccgtctgtcttcagtctctcccggtctgctgtctcgtggaagattcccttctcccttttcgaggttttctttcctcccctcaggggcttcttctccccgcttcggctcagca

SEQ ID NO: 3564 - DNA, 4416 bp, Toxoplasma gondii
acaatgtcgagcagcctcaacaaagtatcttcggagatgctccgaatatattctcgcacacgatagtctactactggggcaggaacctgatatcctgtgagcgtcactcctcataatgaaggactgtgggcggaaaagccatcagttgtcactgctcgcctcataatgagaaagatgcgacagaaaacctgtgccaatgcaaacccgccctcagaaaatcgtacaggagtgctatatgattagaacgcggagttttagcttctgtttttctaatgcccagttcgtgtataaaaataccgcgttcaggcagccttttcggatagaaaggtgccagaaaacaaggacaacgtgtagcactcggaggaacatctctcaaagataaaacggatcgttcttcgtcaacgatcaacgatcgacagaaaaagaaagtagttgtacagtagcactgccacatacggaagtggaaaggccgaaaattttcctgctgctgtttcccaagctataacgtcacaaagacagaggccgcagcaaagagacggaggccaacgaatagaatacagaatactcttacgagatgctccacagggtcagcagcaccaaacatagttgcagctctgaggcgctaaaagtcgcttcccctcactcgtcactgtggcttcacgttagtagccccttacgatcactgtgaagctgaaggggaaaaacctggaaagcaagttaatcctcttaagaccttatgtatcgcggttacccgtggttttttctagctcttttagtttttccctctcagatgctattcctttctgagcgtcaacttctctgtcgtttagcacggtagttgctgccggaaaaaagtatctgcggaaaaatgctttggccaactgcgaattcctcctactggacgattcaatccattgcttcgcatcagcatgagtccccggaacttgaagttctgaagccatcttccacatttgaccatgaggccctttttcgggatttctcattccgatggtttccttgtacttcttatacacgcttccgtgcttcttttgccactgaacctcctcctcttcgacatgtttcatttcatcttcaattgcagcgacaacatcacgaaacgggtctcgtaggctaccagcaactgaagattgtcctgaaccgtcagataaacgtgacgacagctggtcatcagagagcgctgccctccacgaggatgggtctttcatcgcgggttgcatttgctgctgtgacggctgtagttcatcagagatcgctactgccaacgaggatgaggccctcacttcgggtcgcatttgctgttgagtgtcgcccgagggaggaagcgacccctctaatggctgacgcttcttgcgtttgttctttcccagagacccaaatgcgtttttgatattattcaacttcttgatcctgcttttgcgctttcgtgagggagtttcatcgacagattcatccggaacgtgactccccagctccgtgatctgtgctcgtttttgttcagttcggtgttcaatgtcgcttgcacgatccaggtatgcctgatcaagggtaatctcgttctcaagctgcttcttcacttcgtctgtagcccgctgactggcggaaacctctcgcagcaccgatgctgttttcacgccgattgcaactaacccaataattacagcggctcctgcaacgtaacgtagcagctgcttcagcttctgtgtacgagcatctttgtttcctgccaagatgcctttcgaaaatgagagtctagaagatagatggacttctccactaactctaccgggactaggcaaaatgtcgtcctcatgtactccaatgtattcaggggtagttacagatccagtgtcgattccaccggcatatgctgcccaatcgtcggtacccatcgtcgaacgtaccggataacagaaatgggaaatcgttactctgggagaggcggggtgtatcttggagccgcacgatttatcatccggtcgttcatactacccagttggttttaccccgcagacgacagcaccgaaatccgctttaggttttcatgttgatcggaggcgattgccgtctcggatcagagttctacggtgaatgcgcgcagcgcagaaacagaaacaggccgtcagtggcagactagactcttcacagtgtacttgcgagactgcatcacgaagatgaattacacaaacaatggactaagcagtcaacaatcggtcagcgacgaagcactggaggtaaaacttttcgcaaactgagccatttttagtgcctcttcctcgagcatactgcccgccgcgtctcttatctctgtagtgccgtgtagaaggcccgtcggactatacgatgccttccatatagccgctggatccgcatgcgacgaaggctgacgtgttgtcctgtctgccctcaatttagcatttgcagattgtggcattcgcggttaagcacgtcgctcctcaaccgctgctctgtggggcatacattaatatccaaacgactatggaagtgcttctgtagttgaattaggggtccactgcgcgcgtccatttaagcgttgtgctcattctttctcttgcaagctcccgcagagctcgagacgttcactgttaggcagtaagaagtgtctcgctgtgtgattttttcagacaacgggacctcggctagctacgccctataacgctccctgcagtgctactgaacacaccagccgccaggaaagtgtatggcaggctggtgacggagcaagtacatgggatagagaacaaaaaatattgtcgggtttgcagttgaatccatcgtgcacaagcaaccatcatattctcgccaattccgtatttcggcatagagttatcaatttttatcgctgtttcgggttgccacatgctcgacggcgtgcagtggagcagaggtttcgccttcgcccagcgatattgtctactatttgttggtttcttcggactgttctcctcttctgctatcgaatcctgtcccaggcctgacgatgcccccgatgtcagaagttttaaacaggaagagtatccgaatcgtgtggccccgaaaaaacttcggtacagactacagggcttgagcgtggcgcagccggtgacattacggatacccgctgaggcattcggcattggattcgtttagctgggcgcgcaaggacagagtcgccttcgtgaaaacagattttttctttgcattaccgcagagactagtgtgtgcacgtgacttgggagcgtcgctgtaatactgcatttgtgggcagtagagtgctaggcagcatcccggaagttttcagacgtgtgctaccctcctcggatttttccctcacagaactgcgcttatatcgccaacacggtaaatgttctcttagggctggtctaacacagtacacgagcgttgcacaggccaaaacatacaactcagccctcggcggcggagcacaatttgggtagcggtgcgcttagggagtagctgcagctatccgagcagtctctttgaatacacagtgcattcgcttactcctccttgctgattttcacatgaacatgcaaatgtaacataaaagagtaggctgagttggagcagagggattacgaggagcagttgccggctggtgctatgagaagtcataccgttacagcaacgatggctgaacgtcccttgccgtctttctgtgagactcaacaatgctattgccgaggatggttggcggcagtcacaaacttcctaacattcgctgacaagtatttcttttctattcggtgggaaatgcgccatgcaggctttgacttctgactaagtggccagtacagtgtgttggctgtgcgtgctctcgcacgattgtactgcgagacgccagaagtgttctaaactgatactcgcagattggccggcgcgcgtgcagaatttcttccggtggcacctggcctgccgtgctaaaatcgttcaggtactggccgaggtagctaaccgacatgaaaaatccccccccaaaacagtagaacacaacctttttcctgcaaaatttcgagatgcatcggtaacagatacatccttccactgcatgtacagcaccgctcagcatgcgcactcttttttgtcgtcgttaggactacctctattccctcctaattgctggtgttgtgtccacaaataacggcgtgttcattgttgacatcaagcagtatttcgaccgtatgattcagctggtgaggcggtctttgtcgtcagttgcccgtgtttctgcgtcttaagcctccctgtttttccggacagagtccccgttgccagtgcgttccccgcacgtttccgtgcgcaaaatttgtgtgtgtctacggccaaacaactgcattagcttttgaggaaagctcacaagagaaaaagctgagaaaa

SEQ ID NO: 3565 - DNA, 2023 bp, Toxoplasma gondii
tttccactttttatacgcggaatttcacttttcatctcctaaatgaggtcgtaggctccggaatcagaaaaacacgctgttgaaaaaacagcttcacatgttgtatcgtaagaggttttttttccacttttcaggtttagggactattgttatgaatcgcggcgactaggatcgcagatggaaacacgagatgtagactacgttccatcattgtaggcgtgctagtagggagtctgttccaatatttgctgactgtcccttcttttccacatgtttctacgttcggttccgaacaatcagcgacaccgtgaccgctgccacgccgttctactcagcgaactttattggagccgttgcctgaagaacccgttttcataaagcaaaaatgcgtgcaagaaacaaccgtccatgtacgaggctacttcgccaacgaacagagaggaaggaatgtcacacaaacatttcgggtacagggtactcttgagaatacggtttttctgtaaacgccttcatgtacggaaagagaagctgcaatagcagtatcatggaagcggcagtattacatgggccttaatcgaaaattctggcttaagggtatgcgatacacccgatgtccagccttaggctcttattgttctgaccataccactgcttctcagcgggcggggccaaaacccatggcaatggactttgagatcaagtttcctctgtgtttctggaagccgtagggcatctgcttttgctaaacgaaggcagccgtagatagacggaaggtgtctcaatgaatgcggatcgggtgtgatctgttgaagtcacttggaggtacacagtctatcgccgctgttggatttgtgtttttccatcacacttgagacttcgacgtccctctggtacggctactagccatggtaaaccacacagaaagacatctcctgaaagccgcaactgcgtgaatgactcatgctccttacgagaaaatgtcttcgaaggtccaaaagccaccaaggattttccatgcatttctgttcgcggccgcctggtatgaacagccttgctagcggggccacgatcccatcgaatagtggaccaccgtcaaacccctgaaatagaactcgaaactcgtaccccctcgccggaaaagaaatgaagagctttggtgttgctctcgttgcaagcagccattgtttagaaaaggggctctgcctggggaaactggtcttgaccagttgtagtctgagcttttaacatgcatgcagccagcatcgatggaggcgcagctgcagaagacatgcacacgtcggatgagaaagaagcatctgcctacagaaaaggaattacgttggatttgactcgctttcggtcagcgtttctgctgctgctcttcgctttagattcagaagttccgccttcccgctgtaacaaaagcgttgttcttgctgaggtcttctttctcgccgcatcgcctgcgacggtggagcatcagcagatccatccacgcaaagttgcgttgagtatgaaggttccgtcttttcctttcgttcccgagcttggctttctcgcaccgactccactgtttcccactgccggtgtgcctgtgtcccttcctctccaaagttttttcggagctttcattacgcatcgttacaagggagctagtggaatttttttggtttgtgtctgcctctgggagtgacccccctgagagcaaggcagtctttcacgtgctacaggcgccgtcgattccaaagcctgcttgacattcactgagacgctgaaggctgtccctttttgaccagtagcagggggaatgacagtcagaacagggcggttgcccgaccgcctgggccgcggaaggcatgccgaaacagtctactgatattccgttcttgccagttaccacgcgcagcgagcggttagcagtaacaaccgtcctggagcctttagacagcgctacttctgcgccggataggcgccccggaaatccccgagtcgcgacatccccatctccgtccctgtctaagta

SEQ ID NO: 3566 - DNA, 3151 bp, Toxoplasma gondii
gaaggccgagaagacggcaggctgctttttccggtcgtttctccagacgttttgccggctgcgtcgtccctgtctcttgaagcctctgtgctcggcggacctgcttcatgtccctcctctttctttcgtgaatcgagccgaggaaacaaacaccggcaattgacaaagtagacaatctgctcggcatctccaaccagctccgcggatctacgcagcagtcgaagaagctcttgcgcattgcggtcttcttcgtctccgttttctcccctctgttctccttccttttcctccttttcttccttttcttccttttcttccttttcttccttgtcctccctttcccccgtctcttcgtctgctcgttctcgttctttcgtcgctgacaggcggagcaggcggtggtctccgaagagcccctctgccgcgttgttgaagactcttttgaaaaacgttttttcttctctcagcagctgtctagcggcgtcgagtgctggctcttcgtcgtcccttgatgtcggagggagctccgcgtcttctgagctccggagagccgcaaaaaagtgaagcaggcgatccaagtggtctcctcctagctccagcagatgcagcgcgacgtatcgcgtcgacgccgagaagagcagagacccggaagaagaaggcgaaggagaaatcgaagagggagacggggaggaaacagtgaatggaactgaaaactcggagcagaagaacaggaagtcctccaaagtgaagagaacgagagcacgcgcgacgtcgctgtccaagaaaggctgttcatctcgacaaacagacaacaaagcagaggcgggaggctcgagcgaagaggaagataaaggcggcgaagatgaagaagacggagaagaagaactgaagggatcaggttgagtgcagttgttctgcgatggttttctctcctcaggaagcacatcgctgcgtcggctgtcttcgttcgcggtctcttgtttccttcgcggctgtcctttttcttggaagtcctgttctctcaggaaaatgagacgcgcgttcgaaaaggaagcttgaaggaaggggaggaaagacgtgagctggaggaagcgagcgccgagacggtctcggcaaaacgcatgcagaaaagtgctcttccctgcattttggtcgcccacaatcaacaaactcaccatcgctgtctccccgcagtggtccaccaaatgcgaagacctcgctgatctctcgctccactcccctctctcttcttctccatcttctccttcttcttctctctgttctccttcttcttgttctccggcgtctgcctccacctgtgtgcctttcctgcagctcttgcctctcgctgtcctctccagatgtctgtggtgcgaggaagagacagtcgttcgaagaggactgtaaaagagcgacccctggggcaggcggcgacaggagaggtcgaaggcagaaggaaggaaaacagagtcgtcgatttcttcgtgccgccggtccaagtgtctgtacaccgcgcgctgctctaggccgaaggctgtttctcgaatctccaatccttcctcagctgtctctgcgtctccatcgcgcatttcgcgtcttttctctcctcttttccacatcccctcttcgtcctcgcttccgtccaaacacatagtgtatatatatatatatatttatttatttatgtatgtaaatgtatacacatatacatatatacatatgtataattatggataaatgtggaaaattatggataaatacatataaatatggataaatctggataaattgtgcataacgatgcaggcaacaaaagcatgtatggcgttatgtctgtctgtcgattcactacgtatctgttgacaccgtcttgtgtaggtcattttgtcgattgaccgatacacctccgcacaagtgcgcattttcacatagaaagtatccacaagtctccatagtgtgtatcctgttttgactgtatatgcatgtatgtctttctacgacccagaaagagcaggttgaggagagacaggagcttgtcgtgtgagaggtacggccatggcaagcaagcagaaggcagaaaagacggaggacagaacgtctcagaagaaagagagctgaatgcgcggtgaacggaagaacagaggaagactgtatctttctgaaacacaggactttttccacttttctcgcatctgcgcgagggcgcgcgaggccgcgcgagggcggcggacacaagcgcgcatgccttgtcgagaaaaaacgaacccgatacgaatgcagctctttttggagaaaagatttactttctctttctgctgctcttctagcgagaagcagcaatgcgatgagggggagacgagacatgtcggaggtcgacggaagaaaattggcgaaagcgatttcttcttcgacggtgtcggactgctttccctcctcatctctggaggaccacaaactgacgagtgggggatttagtaggaacttgtgaatttttctcccttttaaaacaaaactctctcctttttcttcataaggtttaaaacaaacctctcgcctttttcttcggaagaaaacaggcgagcgaggagaaacactgctgcggctttaacgtcgtggtcgtctcttcgttcttcttttcgtctgtgctcgccttcgttttccctcgttctttgcttctcgcttttcgtctccttgctccctcagttcctcttgtttcgctgcttcctcctttctgcttcgcattttatcctcgttgcaccccttcgcctctcctggagtgcagcggaaagctgtctctctctgtaaagccttcaatcctctttgacaaagtttcgttttctgcagtttcctcggctttgtactcgcagaagtctttctttcgtctcttttcttgcttggcctgcctcgcctgctgtcttgtggagaaaacgcagtcgtccttccacgaggtcttgctctcttctcccctctgtggtctccttcgttcttcttctctgctgcgtcttcttcttcttctccttttcctctcctcgtgtctgtctctgttctcggactgacggcagaagaacctcgaagaaaggcgcgagcgcttttcgcgcaagtcttctgcaacttgacgttgaacattcacagagatcccccgaaagcagga

SEQ ID NO: 3567 - DNA, 1965 bp, Toxoplasma gondii
ggccgcaagtgtaaaattctagtacattaggcatgtatcagcgatgcacgtctacacaatcgtatatatatatatatatatttgtgtgaatgtgtatatatatatgtgcgtatttatgtacaacaattatgcacgtttacgtttagacaaggtgtcgaaacgcagcagcttgacacgttggggttttcggcaaagcaagtagtttccattgtttactacatcgatcggaggcgatggaaggctctttttcagtagcttgacgaagtgtgctacagaaccaatgagagagaagttgctactttcgagcccccgcacacacgaagtgcacgaacgttcggaggctggcatcaacccaggaactgtttggattttttgaaatctgagttgaatttaactcgtctctttcgaacacatgccggactagcgagcaaaaggtactgctgtacgacctctaaaggttggaaggaagttcatctggtttcatcggataccttgaaaggatggaaacaaagcaaacgtggggaaagaacagaggaaaggaaaaaaggtaactggggcacaaatcctaacaacgctgacacagaacttctatagaatgatctacagttcggcaccagggtcgcggtccgtcacggcgattcagcagcccccgcaacaaaacactgataggaaattttttaagtcagaaaaagacaagaacgtggaacacagatctctaaagaggctacgaccacgaacagcttcattgaaactccgcgtacgagtgagaatgcaagtgcaccgaagcgggggttgtggcaagcaaagaaagacaagcgaatggtcaaagacgcagacgaaaacctaccattgtacgcgtgccaccttatgtgaggttgcacaaggtaagtctctaaaacgctgaacccatgaaccatgctcccctcgattacaatagagtcgggtgttcagaacggatctggcgcatgggcaaatcgggaagccggattgctttctgtgaatcacccttctgcgcagtctcgaaagaccaggcgtaacgctgcttctgttttccacagcaattcacgaaagaatgcgtccgctttgagaccagacacatcctccacaaaggaacacccggcatgtctcctccgtcccaaagcttttttatgctccccgctctctcttctcgacagaatcgacgtggtcaatggtggagacggagccaccggtcaaagtgtgagacgatccccgaatgttggtactgtgaagtgttgccacccattgtgtacaggaacagaagcgctacatccactagagaagctaccttcttcaaggtaacaccaaacttacgcatttgtgtggacagcttaacgctacaaggagcgccagtgcagacaaagtgaggagtctatgaacagtggcaggacgtgtggagcgtttcttccaggagaaatccggctctcctgaacagtgcacgaacaagatctgttttatctaagcttgttgtgtgtgggcacctaagcaactcttggtccacattaacactgactgcagtgacatgtgcaacctcaattgaagttcttgctgggccacgttccgcttctctctctggagagtcttgctttctgttaaccccggagggtcgaaagggtgcaccgctcttcccgggagtgcaagaggaaggcgacacttgaggaaggcctgagcaagctcagaaacctaacctccccaaacaaaaattgatgtgacataattgggtccagttggacccatatcagttgtcacactgataagaacagatactacacttgatcatagccaaaaggccgagaaggtatgaccaacccttgttggcggagtcacccaccccgagttcgaatggagcggcgcatgggtgtggcagagacaaaacggcgtccagcttttgtgtgctgccacgcgacaagatgcaccgctctcctccgttcgaaccccacctcaaga

SEQ ID NO: 3568 - DNA, 2092 bp, Toxoplasma gondii
atgaatgccggtacgatattggaatccggcacttttacctgtttttagcagtccagtggagaggtgatatacagcaatcataaataactcggttgcctgtaacttaaaactggagtcatattcagtatcctaagtactacagtgtctctgtttattcgatttgagttgtagcaatgtgaacacatgagattatcgaatgtaatggtatgctactaaatgtatggggtcaagctgtaaacaaaggcctctttaacttaaactgacatcccaagcaggtataaaccgtctaaagattgctatttcacaagcaggtgatatgcatctgtcatggtagattaacaactctcttacaccttactaccagactagttctgtggatatacaacaccaacaatgttaacgagtacagtttccgggcaaacatgaatacggataggacaccgaaatccaacagcacgtgcatgaggatactatcacagagaggcagccaacagcccactgaggagctgcaccggaaatttcgaaggtttcggccattagagtttttggcggtttctttccaccgaccatcctcgaccacgttccatgctcatggtcgatgttcatttgcagagtatacacctaatgctcatgagcgtctttccacatagatcttgtgattggatcagcggagaaaatagaaagacgcgcagccaccgctgaacagtagaggagctccgtggtgtcaagctaaagacgttcagtctgcgcagcgtgttgttagcctgacagtcgtggtcggtcacagcgtaaaaacgaagcactctacgaggagcactggtgacagcgcgtgtctatctctgttgaatcccttatgaatgtattatgaacattcgaggcatactacaacccaagagcatttgctcattgtcttgccaaagaataacttaacaagacagatgcgttcttcaattcactgaatcacttgcatgcacctgcgtaccctgtggcttcctgcggtgtgtccgcggctacatgccgtgcgcatactgaagcatcagattgagagttatgttaaaaaaacattctattctcagtcccatcaccttccgatggcacctgaatctctcaaccagccttgcgcagtgcagatgtgcatagcttttcgtcgtgtgtgaatgcccggcaccccgttgtaagtgaaggcccctgacgagcctttgaacttacgcgggagtgttctttccggactgccaacacccccaggtatcgctatacgagaatggaattcgcgcatctgaacgtcttcctgagatacagaactgcgctcctcaaattggatagacatagacatcatcatagcaccttcctgacaaggccagtctcggatgaaagaaccgaggcgaggcgacacaccgtttttcctgtgttcggcaacttcaagaggaaccgaggaacatgtcacagcgaacgctttgagcattccttctgtgacgatatcggctcacggtgtcagcagcacatgagcgccgcggcttgagaatcgcagcgttcacgcgtggctgctttctctcagctcccagcctagtaaacctgacaagtgccaggtggtatttcgttgcaattacagttgacttttccgcttttaccttaattgaagcaaagtgtgacatgagtcgtcctttatttaggggttgtgcggttctccagggagtcaaaaacattgcctgaggatgttcttggccgtcggcggtgtacttcgctctttttgagcgcattttcggagtctctcgtgcggacagccgcgacgctttccaagtgagaaactggcgatttcttgaatcacaataaaccaacttgccgaaagccttctatttctctctctttctgtttccgtaccacgttccattcgaccttcgtttgccgttttaggtcgcgaggtctttctgtcttgcacggtcgccgcccgcctagctcggcgtccgcgccgtctcctgccggttgtccgagcggcggtctgcacacctttgttcctgggatttctgtgcagccgtttccgccgatgactttcctacgttcccagcgaactttcttccgccgtttatcatttcaa

SEQ ID NO: 3569 - DNA, 1820 bp, Toxoplasma gondii
gaccttttgaacgccagctgtcgaaacgcgaccttcactttccctgtctcctctccgacgtttttcttttttccccgcgaacaaggaggggaagttgcttttcgacacaaagatatcctctatcctcgaatgagaagcggccttcgacaaagagacgacgtcggagatttcgcgtgagatctgatcgcgaagacctgcacacgcagtggcccgttgcgccgcttcaccgaaaaaacttcgcaggcgaatctcctgagagttccgcgacgcaaattccagatttgctccggtgcagcttcgaaaacttgtccgcttctttagttcccaaacactaagtgaaaagaaacgaaaatttgcgaaaatatcaaaggcgcgtcagctgcgtctgttcattcggacccgtcctctgattttcttacaccggcctcagtccaccgcgagacttgtcgattttgaggtgaacaaccacaaaaagacattccttgagatcactcatatatatatttatatttatatatttatttatataattatacatttatgtatatggacttctgcatgtggcttctacatacatatacttgttgtttacacgtgtgtataggatatacattagagaaaagtatagcatatacatgagaaattgaagtcaataatttatttgtatctttttatggagatgtaggattctgtcttcttggagtggtcggctcacacctaactaccattacctctttctctctctctacatgtttatatatatatatatatatatatatgtctatctatgtcgactcgtttagatgccttcacaaatgttgcatattgaacatcaccggaaatgtttacatcttcagaaacgagtaagtataggcacatgcggtgcacagccaatatggagggcaatgtctgtaccttttacactcttgtggcgaggccatgatgcgagaggaagaacggctttctctgcttctcttttgtgcagttttctcaggacttctttgcctccttcgcacacccgtctgctggggaaaatcggaatttcaccgttgaagtgctttcagagactaaggtggttgtttttcagaatctgcatccctttttcgcacggaagttttctcgccagcgctgcatgcatgcgaaaagggaactcgctggatgagcaaggtaggggcgcccgtttgtagccagaagaagaccgatttgcctctgatctttccaacttttacgccgagtcctcgacttgtcttgtttgatttccctcgctcctgtctctctgccgcagagccttttcggtgggggaacggcgtttctcttccttttgcggacgcgcgtcatccggcagttcggagaacagaggatttctcgcgtttttcctgcctttgcttcgtctccccctccactgttctcttctccccagcgcggcacttgttctccagacgtctgtctctgtcgtttgccggattgtttctctgttgttttacctcggcgttcccgcccggccctctccgcgcgctgccttttcgtcgtctcgaaaactgtaaacttccgcgcggcgggggtcggcacagattcgccatccctttttgccgtcccctctctggccgtcgtcttcctcttgcgttcttccctcttctcgcctcttcttcactctccgctctacgtcgcaggactcctctttccttcctcgttcctctcccccgtctcccgctggccgcgccgccttctccctgcctctccctgttcttctccgtccgtttccggtctccgattcgttgtttcttcgcgttcgtccttgcttgccgcccgtctctccgaga

SEQ ID NO: 3570 - DNA, 2077 bp, Toxoplasma gondii
cggtgtttttcttctacagaaagttccagaaacgtacaagagaaccgaaggagatacgtcgcttggacacacgaggtaaacggcagatttacccaccacgggatctttctctcgagcggctgcgctttctggcgaggagacaaacatgcgtgctgttcgccactgcttcacacgcaaaactgacgttgacctgccgcagcgctggaaataaaccaagttagctgcaccaccccttccacaaaaatgtgtccacagtaatacatcgtgacattcataagcgtacatacacatatacatatatatatatatacatacatacatatcatggcgaatgaggatgtgcacatgcgacccttgatgtaagttgagagacttttatctgaggtggaacgattcgtctcgtgcaacttaagacattttgtgttccagaacttacgcacgcattgcttccctttcccatcttcttgggcgcgttgcaggagaatcgaaaaagttaccgccctgacgtattcctgtcgtgtagcgcacagcatgcacgcattaacaacgcttgcagtagatgctgaaaagccgagagaaaaggcttggtgtcgaaatttggaacagccgcgttcgacaagcgtaaccaaggagttcacacacaagaaacaggctgtaataagtgtggctgaatctctgaccgggtcagagaaacagggcggaggccgacgaaagtcgcgcttctcgcgggctggggcaaggcagaaatggagagaaacagcattcacgctagactagatggagttccacgcaaaatgaggagaggaggaaggacgaaaaaaacaaaagatgccgctgtgaatgggaagatgaaatcgagttgcagcacaacgcgagggcgatgccaaggggatcctggggcacccgctcctgtcaagttgcctctcccgcttaacctgaactccaccaagtgtggagacgacaaacggatctcggctcggttgcaagcggtgtgtgtctgcgaatcttgttgcaaaaagatccgagagaaaacagaaaacgtcttttccggccgcggcttttattcggagaggctgccgacgctgcatgcacagtggggtcgcccacttttctccgtgctctggttcgcagagaggctggtgagcgaaagaagagaggcgcggaaaaaggcggaggaaaagtggaattgagagccgaacaggccagcgattgtgtgcttggaggagaggttgatgatggctagcaaatggttcgtctttctggttggagagcgaaggaccgagagaaacggagatcgatcttgcatgaagacctgcatgcgttacacaggggaggcgtttgcgccacgctgaagaaaatcctacgccgtttctgtgggtgggagaagcggcgacgcttttgcgagaaagtgaaagacagaggagcagagagatccgacagaaaggaaaaaggcagcctggaaaaacacggttttctgccctgtcttgtttctctttttcttctctcacttgagaaagtggaacgaagcttcctgttttcttaaaagccttggccacccggtctcgccacgcacttcgccgtttgaaacagtctaaggaacttggttctgaagtcggttcctcttctcctttcccagcctttttcagactgagattgcactccatcgtcgcctctttcttcgacactctgcgtagaaacatttcctctctttccgcctcctgctgtctgcatgttctcttccgttttctatgctgcaaagaggcgcggagagcgaaggccccagtagcttgcctgcggtttcttgtccaccccccattcccttttcttattagaaaactgcgtggtttttcagggcgcctgacgctcttctcggcgccaggcccggttcccctcacagtgtctccatccaacgagtgcaacgaagagaacccccattcgctttctctctgttctctctctctgtcgcactggccttcactttccttccccgttatctccgcgagctcgacgcatcgccaagcggctctcctctccctctcctctgtcttcaattcactcttcatcttccctgccacta

SEQ ID NO: 3571 - DNA, 4705 bp, Toxoplasma gondii
cacgatacaccgaagagaacacatcacaaatcgcttgaagtcagtcttgttctgagatctactctactgcgatgtggaacactgcaaatacccatgctcttatgagcaagcctcagcgggacaccgagaattttgtgctctcctaaaatcgggacttttttcgtcgtttacataaatctagtcgcacttttcgagtgcccagagaggttctgaagtcagtgtccctggagacaccataccgctacagattccaaattccacagaagcccctaaatcgtcaatttcgcagtccacttacagccttgttttggaagttctgcatcagcaaattgttctgttgagcaagagcggtgacgcccaaaccggcaagacctgcaaaagagttcacacggaacagcaccggcactgtgagaaaccttctgttgtgtccacaacggacgcttggtatctacgcacggcgcgaacaagcatcggacacttagcgtgctcgtacgaacgaacgacggagacagtcgttgaacaacgacactcaagacctcagtcagtgacgcacgaacagtcggcctgatggcttacctgtcccagccaagccaggtattgttggcgtcgctccttcctccgcgccaacatcccatcctgtccgcttcttccgctttctctgaacacgcaagacacacaacagtcacgctggtcgtgactttagggttcagtcgcgcctcgcctgaaggtatgtttacgcatttacgccagtacataagctggttgtgttgccttttggaagaaagcttaagtgctccggatgtccttcaggcgtgacagactcccgcacgacgaccgaacagcgccagtccatcgcacccgccgtcgccctgaagcccgcagtccccgcttcgaaatctggatttctgcacaaaatccatcttggcatcgttgacgagatgactgtcaaactcgcgctgatgtggcaggagagaaatactctcgaattccccgccaatgcaccacgggcagcggccgatggggactgacgggcaacggaagccggtactcccgtggagctgatcggaggtaaaactgacctcttcgcgggtgtcatcccgtcgagggcttctactcctgctacgagacctgcgatctggcattttgaaaaatctccaatgaagatcgggggaactgatgtgaaccgaccgctggaagttcgcgatactgacgtgatcgggtgggttgtccggaaagggtaccgcgagtcacagcgtttcgggtgtacagacactggattcagtggctgccgtcacgcgtcggaatacccaaacaacagtgtttctcaatggtgcgccagacgtgctgtgaatccaatttctgcggttcctgtcgcgaaaccaccgcagacactgttgaagcaagtgcaagcagagatgagaaagagacgccgacttcgaggatgtcgacgggaaacaaattcgacaaaaaccggacttgacagacgaggctgcagagaatcgaagaagactgcaacaacagtcgcaggcgagacgcggtaaatggctgaacaatccagtatgaatgttttgcccggagaaaagcaatcgcactatgtggtgggtgacacccgcagggaaaagtaccacgaccgagcggcgcgacgcccatgcgcacacaatctgtaaaaatgcgagtagatgacataaagtgggcaaagtaaccagcttctgtggagttggtacgcaagtcttccacagttcgtgccgttccagttcctgaaattccaacaggctaccaaactcgtgggcgagcacctttaggcggatcttcccgtggggcgccggagggttgcgcagtgggggaagcctgctcttcgtttcgagagagggaaacatctgggtgaagctgtggaatcaaccgtgcacagtcttggtaaatttacggcttggagtagaatatgcgtcgcagtgtggcggccctcaagatgaggagaggaaaagcacggattctacttatctcaccgccgtagcttcattcggactgttaaaaacggtggttgcaccccaggaacccttgttgttttggacgggttttagccatgatatacactcgaaggtcgcgaaagccgacagtgcgaatctttgttacaacctcgcggatgtccatgtgccagtccgagcagcgaggtctggaccacgttccattaggatgggggtcgtttgtgagacacgttagatcaagggcgttaacttgagctcagctgccgcgtttgaggacagaccatggcttcctgtttgctcatcacagtcgtgtatgaagagcgttaggaactccggcctgaaggtatttccacgaagaagttgttccagtccagttctagcgactcactcctacaggaaagcggctcggaacacgcagtaagcagggtggagcagacagcgagattttcgggcttcctattccactttccgctaattcgttgcaacggaagggctctagggaaaacggactgtacttggatatgaaagactctctcgatatagatcgcggggcagagctgcttgtaacggaaacacccggtgcaggcactcagattaaaacgctcgactagcgcccgtgaatggcttacgtccaacgttttgccgaggaacgagcccacgtgagcaaggggcgacgacgaaagatgcacaaatgcaatcttttttgttttgccccggtgggagagggctctcgatataaaggccggtggcgaatgatgcagtggcaccgttccgtcggcacaagcactgagaaccagatgattttgttgggttgtgttcaaggaatcgctgacaccagtgatctgttccgcctcgatgcgtatcaaaacggaaagttaacagtcacagcgtttcattaaaatgcttcgaaggaacgccgatacgttagtggaaacgatctttacaaagctgcaccccaccgaaatcgtcccgtcatagaatatgcacatggtccagtacagactagactacggcatctgctgggtagttaaagttattatttttgccaggaagaccacaaagctgggaatccatcaagtgagaaagcaggcagcacggacaatggagcccgttaggtgagttcatacgaatgaggctgcacctgttcgaaagctgtgtacggtgtgttgtatgcgacgctttttgttcaccgctgtgtggcagatgcctgagggcgaatgcaggaagattccgcacgctgataaggcgtctatttagggttcttgagattcccttttgcgtggcaagcttaactgctagacggttttcccctccgcgtaggtaagatcaaacgttaggttcccgatcttcagaaggttaaaagggttggatgtcaatgtcctaccgccgtacgcagacggcattaagaacatgaagatcttcgctagaccaagctaggctcactgtctccgttaactgtgagaacgaaacgcagtggggcagccaataaacaaagtcatacattgtatgagacttcgtgcgttacccctgcggatcgctggatcaaccccgcgtatcgggcgtcggacaaccgaaggagctcacactctgtatgtcgagattccatctttttctgtctcttccactaattcgcggaggtgtcgcaaatgcagaggttacgttgtgtccagacaaaccctctggaggtgccgggctgctccattcccaagagcgactgttctgttcgcgcgacgagtttgctggacctcttgtgtggccttcgagctggatccgcatgttatcagtgactgcctaacctccaaagaaccctctcaccgtacatttctcactctagacgcccgtctgttggcagctcggcattcgcggtaaccgtcgcagttctgtgaacggaccagaaaagaacatcgcaagaactcgagaaggcactcgcgcccccgagacgaactggtcgcgcaggtagggatgtgcggcaccgttttggcccgtcagtcccgcagcgggagtttttcaagttcaatgcggaatagaggaaaccctgtatttcatgaacgacaagtgcttctgtgaaacacatgcgggaccgttattttcactaaaaaagtgtgaatgcgcgcagaagcgaactgttggcattcctgccagctgctgaagggcccgcggcacacagtccgagttttgaccggagagtctggttcagggggctgcgcgtgcgcatcttcacttgcgtgtaagtctttttcgtttccgatcttttcggtctacaatttctctgttcttccgtttgtccagcgcgatttcccggtgtatctccaagcggctttcacgttataggcgcagtgtcgcgctgggacgccgcaaatcactggggcgtcgtatcgctgtcccggcacatcgcgaaaacgctctgaacttgtttgcgaactttcccttttccagtacccctgccctcttcttcgtttctgcgccactcatgtggctcgggcatacgtctgttctctggcgtctgggtcgccgtcgcgcccatcccgaagtccagcgtcgtttcctcgctctgtaggaacttgctccggaaattcgatgctgggcagagccgtctagtgagttctctgccttttagagtgtctctgctgcgcgtgatcttgcgtcttttcttgcccgccactattttttcttccccggattcgtggagggcggggggggggacagggaagagcgttccgcga

SEQ ID NO: 3572 - DNA, 1105 bp, Toxoplasma gondii
ctgccggcggatggattgctttgatatcttagaggaaccatctgaggtttgtttggttcattagaatcttttgacctgccggatattctgtcattccgttggcagtgaactgtggaaatatctttgacgaagtcgcgagaatgctgattctactgcgatcggcgtagggatccctaaggatgtgtaatgctgtcagtgtgttaactgttactagtgtgactcacgtcccaggtgcacgggccgctgatcctcgcaagcgagactgttgtggttgagcgtcttctggagtcactggagacgggttggtcagtcccatgcctgaaaggagtcaggttgtaaagtgatgactcgcaacattctggaactcctagaggcgggtgcttctcttcttgcagtggttggtcagtaccgctagaagagaaatctctcacagtctgtagctgaactgccgattgttaggttgttcttcacagggcacgtaacgtgcgttcaacaaagaggcgttgcccgtacagagcgcatcagcgataattcgagcgttaccgtgatgcagagagtggcttttacttgtgtgtagaagacaagcacgatgcggacgaagctgctgaattcggcgggaggcttgcctctctaatgcgagaattacacatctcctgtgcttttcggaaaagacaacacaaatctgaagtctagcagcgagcggatcgggtaaatggctcacttcacagaattgtgcattcagatggtctcatcccttttccacaagagttcgctatacgcattcgggcgaagcctcaaagtgtttctcgtaggacgccgtcgtagagagaccgtcttctccaagaagaaccctgtgtcctttcgatgtggatttacccaatgccggaggaaatgcggctctggaagagctgcacgagttccaaatcacaaatggcggtcctgcacacgtcgcttctggaaatcagtttcctcgtattctcgcaccttccgggggtgatgggtccaagcactgacactcagtcgaccgaggccatcgatccctgttagagatgacgggcatctgtgctgcaaaggaaatccgtttctccaggaaaaacaccattaa

SEQ ID NO: 3573 - DNA, 2206 bp, Toxoplasma gondii
caaagcttacctctttggtgaggagcgcgagaagcgcaagactctcgaaggagatccaacgcctctttccagcaggcgcacccgccccagtcgacgcggacagcgcaggcagcgagaaggagaatccgaatgtatgtcctcctgcgacgactgcggtcgacgaggcggcggctaggcgcagaagatcctgttgccgcttcaagtgcagcatcttgaggtagcgaagcaggacagacgcgacaaagaagacgaagaaggtgaggagcaggagaaagaagaaagatggaggacagacgaaggggacgagaaagacgagaagcgaagacgaagacgaccccgtcgtcaacgcagcgcccgccgcctctgccgcctgggcagctgccgagacagcagccgccggcaagctctccatccccgcctgcggaaaaacagagggggagacccagaagaggggaaggaaagagacagatcccccgcagaagacaggggaagagaacacggaaggggcacacactgaagaaagccgagacagccaggatggaagcctgaatcatgggcacaagctaaagccccgaaccatccagttgtctcttcagaaaaaggggaaagagaaaagcgctacctctctgaaaagaagaaggagatgcactatctcagcgcgaaaaagagaagagagagcctctccgaaaaaaagagaaaagaaagatgcaccaccaactcccccgaggaaaaatcaccgtccctctaagaggcagaagagcgtcctcggcgtctgccaggctggcacacatgagaccgggcgacgcaaacctggcagcgaggtgtatgtacacccgaaggggacggaaccattgtcgacgcgggggcgagagaggagaccgcagacgagagcccagggcgccgggaagaaacgaggaacagagacgcagagcagaagtgtgaaaagggagttggagaagaaagaggaacggggagacagagaaccacctggaggcaaaaggagacgtgacgaggaaagaggaacggagaagccgcagagaaggaaagaaacaccgcaaaagaggaaagaaccgccgcagagaaggaaagaaccgccgcagagaaggaaagaaaagccgcagagaaggaaagaaacgccgcagagggactgctctccgttgacgtccgcaaaaagaagagcctggcgatgggagcagcttgcagttccgctcggcaagacagcgtttagcaggtggaaaaagaaaaatccacgaggaaacagagacgcgagaaaagccggcggtgttcgggcacgctgaaggaattctgtcagagaaaggcgatttacgagacaaggacgagtccaaaaagcagacgcagttcgttcatgttctcctcgcgagtgacaccgaaaacagggaaaagggcatttgcgttttctacgaatgggtgactccaggctgtttctcttcctctcacacctgcatgtcgaaaagaaaaccttgcatgtattgttccgtgcactctgtgacggagtcggtagaaactcgactggcgaaaataacaacggaaagggagtctcttttctcgcttcccgtttctcttccttcgtttcgcctgttcagcgccctttttctctcgcagagacgcacgctctgaggtgtacagacaccgagcgcatctcgccacgcgccgaaaaagcagtcgtcttttttgtcgcgcttcgggaggaaagacgctgggggagaaggcggatttcgctccgacgcatgactgtctttgtctcggtggtgcggttccttctccgtgaaacttctcttcttctgtctggcggcgagagagaggcgttgtttctcttcagggccgcagaggcggctcgccttcgcagcggatggtcctctcgcagttttcccccttcgtccgtcacacttgcatgcacgaacttccatttgaaagaaaacgccgcgaaggcgagctccacgcagaaaaaaccatcaagagcagtggcgaccgcctttcgcgagacgaacgcggcgtcctggacttccgtcctctctctctgcgaaagcggaagcaggaagaaagacactcgaagaagttgtctcccctgccgaggcgacctcgctctcgcccacacgcgcgcaggggtgtacagacgcctgctgggagggcctcccactggaacctgaagaagaaggcctcgaacctcctcgcctgcacaccacca

SEQ ID NO: 3574 - DNA, 426 bp, Toxoplasma gondii
agaaggcacagaagacaagaaagacagagatggtaaagagcagaaggaggcgagaaggacaaacgcgcgagaaggcaatgacaagagggaggagacaaatccaataggatcgaaagaacagagggacgagggggagaggacgaaccagcagaggcaagggaacagaatgagaagggagagaggaaggaagcctcgagagagaaagaaggaagacagagagaagtgacccgacaacagaagtcggcgaggtcgatcctgccaaggcggcgcggaggcgaccttgaagaccttcatcttgctgcgaactctagagaagaaacagaaacaacgctccgcgacgcgagagaaacagagaggggagagaacagagaagaaggaaggaaaaaggtggagggtgacgtcagagggaaaatgaatgtagacaca

SEQ ID NO: 3575 - DNA, 1762 bp, Toxoplasma gondii
ctacactcttttgtccggcacttctcatctcgaatatcctggtagaagtcgaaagaaagaatgattttgtcgaatggctcgacactcggagtgcggcctgctccttcgacaacacggaggcgctgcaagtaatttgcattatgcagcaccttccccgatttgctgtgggcataccgcgtttggcgatcaaaaggttgtggcctgtggtgaaaagtcttttttaaagatctttcagagcccggtgccggacacccaagttcgccgtctgtcgcagcagccgttgtgttgccgtcgacactgcttacagccgaaattgtttcgatacccatctttgacaaaatcaggtgtacgtacagctgagacgagactctcgaactaggcaagtaggcggctgaaaagtctcggcgctacatgatatgagacacctccgctacaaggcgccctttcatgcacgtaagatagtatctgactagtctccacatactaaagctgccagaataagcgggtgactggcgacatctttcttgacagttcagccaaggtgtcacgtcaattaatttcgcgtcacaggccttgtaacggacaggggagagtagacgaccaaagaagcaaacgaacaaggtaagtacgacggcagaaataaaggcagtcactgcggggttgttatgtcttttggcggaagacccctaactggaggagcacagttgacagagggtatctggaacggcgactagagacgcaaagtcgattgacaagcaaagcaagtggggtctacgatagactccctccaggaaacgccgctcgagagtatgctaagcactgttgcgtttctttctattcaaaccaatatctcagtcgaagtcgagttgcagaacatgtgacgaagcagcgccagatgaggaaaccggggtcacggtctgctgcgtcgtttctctcacgaaatggcgcaaaggaagaggagcgtagtgtaagaaaacggcattattagacgcgaacaaaagtgatgactcaaatgtgctacagactgactcaaacgaaggcgagaccagatgagctgatctggaaaaattcacaccctaacatcattgaatatattggatctcgagttgaagcgagcctgcatgcgctcctccgtagtgccgtttatgcagaaccgaggacccacaggtatttatgcaagtcatattgtctctttaggaatgatatacggagttcttctctgtcacagcacgtaaaaaatgaggcagaatatctcaaccagtggcctgtttgcaatttctgctgcgacgactggcacatgcgtttgcatgcacccacagagaatcgacgtacagaggacccggccgaacccgtccttgcgtttggcgctgaaaatccccgtgctgctcctttcctcaaaaggacacgaaagaactttttttcacaggccagtcagttgcacttgcgctttcctgtgtcttctgtccacgatggcgggtttttttgacgtgtgagtttccgcggtgcagaccgatgtcggccggtagctgctgcatgtgcagaagtttctaggtttccttctggaagttgagggcactttcaacctctatacctcgctttgtcgtggagcacactacgcattggttcttgaatgccttggaagatgtgtgctgcatttctgtggggtcataccaagaccgaatatccaagtcgtatatcaacgctttcgttgaaaggcgggaataagcagacacccgaatgaatcacgtataatgagaagaaa

SEQ ID NO: 3576 - DNA, 1880 bp, Toxoplasma gondii
gtcttcaatgagaagggtggtacgaaggaggctgatgagatgatcgacttcccagccttgtcttccttccggcttaaatacggctgtgagtctgtccggcatctcgtctgcttcgttgccctgtcctccacttcgaggcagtcctcgttcctcgcttcttttttccttatcacccttttcatctggtttctctccctccttttcgtccctacgagcagtatcttcctcttcctccgcgcctccgccgccttctctcccatctgtgtcaaccactattcgttctccccccgagtgcgctctttctggggaacggagcgtccttctgcaagagaggcagtcgtattttctggtggacgtctgctggtgtgtaggcgcggggaagtattcagatgatgccttcgatgcggcgaccagagagacctctcccccgctgaattctttctcattctccccattttgcacaaacgttttcccctccacgtatctaccgagtcgcttctcgcgctcagacttttctggatcagcgaggaaaggcgcgcgccggtacaaggcggggctcttgggctctctgtggctgccgagcggaagactgccaggcagcggtgtcgcgacctcagggaaataaaacagttctgggagattccatcggtacgcaaagcgcagacagtacaaacccagcgtacatacagggactcctagagcatcttggagctgctcttggacgcggcgggtcctcgcagtcgggcgtaggagtttttcttggtcttgccagcaggatttgaccctgtccagtctggatgtttcatttctgttttccgcatcttggccttccacaccatgctcctgttcagcgtgttccctttcaacttgagagttgagtcttgcctctccgggacccgcttcactccctccgtttccgctgcctgctgttttttctcctgcctcgcggtcctggacaggtggtttctggcctgcatgcatagggctgtctgtttttggcgagcgggttgcaagctaaaggtggaagccgccgaagaaacgaccaaccagcagacagtgaggaagtcgcctttctcgcgcgcttcacggggcttctggccagacacttcatagctccggaggacagggcgttgagtggcagtgcgggtaaaacgcatgaaggacaaagaatttgcgaggcgcccacttgtctcatattcttcgtgaatttccctggtcgaactgtcgcattttgactcgagggatgggccggagtacagagctcggacaactcgagcatgcgcgctctgattcgaatcgcggagaaatcgcagaaaacgcaaactcaaattcccctgaggcgcttcgcttgttcgctgcttcttcaaaatgtggagaaaaaccgcggtgggcggcaacacactcgcacgtcgctggcgaaaaatctgctggcgtcgtccgttgccctggagctcagacgagcgctcttggcaccggtgaaaacgcagtgtccgtttgaagcgggaaccggagagaagaaacgaggaaaaatccagaaaacgaccgatggcaaatggaaaaaagagtccggtgaaacggacaggaaggaacggcggcctgttctggagggtgtgtcttgcggtaaccccattcatggcattacgcagctgccggagcgcgcggcccccccatctcatattctgcttcccgttggtaacctcgctctcctacggacgggtccacatctgaaagcttgccgtcgtgtgctcaatgtgttgcttcgacaagtgtgaagacagccgaagatgacggtaaaagaattcagtcctctcgcgagcttgaccgagaatggtccctctcgcgcccaccatgcccggaagtcgccgggcagccaggccaga

SEQ ID NO: 3577 - DNA, 2900 bp, Toxoplasma gondii
acagttgactgaaggagtgacttcacctcgcagtttttcactgaacctcgaattcgaagcctacagaacgccatgcagggactggggcggtcctctttgggtcggcagtgctgtctctcgagacgggcaggccgcgccactcgcaagggcggcttcgatccacactgaagacgcgcttcgatccacactgaagacgcgcttcgatccacactgaagacgcgcttcgatccacactgaagacgggctcgcgacgcagacggcaaacgagaagcagttacctcgaagagagcctggcctctgaactgcggggtcgcaggaaccagacgagcagccgagaggaacggcgacacttacagaatggaggtttgcttctttgcggggacggccgcagccttcttcatggtgatggcggggcggagaggagacaagcgacgcgaagaagaagaggaagaagaagaaggggattcgcagagccgcacagcgggtgcagattgggaggaggtgtggaggggagcggggaagggcgagaggaggaaggacggacgtcgaggagccagaagagcgctggacggcaaggaggcaggcgtcgacgcgaagggaacagcgcgagaagaaacgcggccgacgagaggattcgctgggacttcgaaagcaggaacggggagtgcagcagccgggagagggggagaagtcaacaggacaacgacggacgagaagaggaagaaatagagccggcggcggattgacgccgtcgttcttcttcggcgacgcagttgtttctcggaaggctgcaagaaagtccgaaagaggccgggcaagccgtaggcgacccggagactgtcgtggagactggagagacgagagggaggaagtgaggcagctcgaagaaagggagctgtcgaggttaagacgacgccaatccaagcagcaaggaagaacgcgagcagagagggcaccaaagacagtggacaggcgagaaaaagaaagaagagaaggcagagaccgtcagggagaagaagagaggaagaagagctgtttccggtcatcagctctcgcgatggcttgcgtcgaagatgctctgcaagacatgcacgccgtttgacgagcagcgacaccggcgaccttcgctctttgattgtgtgtagaggatttccctcgactcgcgtttcttctctttcctctactgggtcgcttgctttgcttctctctccccccccgctgagagaacatgctggacacagtgtgtggtgtgtgcggtcgcagagctgcccgcgaggaggtcagcctctccgttttcctcttgatcgcctgcagctctcgcttcggagttgtctcgctttcgcgcgaacctgcaggaacttcagccgacaaagtacgcaagagagaaggcgcagcggctgctgttgtttcctcctcagagcgagcagcgcttgtcttcatcagcgcccccctgtgttcgcggcgttcctctgcaaaactccacacacaccacccgccgaaggagagtgctagcgcgcgcaggcgcggatgctagaaggcgaagcgagagggagatgaaaaaaagcctcacaagcaagccggcacacagcggcagtgccggaagaagacgagaggaagaaacgaagagaaacttggagaaaaaggaggcagaagacagtgaaaacgcgagacgcgacggctgtcgcggccaaaagtttttccaccctccctcctgttcttgtatatatgccgacagagcgctggcagcgctgcagacctgctgccttctcttctttctcaggtaaattcgccgtcgtcgtctttgcatctgagaggcatgtgcctgttttttgttcagagcgtcaatctgctgctcccgagtgccgcgaaagctgagaacaggacaaagcgaagcggagtgaggtcgcttctctctgcggcagattctttcaacggagaggcaagctttttccgcggcggttgcggctcggccgctctcgacatcgcgaggaggcagcgacgccagcatcacgtttcagctcttttcagaagatagttctgccttccctttcccttgttcgtcggagaaggaggacgcagagagagaggcgagatggagaacgggcgtctggcgaacctatttctgagttgtgtggctgcggtcaatagaagaatttgtgacggcgaagacgcgagcgttgtgcctctcgtcaactgaaaactcgaaacgggggaaaaggctctccggaaactcgggtcgtcttcggttctcttgacgtcttcttttcatcttgcggggacgacggggattttctccgtctctcttttcgtttgtttcacctgtctctctcgctctcgtacgagcctctcgccctctcgcaacagcgtgcagccttttcaagcgttttccttcttttcttccccccatcgatgctaaatgaccttcccccatctgaaaatacatatatatattatatgtaggtttaggtgaatatctttttgtgtacgtcgcctggtcagggagaggagtgaagagaggtttctgcctctgtctctctgttctgtgaggctgcgtccctctttcctctttgcttctctaaaggtgtgtctgagctctctcctctcgctgccccagagggtgtatcccttctgcgcctttctccctgaacctacagtctgtttgtcgcgctccttccttcgtcgcaagtgggcggtccgcgcgctttgctcgccggtgcgacttcatcgttttcagacggaaggacgccagtgtcgatcgacgaaggaaagcgggagctccagcttctctgtgccgcttcacttcgccgttccctccggtgccctttcttcttctgcgcttttctttcgcgcgcgtccgccacccgcggctcctcccgcctgccttcttcgcgcagtgagga

SEQ ID NO: 3578 - DNA, 2003 bp, Toxoplasma gondii
gtgaacggaggcagtgtgtttagctgggaagctagcgttcaacaactctgccggtgtacgaagtcagacgcacagatagaaataagttcctttccgatgtagggagcccagagaacggaataccgttgaggaacgcttccaaggaaagccggagagatttgtgacgcagagtctgttcaaccaaaagagggagtgcggtgtgcgaatgagaagaaatctgttttcgctaggtcgtgcagaccagagacaggacatgcgtccgcggcgtcgaacactctgcgggcattgctgcgcgcattgcgtccaagcccctgaagctacgttctagtgattactctaaaactgttttcgctgatccataagaagagcgttatacatttgctgagacttgccggaggttgatcgaagcacaagcgaaattccgacgaagcgacagagctcaaggtcgtttctgtcttcccgcttgaccacacgagacacgccggtctgcgccgggtgtacatacactcggatgtgctgcgtgcgccccagatggctcagaagcgcttcctcacgcgttcgctgctgcctgggttcgcaatgcttctttttcactttataaagggtgaaaagaaatatatctctagtagtccaactgagatgccattcgctgtgaaagtcgcgaaaagagaggtcacgcgctatctatcggagtcgtacatgtgataagaaagacagatcagatggaaacaaggtagacggtgaagtggacgtggaaaatccgctgacttctgctggtgttagtcccgagaaacagatgttgtgcttgaaatgaacagtcaagcacccactacttgtgctgcgagggtgcgtcatgaccgtgtgtcctcggatattcgatacataccacggctctttcacgtcattcattgattgctgctgcacagttgtcagagatctgcatgtaaactgcatcacaggaccttgcggaagtccttgtcagcgtcgagacgcacgagcgaaaggcggttgttatgtatgtggggaatcactcttcggtgtgtcgtgagttgtcctcccagcgtttctctgtacggagcacctaggatgtcgagtactttttcagtcatgagatacaatccggttctgggtgattggagacgctttacatcctaggatactgaattgatgttgagttagagagatgcaacgactcaggatgttcgtgtctgcagtctatcaccacccccatcgccgcttaaaacagcagacagctttggagttagctttccgccgacgtgaagcttgcaccacatcggcagaggatttcagtggtagacagtcaggacacgcgtcaagagcgtttctctgtatctcgtaacagaatatatatcgggttgcatgcagagtcgagcgtcagaggcactccagcatcgcttgtttcttcgaacttccgcttttctgcctcctccgttctctgtcgagtgtcgaaacgaaagggagaagtcgaatcccctttgaaaacccattaacagaattacgctgttatcgccggcctcgccaggtccccatgtcgcatgcagttggcgtttccggggctggtgtgcgtgtgcttccgaacggcagagtcgagagaagaggtggacctcggaatttgattttttcagacggaatcctggaacggaagaactgtttttcttgacgctggatgtttcagggctcagggaggaagtcgacgaggcagaaatcgtgctttcatcatgaactgtgagttaccgcggaagcgtgacccgggaacgagcgacgaaccagcgtcgccgctttgacgctgcgaatcctgagaagctcgagagaagcaagctgctcaggcagaggcaagaagacgcaaagaaaaaggagctcatctgagaggtgtcttccggggcctttctttcgtcagcttctttttctcgacccccgcccacctgcacagacgcgttcttccgtgaataaggtcaactctgcgcgttctcgcctcctcagca

SEQ ID NO: 3579 - DNA, 1936 bp, Toxoplasma gondii
tttttctttggatgtacagtggctaccattgtgacaaagacggtatctccgcgacggcgcctcccgttgttgcctactcgctattgtgatgtaaaactggcttgtgtatccacacactttaagggatctgctttctttaacgaaatgtaacagcactgccgaagtagcggattcctcagccaatccagaacagtaggacgttgtatgttttcaaatgcagatatatatatgtatatgattaaaaatgagtgtcaacagaaagtagacacatttatacttgggagatatgttttcgtactgttttctgcatccaagtagcgcgtatgacaaagaaaacgcctatacactattgttggatttctcacgttttccctgcgaagctgtaaagtctggatctgattgattacggaaccgccggcaggaagatgtaacgttcttgaggattaaagaaattcgagccgaatttttctgacggagaacgcggatgagacgagcgatgtagaatgacaccatgtagaggcgcggtcgtgcggatcctcaacaatcaaccaactgaagagaaggacctgtcgcacagcgcgaaaagacagcgtccgactcaatgcaaaccgcagtgggagagaagcacttgaggccaacaccatatgcgttgactgaggaagactggttagagtgagcattgcaataatgtagtgggagataggaaagaagctgactccgaatgcttgctcacctggtacacagacaggcgagcaaatagtcgtgtgccatatggcacagacgacaactagtcaatcgctttcttttagcaggtgaaacaggcgagagtttattgtgtacccaacatttaacgggtaagaggtcatgacggcgactttgcgatctgagatgactgaattggtcgtcaggagagtctagagggaagctcggcggttaatctggcaagtatttgctgcacgccttgatctcagaattcccgttctacagagacagtcgaagggtctccatcttttctctccagatgccgttgaatccgaggtgtgtaacgcatgtagttctagcaacatccaaagcgggcggaagacatctccggaaaaggcacggccgagttgcaagaaagttatccttttcacagctaaaattgagactgaaggcgtctggcctatcatctgaataaaaaactgctgtgtttgaccctttgtacagtggaagaattctctgacaaaactcaacacgcggccgtccaggtttccgttgcatgcgcgcgtgaacactattactgattgtgtttgtcttcagtttctgtttctcgtctttcctttctcgccgtttgcgtcttctgtgcattccgggcttgactcccgctgcgctccaagctttttcgcgttgtctttttcctcaagctgtcctacggttgctcgggtgaccctccaaaatcgacgtggccgccggcgacggcacgaccccactgcatcttttcatccactcgaacttaggaatgatcaaccgtcgcgcagaaactgttttcttgtcctgttttcgacactgacgcaggagctgtcgactcacttcagaccacctgcgccagtgttatgccgagagtgtttgtcgcgcagtttccaggaataccgctggaagagatctcgctgtcttgaccgacacgaaacactcgcctggtgcctcatcttttccaagtcctgaggaccctcaaaaaacgtttcattctctggtttttcgctcctgtcaagcctttaatctcgtccctgtcgcgcgtcattccgctacagagtcgcctgcctgcggatagtcgccctccttctctggttgttttccatccccgtaacgaatccttcacctgcatacctttacgtagagttttcacgggtggtctctccaagagaatcagtctgccgcggtccctcttacttgctcctta

SEQ ID NO: 3580 - DNA, 2411 bp, Toxoplasma gondii
cacaagttgtccaggctcatcgtgcgaatgaggcggaactcgagttcctcagccaacccagcgaggagctgcgaggaggagacgcggagaagaagcgcagagtggaggagagacaagacggcctcggtctgcagactgtgacggtcggagaagcactgcgccaggaggacggaaagctggggtgtctccgcatgcaggcgtggaggcgcgggcgagggatgcctgggatcgcctgagggtgcggggagagaggagagactctttcgaagagaaagacgacgcagaagcgccactgcctctgctccggaagaaggggaagaaacgtaggaatgggcagcagacgatgaagcagacgcagaggagcgaccggagaaagaagaggcagaaaacgatgcaaatgacgacaaggcgagaggcattgcacgaggtgaccagtggcgaggggggagagcggtagctgtcgacgagacgaccggaggcagggaaggacagagacaggagagagcgaaaaacgaatcgcgcgaaggcgaagaggcccagtggcggcgaacgcaaggacgagacacggggggaccctcttgtttcctatgcgaggcaaggcgagagcaggaaaaaagccgtcgagctccactcacaaaaggagaacaggctttcggagacgaagcgaaagacacaccagaagaagccgcagacacagcgaactctgcagagtcgcccggcaaactgaccaggcgaggagaaaacgcgtcgggcagagaaagcgaaaaagctagggaagctggagaagacaaggaaggagcacgagcgaaaaaagaggaagcaagagcggaggaacagagagacgacctcgagagagagaccggagacactgttcgccgcgtgaggcagcgcgagaaggatccccgaagagggtggaaggaggggaggcccctcgcgcggcgagctgccattggacttggtttccgtgtgcctcgaaaaaaaaggaagtttgcatagcgtgaagagacctcactgaacgttcttgtggaacttcgcgtgcgtcgaaagaagaaatgaaaaacgccggattccaggactcgacgacgtcgacggtgttctctactgcagtggcaccgcggtgcggaggctacgtcaacatctttgcgcgccttttgaaggacgttcctttgctgttaaggaattccttctgctgtggcagcgcaaagcaaaagttcctcgtttcgctcatttcacaggaaagggaaggacgctttgcacgtgcggccagcctttgcgttttgcggctgcgttgccgacatggcgcccagtcacgagcaacgaattccccaactgtctcccagaaaagttcaagctgggctgtacaggaagacgcaaggtcgcgaaatgaagcggacgcatggagtcagtgaaaatggcgagaaaaacgaaggaaattcaccggcgtcgacaccggcacctttgtgcccggcgcgccagtgtgcaactgtagcagcaggtacacagccggcgcgagtcggtgcatccgtcaagcgaaacggcgcggcatcacccgacagaaacgcggatttcctggagacaaacgcgcaacaaacgccctaggccagcagccaagagtttgcggtgtctcttcggaagaagatgcgcggaaaaacagcgaagcttcgtcgaggcgagcgcggcttcgctgtctgggcgactcgcatgcgccgaacttgcatgcatgcgctcgaacgcgacacggcggcgggtctgagtcaaactgggaactgtgtcaagggccagatgattgtctgtttttttcctctgagtctccacgtttgcttcggccgttgtctctagaagtagagctcaggggaaagactcgaaaggtccagctccgcgagtcgtctttgccggtcccttccctttctgccgtcgagtgttttctgccccacacgcggcgccaagtgggagagtcattgccgcgaagagttgcgtttttttttctctgggtttctcgtcgtctgctgcctcttcttcttgagttgcgtgtgtctttctcacctcgcaaaacgcgctctgctacgcgcaacgactccgtttctcccgcgaggggctctcgtcctagacgcgctcggcagctgctgaacgacccgcagggcgtcgtctgtctttttttgactcctttttcgtttttcccctcgacgcagttcgctctcttgtttctctctcgcgcactgcggagcctgcgtcttcttcacaggctctgtgtccgagtcgaacgcgtctcagtttgcagggaggtcgacttctctctccgcgcctcctctgcgagtctcttctgctcacgcctgttctcgacttcctgctgtcctcctctcctttttctccgcttcgctctctccttgaacagttctccgccttcgccccca

SEQ ID NO: 3581 - DNA, 3125 bp, Toxoplasma gondii
aatagagttcgagtatcgccgagcatgaatgttttcgtctaccagatccatgttctggtgtacctaggcgtttggggggagagcttcgagtatgctaagatcctttgacttcgctgctttgttcttgttcacggtgtcttggcagttcaggccacttgccgtccgtgagttccaccgtacgtttatctgggtgtctttcttcagcacggcgaaggtgaactacgggtgcttccctgcttgaatgcgagcgaggaggcgacagcggcggtgtttgccattgcgagggagcaaatgacggactggctaaaactgatggtgccgctggaaggggaaaaaaacccttgagcagaatgggccgacagagtgcagaaacactcgttcaggatgtgagttggtagtctttcttttacaaatactttgtagaaaaagcttgtaaataggcctgtctgagaggtgcaagacggggctcgacccccaccaacaactgatctgtaggtggacactacttccgctcttatgtacatttgactgtgtttctcacgaactaacgcgacaaaagtcgaacagatagatgacaccgatggtttattaagggttttcatcgtgcaaattcgcaggcatttgcacaccgctgcagaaataactgaagagtccgagcttacgcagctgggataaaccagtgacgagcacaattcctcgcaaaaggcctgtggtcgaacactggaacatggccgtgaccggatcgttttcacaacggctctcagcgcgtttctcagttttgggtcaacgttttcttgggcatcaccggcaaatcgcatgctgagtcgatcgactctcattttcctggtggcagcggcaaatccagtcagtagacaggcgtgtttgcaatagccgtgtttttttcgggcagtctgaagcgtgaagtttttctttggactttcgagtcagaagttcttgatttccacggacattttgtatctcagacggcgcgttcgtgctcacgggcagtcctgatgtgaacggcagtgtctgttgatctgggaacttgtgttcgtgccaggcgtgctccgctgtcaagaggtgctgcattgttgtctccctctaggggttcattgacttcatttagaatgagactgagaattccctagcgtttccgttttgtatccgtttcatggcatgcactgacgagacgtgctcgagcatcttgtggtttctcgttcactcacttgcacgatttgaattaactttctaaatcctttcggtcttcacatgcgatgccgatggggtggttttcgtgcaaaccgttttgcaaactttcggaggttggctccccgactacccaactcggttttaacgtcgcgacgaacagcagatgccccttgtgcagacacagtggcaatgcaaaacccgaatgttgcctagccttcgcatcgcaggcatgagtgctgcactggtcacagccagctctcaatttgatccttggctttttgatctgctaagtggcattgaaggaattatggagccggtctgagagactcacaagtctgtcctcttcacgcgagctgacgatcagccacgccagttctcgttacgacggtgaagcagatgcattgggtactgtattgtgtgtttgttttagttggttccagaggggccagtatttcttagaacgtaaattgaaagaatgaaatctattggaggccccctatggccagacagctgcacgtcttgggcaagttgaaggacagagaaattatttctcccgaaagcctagctgcatttgctacatgactgacaacgtcatttgtaccatttccacagacgatacgaatctgcctccgtccgtgttttttgctaaatattactcgctattgacttgcgagtaaacgcgggcttttcctcgaccgctttaggttggggggaaggtacgagtgaaagttggcgaggcgtcagatgttacataaacgtcatcctgctgaatgtacaggattcaaaatccaggctacggttgtcacgtgttttttctctcaaatttgatgcaccggttttcgaaagacgactcagttgcctttaacctattctcagagcaaacatatccaagcgaaggtggctttaacgaacagtcgcactgcgtgtcaccaggagccgaggccgaatcgtgaaatccccaacattagtctcgtctgccattgtatacgcgagaggggacgcgaaacattcctgtggcttgtgccgtcgcctgccatagacactaaagtggccgtcatttctctgcaactgtgcctgtgcctccatgacgttcgcctgccccagaaaaacaacaggggcacaagcggcagaatccaaagagttctgtgttcttgcggcaagaggttatgctcccgcctgcggatcgaaacgacggggtagcagatagattggtccttcctacgtaaatgcctcaattgtctagcgccacatctgtctctttcgaatgaaacgacggcgcattcagtaagtacgcgtttcagacgtctacaaacttagccttcgcatcgctcggcggcagaaaataaatggtgaagaagagctttcggatgatgtgtaggctagcggatgcctgttgactggaacaccaaatcgtttctgtatttctgcaaacgggggaagagagttggggaaccccccgttgttccggtatcgcacaagtggtagggccgcataccaccggcaaaaaaggagcattgctccgatgtttttttgcgtctacttgctcttggattccctctgagtaagtcgtcattaagaagtaaaggacgccacgttttgaagaggaaatggccggtcggcctgcacacgcatggtttctgcgagcgcggacaatattttcagtgctctggccccgaggaagcgcggtgtcttgaggaagacaagctccgcgcggcggccttgctcggaggccgtggtagagccggagacggattcttcggggtacggtcccaaacactagatctttttttgcggcgttgatgtggagcagtttcgctttctattcccctttatcttaaagggtttccgtttcgtcttaccttttcggtgtctgcgcccgttcgtaccagctagccactgccacgccctcgtcaaaa

SEQ ID NO: 3582 - DNA, 3395 bp, Toxoplasma gondii
caaactcgcgaggctcagcagagaagcggaaaggagacaggacttgagacgaagtcgcaggagggggagacgaaggagcagtggagagaggtgcgagaggacgggtgtcggaagactttcctgagatgtctgtctgaagaacttctccgtttccttgtgtctctccgtccttcctgatcagcgcgagaggactgggctgcgcggacggcgcatgaggacttgcatcagctccttggcttggcaacgtcggccacgagagaaagagaacgagacagaagaagcaccagcagaatgagcaggaagagaagaaagcgggagagacagaggagaatgaagagacagacccccgtcgtcgacggagacgtcgtcgctcctcatctggtcgactggcggagaagacgcaggagctctcttccattggtgtcggccgcgagtgcaaacggggaaactcagttcgacagaattcatgtggagaaaggccgagcagttccagtgtgcttcctctcgttcagtgtcgctctagtcccgggctgtccgccatctccccctgcctctcagacttttcgagtccgccttaaacgagaaagtccgcaaatcacgtgaacgtctgaaaaaaggtttttctaaaaaccagcaggcagatgcaaatacgcagacggaactgtacaaagctgcatgcggatacacatatggaaagaatcgctttgagcatagtcggaatgacaagctttgagggtctagaacctgctgaaaccctgtattgaagtgacacagacgatccgggcttcctcggatcctccttggcgttacggtgtgtatgctctcgaggctggtgacttctttttcgtggaaaggtgcagagggtacctagttgaacacggcagaaggacagtcttgaagagtgagggaaaagagggggagttcgtgaggaacgagtaagactcgcaacaggacttcgccgtttgccgaagacacgccgctggtgtttctggagaaccgagggaatgtcaggacgcgcgaaggggtctagacaaagcgcagacgctgcaaaaatgtggtggaaaatcttttcagcgaaaacccagtcgggtcgcttccctcatcggaagactcgccccctctgcccgccgaaggagcgccggagacggtcaagtgacaacgactccagagacggaacaggaatcgcatagctcgcaaaggacacgagcctcagagttcagttcgtctgagacaacggacactccagtgcacactgacacccatcgatttctttttttaacgaaaaagcgactagacgctgccaccacaaagcaagcaaacgcagataaaaaaacagggaagcctcacacgaagcgggaatcctcacgatgtgcgcttattgtctgagccgacggcgagagcggattgttggggtttttcgcggaggaagtcgcagccttggccaaagcgacactgctaaaaggttgcaaagagcctgacacgcgttgttcgaaaaaaacgttcttccctggtgtcgattcttgttctagtctcgacttcgcgatggtcttttctcacggcattcgtaagcacacacactggcgagccgtctcagccggggggttctccggggaatttttactggcaaaaaagccttacccacgtttaaacacacttcctcgagtcatttcgcgtcgcggattccgacaaatacggggaagccgtctttcttgcactttctccgacgttctcggggtagctaacgaccgaaggcggtgtttcagtaccgtgtcaacgcaaggacaagatcctgaacaccgggcagagaaaactcttctctgctatctgaatcttccaatccgttcagagaaaatgaaattacccattggccagtttgcccaaaaagaatctccggcgggcgttcctacaccgtgtttcggtaaattcccactataccccgttaggtcacctccagttcttgtggcgagcttggcagccctggggctggcaaggaaaagcgaaagtgccagtctgaactatgaagagaaaaggaagcgaatcactgagttcgtttctcttagagaaacgggttttcatcgctgtttcacctgacacccgcctcgtcaagttgactctcgcgcagaagtatgcttcccagagggtacatccgtatataagccgatcacgtggtttgcaaggcctcacgaagactcatgccgagacgctgaaaaggggagacgaaggtcttcctcgcatgttgcacttcacgaaaacgacctgacatgttgcttcgttgtctttcctaactcctcggcggcgctagagtcccgccgaaaggctcctgcgcagtcatcatatggacaaccgtacacatacgccgaatgtgtctgtatgtctacgcgcaggagacacgttgaagacacacatttatgcctggtgttcctcttactgtgtttgtagaagtctgtttcgtagagctctatgggccgaaaacagcgcgcgaagccccgctagctgccttcaagtggacagagcgggaagaactctttcttacgtgtacacacagctcgtgagctggctcgctatatcgccgggagcacgtgaaccccctgtctcttcatattctttgttttctctgaaaacaatctcggtgttttcctcgctttctcccgtgttctgtgcaaattgaaggactgcgaaggactttgtcaaaaggcaggcaacgaagaaccgacgggtgacgagcgaaaacatcagtccgccatttttcattccctaattggcgcgttttcaaaaacactcagacgcctaggtcaggctcaagcaccacgacgctggtcaccgagttccgcgaggccgcgtgcatgcatgcgttttgagcagcttaagttgacaaagcgttccctttttcctcgaacttgtcacagtagttccgaccttctggatttttttcaaggaaaagagagcggttgttttctgtttttcgagtatcttctttttccgtttcccccgtccgtccactgaacagcttcccggaagcaactgcctgtcggctccggttggcatgcagcgcgcattcggtaaaggaacgtttgaccctctccgttcgtctcccactgaacatttcctcaacaagaaatacggtttctcccctgttcgtgtctgaagcttttccgtacccgcatcgcgttcagggtgcctccagctttccccctccttcccccttttttccgtggttggtgagagcggcccgcattgccagtgtttttcgtcctctgctctcggtctttcttgcgtgctctcgcctctctggatcttcacccttctcttgcaagcgtctgcaaatctcttgcgcgttccggagttcttccgtccgcattctgcgttttcgcgtcctctgcggtgcggaacggcaa

SEQ ID NO: 3583 - DNA, 2316 bp, Toxoplasma gondii
cgacttgaatgtcactttggcgcctcgagagttcttgccttaccgtcatggggtggaggaagtagctggctgcgacgagagccggcgtagcgacgatctcttcgacgccgtctcgcggctgctggtgcgattcctcgctccccttcgcgagtgtcttgcctcgttcgctcggtcctttctcccgcgtcacgtctgtcgagttctcccagtccttctgtctccaactgaccgcccatgttcgggcctctgctgcggcgacagcgagggcggtcgcggcaaccaagtcgatgaaaatcaagacaaggtagtaccgccactgacagctgctggtgttgcaactctcgtccgcgccgcggcctgcgccggtcagccacttcaaactgaggaagaccagcggctgctgtctgtacaccccgcccgtgtacggcgagaaggagagcgcgtgcagcgtgagcgcctcgcggaaggacgagaaggaggcggaggcgggggaaaccagtggctccgtggactctgaaagagtcaatcccacagagtaaagaaacagacggagtgcgactccgacggcgagaagcacaagaagttgccaagaaaagatggagccttcttttcgctgacatgcgcgggtccaggtcggcaggtccgcctcagagcgcgcagacggcgggggtggaaccggcgcggggagagtcgcgtccaaactggagtctgtttccttcgcttctggacattcagcaggcgaagcctccacagctgggcggtggcgtcgccgaagactctccactgtcatggttggagccggaacaaaacgaggaaagggtgacgatctcaagagactccttggacgcgaagggcgcgcagacactgtgcaataaaggcgctccggaagcagtccgagtgagggaagttccagaaactgggaagaaaaacacagcgtgagtgtacaccagccaactctgtgctggaatcaatgcgcaagagagcgacccgcggccgtaccaccccgggagagtcgccgaccgacgtcagagcgtctcttgaaaaggaatggagttcgtcgatagaaatggggagggtgagctttactgttacaagatttctaaaaaaactggaaggacggtctacttcgataggggggccagcaggcagctggttttctcgtgtcttccgtcgcaaggtctgtcgcgcatgtgtgagcatgtgcgtagagaggcagagaaagccactctcggcacttgaaggtcccgcgtttgcttccttcactttaaaacgcgattgaagagataagaacagctctctgaaacttcctatagacacttcctctccgggaaaacggggttctccttccgagactccgtgtcgagttttttcgcatgcgcatgtgtgcagcgacagctgctgctgcaggttgactagacatgctggaaacagcagttttctgtaccttcacgtggctgtaccaaagccttttttccagcaagaactcttcgccaggagctgtttgcttgcgtgatttttctcccctgtagctcgactggtttttccgtaatgcactcttttgtctgtgacagacctcctggctggcagcggtaccacctctcccaccccccgtgtctgaggtcggtgtcctgatggttggacatgtggagtctgggaaaagcggaaaagttttgcgcaacactgtgtttgattctttacaaagattgctttcgagagagcgccgctggattttcgccccttccatccggcaggaacctgcaaatacgccaagatatgtcccggcgtccgccagttcctcccaaccgaacgcagtctcttgtcactctccttcatcgccgactgttcctctcccgcgttacttcctgagaggtgtcgactcgtgtaactgcacattagcagccgctgaaacccgccgctacgtagcaaaaaaaagtattcatatgcaggcatgtattcggtgtgtgtgcgcatgcattttttctcgaatgcatcgctgtatcgcggtttctttgcgaagttcaagagtccttcctggctccgatggaaaggctcgagtgtcaagctcgaggtttgacattcaagattcgtcagatcgccgcaggtcgcgtctgcgtcgttcagcgttcctgctggtcgcagctgcacagtttgtcggaggttgtggcacagtagatgcgaggggagtctggtgtcggccgaatcgtctgtgacctgaatgtttcattctagtcttttgcgcgtgatcatagacctaaatacctcgtgtgagtcgtgcaatctgtgccgaatacagaaaaacgtcctttcgagaaggaa

SEQ ID NO: 3584 - DNA, 1994 bp, Toxoplasma gondii
cagtactatcaagcgtcttcttcgaaataatgctgctgtaagaggttggcgtatgtgctgcttgcccctgttttgtgttgtcttccgaggctagaggtgtgtccaagttgcgcacacatttgcccgcgtttccaatgcagacagtcctcttggtgatcttctgtgactgttttgatatgaggccaactgtcggtgccagcccttctggtacacggttaccagtttacccttcagcagtgcgtggatcttcagaaagacagaatccgtttgtagaaagcttggttgctgacgcgatgaattgacgcatggatctgactgtgattttcctagcctcatgcggtggcttttcactatagacacgaactcttcaaatcatatcacaggcgcatttctgtgagcagtctacgctagacactggtcactgacaacagactattcaccggctgctcaacgatgtgctcgtgtgccgcagagtttactttctagtcgtgaggggtttcgtggcggttcctgctagaagacaagggaaccagatttgcatgctacggcaacctcgttacatcaggctctatccctcgattttagctgccgtaaggaaaggagtgtcgttggatgcatatacacccgagcatctatttcagttgcatcggatacgtctctcaaggatctgaaagaccggttcgcacgtacggcgacgtttccttctaatccggaaacaactaggcacacagaatacccccttccatcctcagtttggagggcgaccaaggaaaaagagcgtgactttgtggcacagaccatttcacctctgtggaacacctttttcaacagtcgtcgaaggcgacgtcctcgtccgtgtcgggttcccgtccccttgcggagttgtcctgccgtgtgctgcgttccagcttccacaccaatgcattacttgcaaatcttaaccacagcgtgcttcatacatctgttgcagtgagaggagcatgttttttgtgtatcaatttgtctacatcggggcaacagcgacgtgttccgcattcgaacgccacacgcttattccgtgtagtcagagccgattgaatccatgacggtggtagatgtcttctcctcagtgttagagcacgagtggaacagccttcgtcgttgacctcaaggtcgcctgatgcggatgtgaaagggttcacttcaatccgacaaagcagtccaaagggtgtccgcctcaaacaagtagttcggttgtgtcgggggttctgacagtgttattgtttccgattgaacgccgtcatcaactgaccatgagcagacaccccttttacgaccttgtcctcctccgcacgcagtccagttaatcctacttctctttgtgctcttctcaatccgaataattcccttgctcttcatcccaattcgaaatgcgctcacttgcttctttgcgtgaatgctggcagtcagtacccccgacccgcgacacagccccctgcagctggagcagttcgtcacagagaggactcatttttgccaggtttccttttcactttggcatttgccgttttgcacgaagattatcttcatcaaatgcctcttcccgaacttgatattggtacaagagtgagcacccacctgccagctacgcgcttgacgttaccaggggtgagagacccaggtttccttctgcgcttcggcacacatcttgaagttctgcccattgttcgggtctgcaactcgcacgagtcttggaggacacgcctctagggcaggtgggactttatgcagaagtattcacgtcaaagtcccatttcatttatgcttctttgagtcaattttgttttttctcttgattcgtgtgatggggttttgaattgtgccgaatcccttgcaagcagtgtagaaggtcatttcatggatagtcaagacaccagcctgggacccgttttcttcaggagagcagtgtctcccctatcaacaaatttccgcaagagtttccccttttccgacaa

SEQ ID NO: 3585 - DNA, 3586 bp, Toxoplasma gondii
acacctggtacgttgttcagttgattccagtgctaaaaagatttccgtctctcaaagagtattgcccctcctgtggcagcgaccttccgaggcaagcagaccgcacagcacgagcctccgttgctgggttgaaccgagggaactacgcctacaacaatcaactgctgagacaagaccatgtcacaccctcttgtgcagactttatcattttcagattggtattttaccgttttttccccgtcgcctcctccgtccccctcattcgagtctcttcagtgcccgcggggagtgaaaaggaccccccagatcggtggacttggacatcctcaaaaagaacgacgcccgagatcggcgatgccaccgccgcttcgacccattttttcaaggtcccccgccgccccccaaacgtcacgtggaaggacagagctgcaagacctcaatgatttccgcgtccggagttgcgcgacgagaacaaagcatctgagcctcaagtgagcaagacatttcttcctcacgcactccggcgattgcggtactcacggtgccatcgtagaaacggagaagcctcggcttcccgtgattgttcaccacgataaccgccttgatcatctcgggtatcttttctggtcgaaagagacaaggaaccgtggttgtttttgcgcgataactcgcgtccttcccaccagcgagacgtcgtgctttcacgcctttctctccttcctagtgaaccgcaagtagcaatggcagtgcgaaccgtacgaaggatcgaagatgagctgacagaagatgcacgcggtggacttattcctggacgcttacggaagaaatgcccttgccaccggcggcgattggcgtttggctcacgactccggagtcttccacgacctggaactggagatgtcttaccacacggaaagggatgagacaccgactctcccttcaaggcgcatgcatcgccggcgtcatgacaaggaaaacggaaccgtcaaccgtgttacggggacgaaaatgcgtgtcagcttgtacacggtgaactcgccgtacgcgaggacccccaaactcgaaagccgacacactggagtctcgacgaagatagactttgaagcgctccccaacataaatgggaagacaggtgtgtctgttgaccattgaaaagaaaaaaaacggcggggtggaggctccgaaaacgtacaatgacgagacacaagtggtcaccagacacgcatgcgcggttctagaatacacagaaagtggatgtcgacgtctgtcacgtcttcctgggactcacgagcttgtcagcgaataggttgtgtaccaagtgaaccaatcccgcgagtagatactcgcattgtcccccgatcttttgcgtgagctcgacacgccgttacgggcagttaaaaggcgcagaccagggaaaggagataaaggaggtatctgcctcgacgacggaaaaagcgacatatcattgaccactgccagaatggattaggatagaaacacacacttgtacatcattcgcactgctatctgtgctcgagccgtccatggtgacctagacccaactttcatcgggtagatacgggttgcatgcaaaggagcatcctctatccttcgctgttgcggctcaggcggaaaaactcgaattaataacttggtacacgaaacgttttcaagtcactctggaaaggggagcctctaaaccctgagaatgttttttcgtggcaatggaggctatccgcttatgtcggctcatatacgaactgctatcacgcctgcttagcttagttggtagagcatccgcctagtaagcggaaggtcgtcggttcgactccggcagtaggctttattttaagatgtactgcttttccgctggtactggtttgagatgattcgctgtatttccttcttctcggtgcagtacaggacgggaaagctgctcgacgacaaaagaaactagcgagattagtgggagtcttataggcccgctcagtgtagaggtaaacatttatccagatcgccgcggctgatgacgtctgctgttcagtgctgcgcaaagaaaagaatgctttcagcctcactccccatctccccgtacaggtgttaatgtcttctgcatttattgtacctcataacttgcgggagcacacgtccgcggcgaaggtgcctgtctcacattcgcagtaagttgtaaacccaaagacggtgccacgctattcgaaggggcgaaacagcaactaaaactgattgaattaaacgtgcctgcaagtttgtgaatcgggtgtttacgttcattggtggagcctcgcaagagacagagtctcacaaggcatctgaacgcctgcttagcttagttggtagagcatccgcctagtaagcggaaggtcgtcggttcgactccggcagtaggcttttacatatctgcgacggttttgtctttcctgctagttgcgcgggtggctcgcggtcttctttgggaggtcagcattccaggaatgcaacagacgccgagtgtttcctcggcaacgaagagcgttcggacactaacgtcgcagacgcacatggacctgtggatcagcaggcgttcggtggcctgatcagctctgatttgattctgcaaccttgacaataccggtaaggcgaccatcgatacaaagaggtcttcttctcataagccagggaccctacttcaagaagtatcctattgctgcgtaccattggggtttcgtccaagaagtctggcatcgttctgagctcctcgcatgacgtcgccacacggatacactgtttctgtgtcttggtagttgactgtatgcgtcactgaggaccatctcatcacatatgagacctttttctggcctctgcacccctgtcaaggttcacttttcccatcccaactcatcgagcttctccagaaggatatggaatcctgcagacttctaaaaaagctatggacacggtcaagttaagattcgaggaatcgatacttgatgcgtcgcatcttgggcggattatcatggcattccagagtcgattcctgcggactaccactccggtcaataccctcccttgttgggtgcggcaacgacagaagccgcctacagatctacgtcgagttgaaagagggactgctggagcttctcggtttgctaaacagccatttatcgaggattcttgcctcttctccgccaaaacatgtcactgacacaacttgccgaacctcctcctgacacaaaaaagtgactgtcccgccagacggcggatctgatcctgcatggaagtatcctgtcactgcgtggtacatgcatgaaggtccaaataaggatttgttgtggaacgaagaaaatgcctttgaagcgccacgttcagctttcttctgtcgcggatagttagattttttttcagtccaaagcttctgcatgcacgcgcagacagccaacccagtcccgacatgttcgcgggccctgcgcgtgtcttcgttctcgagcgtcgccagcaatcgacgtctgcctggggaaagctgcttgtcagaaccgtcgcacgagctcagaactttccagagggaggccgagtcggcaagagactataa

SEQ ID NO: 3586 - DNA, 2261 bp, Toxoplasma gondii
  misc_feature (2039)..(2084): n is a, c, g, or t
tgtatgtacattggaatcctcatcatgcaaaggcatatacagcgttttgtcgatgtgaagaaattcaatgacatctgtgactctgcacaacatatgtatatgtatatatgtatatatatttgtgtatatacgcatgtccgagctttacgagcagttttcttttgaaagggaacaagcagaacgttctgttggtcttgtttaaacgtttgtttcagatacaccgaaccgtaaaaagtcgagacacatgcacagaaaatcgatacgcacatgcttacaaatgtagaaacatacatgttttcacaaaacagctaaccgtctgcacatccacgtgttcgtaaaaatgcaagcgccccttgggctctacatacacttcgaatgttgcactcggctgtcagcggttcggcctctcgaatatccgaatcggacgagaccgtcgcgaagagaggcatgcatgtcttcgcaaccctgcgtgctcgtccagggtattcggaagtctccttccgcgtagatactgttccttcgattctacagaaagtctcttcaaagatacgaagtaaatttcctcgcctatggggcatctccgatctcgaagcgtctttttttgagagctggctgcagcatggaaaagaaggaacagtcgcctccaagagcttgtctctgtcccatgcatgcaccggaaaactgaaaacgaaccactgggcactccttttttcacgtccttgagacgaagttgacactcttgaagtgttgtccagaagctaagacgaagagtgcagaaactgagaaccgtgagctgcaaaactcatcatcaacctctctgcagggcagtccacctctaacctttactctttcctcccgagggcgctctctctgccactccaactctggagttcgagaaatagaactcgctttcagaagtctaaacgtagggcgcttcatacgagccattagagaactgcctactacactgtggatatgttgacagtctgaaattgcattcaaagaactgtttctgagctgctcctctacagatcttccgtcgcttcccgagattctgtcgtccgggatggcgaaagggggttgcccttccttttccctctaaactctctcgatccctgtgggtacacggaagacaaagctcatcatatttaaacgtttcaatgaatacgttgtagggcgtaatgcaatgcccacgcgtcagcgggaactttgcccggagagcattttgaagtagagaaaagaacggaaccacgcgcagcccacagactttctgttcgtgtctcacggcgcagtcttcccttggtgaccgcgagtgagttgggaacaatagtgcaaagatctggttaatatccacctactgtacctattgccttcctcacacatgtagtagcaggagcgcaaccgcggtacggggccgctagagtcactgtacacattctttctgcaatattacactcggcacctcgttcaagacttgccgagacggactgtacggaccccctgcgagttctctgaagtactgagaggaatcggtttgcgtcacggggagagagatttgaatgatggccttccgtgaaacgccctaccagaccgaatatcggggagactgaactgtatagaaagcgtgctcaaaggccaaggggctacaccagcacacatctgaaatggtagaatggtagagtagctggatagctttcccaaacgcggtgtccaaacagttttttgatcaaaatctttactgttcacgtacttcaatggcgaccttttcctgtactctaaagaggcccagttcagtcggtaaactggttacgaattcaatttcgttggcttttgtcttctcctattcaaagagaaatactgtagagactcacctagtttctcatcctgagtaacaggaattgccgtagacgacgtaccactatatatttccatctacatacacccataagtaccactgctcagtgtacaccagaaaggatagtttctttgtttctgggaatcccagctcgtggctcatgaactaagcgaagtctcacgannnnnnnnnnnnnnnnnnnnnnnnnnnnnnnnnnnnnnnnnnnnnntcttcctccgcttgtacgcgcagagcaggctctccgactagtcgaaaggtgcctgcttttctcgacttgtttctttttccgtttcgcatgctgttcttccaccagagaataattccggtgtcattcggtgccttcaacttcccacgcgcgttgcctgtcttggagctccgctttgca

SEQ ID NO: 3587 - DNA, 3522 bp, Toxoplasma gondii
acagaaaacaattcagaacaacgctttccaaatttgacagcctccgctgcttccgatgctcactgttcactccctgtttcttccccgcctttggactgtccttccggcgcttgcagtttgtccgcgcggtttcctcccgccgacgcagccggggcttctccgggagaagacaaaatgtgcgggatgaacgaagcgggagaaagggtaagtgaagaggcggaaaaggtgagtgggggagggagctttaccccaggggaggcttcagcggaagagctggaagaagcgacagaagatgaggctcagaaagtgtcttcgacgcagtggcctgcacccgccgccgcctgtgaaaagggagaagcgcccgcgagcaagccgcgcagcggtaaaccgagcggaaagccaatcgatccacagaaactcggtaaaggcgcccagaggcttgcagcggctgctccaggcgttgcacttgggcgcgcctgtcggcctaacgcagaaaacaagaaaagttcagactattcgaggagagccccgacagttcacaaggacgtagacgttgcgggagcacgtgccgtttcgcggcgtcaccccgagcgtctgtcgcccatcaaaaactcgatgaagggcccgggagctgcggcctcgcagagtggaaaccgccctggcaaggcggtggtccaaccccagagcgtcgtggaagtttctgaggatgtttctactgaaacggagaacgcggcaaggggaggctccgggaaggaagagaaacgcgcgcggtcggtgggcggggactcgggagaaactgagaaaagcaaagggaaggcggagcaggtagacgacgaacagcgacgccacgggttgcgacgaggccgatccagcgatgggcttttcgtcgggttggaaagcgataaaaaaaagctaaacacagacggcgccagtccagcggccgcccgattcgcgacttctgcgccttgcggaattgaaggtgcgcgcggaatttcgatggaatagacggggaaacggagagaagggcaagaaagtccgggaatcatggaaagaatggagcagtgaaattctgagtcgtgaactctggttttgcagccctcgggaactcagccatttcagcgggcacaaaaatccactgttcttcaacaaagtccatgtgaacagccgttagttcagctacacgacggtgtagcgtagtttgtcgaactctcaccgtcactctattctctgacgccacggtctcaacaagccgctcggtaaaggcatctgtattacatatatatatatatatatatctgtaaaaagaggcctgtcgatgtgttgactatgcacatatccttggacaaaagtctcccaggtcctggcggcagtttattactctatcttccaggaccgtgtaagtcttacacaaccctttcttggcgtcacctttttgtgcggtctgtagcccttgtgagtaaacttgtaaagacgctggaggattctcgttgacttttttcgaatcttccgatttcggaagtcgcaagagctccccgagtgagagtgctgtgtccgaaagcgtttcgaccaggaggttcctttgtcagaaacccgaagttcagcgttttctccatgtttccccggagagtctcggcctaaaaaaagcgagtcgctccccaccgctccttgtgtgtgcaatttgtcgaaacccgtgggagtaatgatacacggtgcattctatatctagatcgtacatcggtcgcaaggtatacgtgggatagcggggcaggtaacactgcaagttcgagtctgcggactgtgccaataccgggaaagttcctcttttctactacgggtttcggtcctgtggtgagggctgcgttctgagcggagcattagactacagaaataggcgtttgaaaggcgcactctccgaaaaaaacaagaacgtgcgagctggacagtgaaatcgaccaaaccacgatgtgcagtgcgattcaccgatcattcttcacaaccttgtacggagcacgcaacagttttggaccgcagataaccgcatcccacgaacctttaacagaaactgcggagtcatctaggtagaaatcgtacaaagagtaattacgtccatctgtatgtctgaaatggtagtcgtcaatttacgttagacgctaacacctcgaattgcctgcaaggagttcagactgcgtggtttccccgagtttccactgaaactggtgtatctgtatcctttggtggatgcggagtatcggtggctaaacaaaaccgaaaagtctgactcttgcagtattttctcagtcattttgtggaaatcgagtcaccgagagccggtttactcaagaacccgcctatctgtcgaggactacgcaacggtcaagcacgtgcaagatttcgactcacagcttgaagcaacaaaggacaacagcagacagcttatgtctcctaggattctacagctaccgacgatggtacgacagaattaagctttccggagagtttccacgttgaaaacctttcttcctcgtgcaacagatttactttgtagcaagcagagtcaaccgagatgcgccactggcagtacagggaaagggtgtctgtacgacgcaacagtaggaacttatcttctacccatggcttttcagcgtccaactttctcatggagaagctgaacaatcgaccaaaaagcaaaaaatcctaaggcgcctttacagacagtgaagtgacgtctggtgaccgtgggtatgattatgcctgcgattgtagcgcagggcgtaaaaatagcaaacctaatgcatggcagcgtttcctcgttgaccactcgtcaccatgatagtgcttcattgccgaatggaagcgtagggagtgaaaagatggtgtttttatgttatctttggagtgttccagaagcagccgcaaagcctcgcgccaagtacatccgcatgcagtcggtgccccgttgaacagacatctctttctctcgaatatctgcctctgttgaaggatgtatctgttgtttcttccttctcttctagattgacgctgttgaactcgcctctgcggtggcaactccaagaagtcgtagcttgaagagttttttcgtcgccgcgtttcagggtctttccttgcatgctacactagtgtaggccgcgtggtttgccatgctatcgctcttgtttcaagcggatttcctcgtctcgaaaaccttcctcgttcgggcttcgagcgcccacctagctcgagtaaaagtgcccatgcaatgccgcactgacccttttctttgccgtttgcagattcgcgccaagcggtttgttcctgtttcttttccggtcttgttgaaggggacagcgagagaaaaagacttttcagaagatgagagtatgatcagtaccctctccttcccaggagtcttcatctctgaggcctgattagtcacacttcttctctgcagtgaacagaccaccagttcgacttcggtttaggtccagaagatccttgattaccggatccctcagtccgcggcca

SEQ ID NO: 3588 - DNA, 4560 bp, Toxoplasma gondii
tcatttagagagtttcggcaatgaggatcagatgtagggctgtttcgttcttctgtgcatcccagcgccttcggaagcatccggctgtctccgcgatggcgtatcgttatatgacgacgcaggtgttcgtctcttttgaaagaggcggaacaacaggggcagctgaacgggcgctgtgggcagacacgagagggcaaaagcaccgcagcagcgagtttccaagttacttctgaaaatcgcttcacctgggcaaagacacgaaaaacaaattttccaactcaaaaggacttatagtcacgacctgaatccctcctaatcaaacaaagacacaagtggcatctgcctttgcagtgacaacctacgagtttgccccggtgcgcgttgagaggcgcgcaacacagtcgtgggtctcatccacactctaactcgctaagaaaccaggacgtagagcattctccatccagcactattcagtggtgaaacagcgatggtcgccattacctcttcggtgtggacagccgcgtggcgccgaagatgtgcagcctttcgaaagcgcgcaccgcatcctgcgacctgacacatgtacactcgcggcaaggcgagcgtctcctgagagcggatacaattcggagggttgtctgtttcgtccatttctgcagagaacgagtatgaagaagctatatcgtggacgatagcctggtgcctcgtttcgagcaagcgatgatgggtttagggcaggcgcccatcagggggtacagggggcgagggtctggcgcggaaggggatggcgaccgtcagccacggtctcaaatcagttgtgaatttgcgtcccaaacaagcttattgtcgactattcggtggttgaaaaaccgtcaacgaaggctaccgaagaggcaaaagaaaatgagaaactacactcgagaaagtttcaactataggcagattgcctagcggagcctggggtaactccttcggtagcgacctcttacgtttcgaagcgacacgggtgacggttgtcctcatataccaagcagctgaggacggtaatttcggacagccaaaatatataaacccgaagagcgaattggggcaactgccggctcatggcggtgaagatatgaggtctttacatcagctcggatcggcatcgggagattctgaggatggagccgagcccattgtgtcccggaaaaagcatttcacacagcaagagaagagaaaactgtggtgtggagcagctttccgtctgctgccttgccaggtaaacggcagaatttatggcgccagcaaactggctgatttagtcgatgccctgtgacgcatgcgcatgcgatttcaccggtgctacgtcggcgagctactggctcaatcgcttactcttcagtcgagaggcagtctttatacgaaaaaaccactatgtcacgtgactttacagaactaagctcgaggataccctgcaaatctgtctcttcttggagtctagcatgcgtcatatcaaggaaggcgcatgcttagtctctgactttcgcgaggagcctccagcttgcgggcaagaccacgccatagaagcgtggcaggtaaaagattggcgagccatgatgctagagtggcaaagaatgatgtgctcgggctggattccgtgatgctcggtttatctactcgcaatggtacaattgcaaaacatggtcaatctatgagttttatgttcgtaatgccccaaactcactcgtctcttgttgtgcacggcagccgcccaacctcgttccaactccgatgaagtcgagctctcttgtccagttctcactgttttgtccacgggcgatgcatcctctgggtgtactgtggtacatagacggcgaaggaactggcagtttaccttgttagagcctttacaaagctgggcaattggactcgttccagctcgtgatttgattcgtaaacaagcagctaaacggtctgaaccagtaatccaactcgtactttatgctcaccagaaccagcttattaatgatcctgtctcagaggtgatgggtcccagtacgatggtgctgacaatgctagcgtatgcttggtagcgttctctggttgttgtcggggcctccagaagtcacggaagcaaaaaactgtcttctctaaatagaaaactcatcccgttctttgtacgtcggttcggcatgtactccattatgaactgagaacagtaagtcagagcaacagagggaagttttggacgtcagattcatgattcactcaaatcgttgacatatactcggaaagagactgcgccctcgagcggcaatggtagataagccattcccagaaacagtgtgtttccattgtcgtgctcaaggccctaacggttgcacgaaggtgaaattatcttcgttactatgttattattcgtgcttacagtcggctggtcataaacaagcccactgcggtccacggaagtttactgagttagggagttcgcacgatgatgacaatctgacctctcatccattcgtaatgaagctgtcgcgtaacgtttgtatagagacgcacgttctgaaccacaaaacgtcgccaccattcatggcacaggtgacggtgttagcgtaacttggtttttttactcaagaaagatcttctcagcctcgaaactacgatacccgcaacgtctcgcacgcagtggtgttcgtgtcatttactctaggaggattttccagtggtatctatgagttgaccaaagcagacctacttgcacggcgtttactgaccgagttctctactacaattggtacctcgtctacacagaaaagtaacgatgcttacagtggaggtgttagatacttggttgtgtgcgcctgtgtcacctacaacagactgaatagcgtagtacttgattaaccgtgggaacacctgcagtttatctcattcttagcatatatatcgttcagaaatacctgagaagtctatgtagataagttcaggcgctggcgttattttggaaacgcttggaggccctggattctcgccggtgcgagagacagccgttgcacttcatgacacatcattcccgaggagacgcatacgaaaccctttaaagattgaaacacaggggaaggaaagtcgctgtatagccgtcatgttcacctagatacagctccagaaagtctgtctcctgatggattctatgtggcgaactaattcccctccttgggtcccaaggtgttttccaaaggatgccgtccccacgtaatgtacaacagacttccctcaaccatttgtgaagttactcagaccgactggtctcctgaaaatgcgactaatcccgagccagaacaagtgatagctgaaaatggggatatgcgtacgaggctctcggctctatgtacagtcctttttcgcatgttctgcatccgtgtcggtcagtttatgatccttcttcgatatgatgccctctaatgaagcgcgacccgtccgagggagagctgcttccgtgcttcgtgtcttccgggccgtatgaatggagtgggattccttttcatgatcactgtctagactgggagttaacatcgacaatacagtaccctgattcagtgtatgcgccgctagctaaaaaaattcgtcccttttctcgggattcgttttctgttcgttcggtgggggcaacattcccctcgaacagactggcagtcgtgagttgaccgttttaaggtcccaactccgaaagtgcacgaagaaagttttggggttcgggttactttagtagctgcacaggactatttcccgtcttccttctcatccgcgcttacaattggctgttaactgactgatcagtgtgtgcgcacttgcgcgtcacgtagcatggcgcgcgagaaaatacccgcggggttgatggaagacgaagaagaggagtgaagaggcaaggcgcaggggtcccagcaccctcaagatttgagtctgcctgaagtagccctgccagtagcctcctgagggccgtgaagtcgtgtggaaagtaccgagaaactcgcttttgcagttgcttgtcgcacaacgtcagtatccatcagttggacgaaaccgggttcgtacaccatgcagcatgtcttgtctgcagttgccaaagcaaccgggggctagagtcgtggcgaatgctaggaccagcgaaccctgctgcccggtcaccctgacgaagaagtgtgcccactcagcaacggctgattgcatgcgaaccgtgcgccgggcaacagggctgtctgcactgggtccggctccgacattccgacttctctcaaggccatccagttatcgttcctgtatgtcagaccagaaactgacagagtatctatccgcgggccggaaggccaagcggaatcaccacagtccccgttcgctgttttcgcttcctagctgatcttcgcggcccaagctcaattccagcgattgtgggaaacgacgcagcaactgattcttctgcgtttcgaagttcaaggaggattcccggtgtacggaggcagagttctcggccaagagaggtagacgcaggttgggtacttctttgcggagcggcgttga

SEQ ID NO: 3589 - DNA, 1919 bp, Toxoplasma gondii
gcaggtccaaaatgcagttttattcttcttcaacggactgattcatgcgcgaacatggactcccgaggaggagtcttcgttctgggtgaggtgaccgcaggcacccagccgagactcgagcctcagaggctttttcgcgcagagagacgcaattcttggtttctttaccggttcctcgttgagcagctggacggcaaacgtttttgctggccgtgcatgcgccgagaactcgaagcgcggcaccggaaactgtaaaaccgtaaacacccctctgggcgtttccgactctccacgcgatgtcctgcttttcgtggaaccagtagcttctgagttagaggctcagcggtttcgcaaacaggagtcccagtagaaccttgaaattcaaaacttttctcggtatcacgcagtagaaaaagttctccgcccgcagctggaagacgtgagcacggcaacctacgtcctagaccgttgctttgccctaggagtccgcgaggcggcaggctgctccggatttttcggagattcacacaaaccgaccgttttatctccgtgaatattagtacgtactgcgcgcacacactctaattcacagcgaagaactggatgcagaaggggaacaagagcggcctccctgttcttcggggactgcttttaaaggctcctttggcttcctgagaagaatgtgcagagtgagtaaacgactgtgaggggggggaacaagaaaaaggcacagcaacagagggaggagacaccatgctcccttccttccagaagccagagaaggcgacgcgacatgttctcagggactgcatgcgctccagagatccgtagagatcaagacggggaaacagattatcagagtccagtcacgacatacatgctctctcgacgcccgtggttactaggaaagaaacacaggcttttctaaccactctgtcctcaagactctcacgttcgtatttacgtcatacgtcatatatatatgtgtgtgtaagccaggtaaactaactatatatatatatatatatatatatatatatgtacatttatatatctgtacagatttatatggacgcgaaagtgcattcgggtgtcgcgtttcgctgtttctacggccctcgggacgttgcaggaaagtggagacgttgagtcagtgatttttttcggactcattccccctcggttctcgccgcgtctctgcggtccaggcgaaaactttggcgagaagtgacctctccgaaagcgcatgcgttcaggttttgaggccgtcgcggtcgccttgacggaagagccgctcctcagctctttcttcgcagatgcggtgtctcttgttttgcgttttcgagatctcgcgacgcatggcgtcagagatttcggtgtttcccgatttttctcgccgacgccagcacatgcagattctctctgcacatctgccggtcgtcaacgcaatgcatgcacagcggtgtgcaccaccggcgcgggtgcagcaaggagggtcggtttccatttgcttcactttgttgtttgccgctttcgtttcgaggggcgcgagaacctgctggtacgtccctcgagtcttcccttcgtcgcgatctgtggaggcagagccgctttctctctgcacaccacaccgagcaggctgccgcgttgtttgcttgtttgcttccgagacctctttgttttttattcttcacgcgtcttgtagtcttgcgttttttcagcttctgaactttctcatcgtcaaagccgagaatctggtaggattcacctccgacacaggcgcctctgcaggcttcttctcagaagcagtcctcgcggagacaggagtatttgtcagctgtttccggggagtccaggcgctacacgttggactcagagttcagagcttcctggttttttctccccacaaagagacacca

SEQ ID NO: 3590 - DNA, 3407 bp, Toxoplasma gondii
ttctggatgattctcctcttccgcgggctcctcaaacgcctaaacagcaaaactgcgaagagtcgagtgagcgggggcgccgcaccgtggaaacctgagtgcaggaaacgcgagtacagggtacggccacctggagagggtggcgaacggcgaggcgacagcaggcaggacgaaagcaagtgcaaaaccgggtaaaacgctctcctgaactttcttttccgttgctgctgtctcactgtgggtgcgccgcgacgcgtgcaacgaaaaaacagcgactgaatgagtgtgtagggaaggccagaaagggccaggacgctccgtcccagtgatatgaggttagacagttttgtgggtgcgtgtcgacatgcggagggaatctcggttgcagctctgtgcagaagaaaaggcatcggcgtatgtaggctggaagacacgcgtgcaagctgccgcgcatttctggaaacaaaccttgtccccgctacattcgggagcattccattctatttgatctggtgtgtccacactgatgcgactccagtcaaagaaacagagacaccgttgtaccgaaacaacacacgggggccgccttcgcctgtccctctgcagaacagcacgccttgcggaccccgttttgccggttgaaaaaagagtagattttacttgcgtattcgtggatgaacagtggacgctgggtcgcataggtgagcagagagagagaggcgaacctattttgtgcatatgcggtagtgtttgtacacgtcggtatgtacacagcacacacaagcacagggccgatcggactggcgtctgggacttttgactgaaacctgcctactttatttggagctgtctgagcgacttcgacgcgttgcgttctgtcctgggagcaacggcgagcgatggcaattggactgccaagcggctaagggaaagtaacgtgtcgtgtggtcgcgtgcgcacaagccaagcctcagttttcgaggctgttcaggctcgtaaccgcgaatatctcttgggtatgacgcccaggtgtgttctgtttcttctgcgtgcgcatttgtgtgtcggtgctctcacgtggcggcttggcaactcgagcaagggctgcatgtagagcgagtgacattcgtttcggttgcgttttgtgtgcggccaccgaagctgtcctgtgaaggcgagcgcagattcagttgtgaggctgacggcacaagagaaatcctgcatctcacatatacagtgggaaattgacgcctccgtctctaactggacttctcctcgttcggtaaatccaatttctgccttgacacattacccacactcacgatggaccgaaaaaagtcgccacgctgggtggacgtgcgccgcttctactacggtcgtgagtgggaaacgcagggcagcacggacagttctgtgctgaaagaagaaaggcaagaaacagaggtggaggaaaaaaagggaaaggcagatggaagaagagagatgcaagaagcgggtttgatacgcggaacggaacggcgggttgtcgcagcgacgcactcgatgagccaacccctatagagggggccacgcaaacagtgggctcacgtctgatcagcatttgagaatatttgttgaaacatacagggatgaaatgtcggagagcgatatgtgtcgtttgtttttgtgtggcggggggttttcgtgtgtccacacagacttcccgtcctgcacggtatcttcaagccgtttgcaggacatcaaagtaaacaatcttatgtgagcgtctgcatgtccatcaaacatgcgatctcctggtttccttgaaatctattcggaagagaaggcttgatagtgatgccgtgagtacataaactagtctcagcagtagcggttaaactatttggcagtcgagaactatccgtacatcccaggcgtaaaaagctgctggggtgctgtcggaatgaaactttccacgcctgcgttccagagtaaaagatccgtctgtatcaccactgtcggcttccacgaagacatgtgtcagggaccagcaggtctgttgcattatatcgcggggaaatggcggtttcagctgcaaagccgcttgcaagcccgcctcccgagacagctcacaaatcgctttgtgatgtaaaggtataagtgacggagtgttgcactgctctgaattcagagttccatcccggttatatctgattacctcgattccgtccccgagcaggctgtcaaccggatgagacgctgtagtcgggttattagtaggaactttgtgtgaatgctgcgtgcccatgtcgatgtggtaaagaggttgttccagggatacatcattccatttccaatactgctactcatctgcagcttttagtgcacgcgttacacctcacaaagccgtcggaggcaaggcaccatgatagagtgagagtcttcgcctccgctcaccttctgcacgcctttactggtaggtttgaagcactatgccaaagttgttccttgccaatttgatcttttttacaaatccctcgcctcctccagaagattgactagtgtccttctgcaaagctcatggtgagtgctgatccggtgcggcgttgccctgcagtgctgcatgcagtttgtgtaggataccctcagctatctgctgaatggcccgtgaaccggatcgcgcttcactctccgaagacggattttctcgagctgttcattgatgtgcgggtgtatgtttcgttttctccgtttcccctgcctttcttccggccgcttccgtctaaattccgctcacgtttgaaatattctctcttcctctcgggctggtgtgtgggtcccgtaacaaaagaggggtataccgggtgcccctgtgagtggattttcccggtcttttttcgcagtctttctcacacgcgcttgtctctttgtgtttttctttccaaccgtactttccgagtccagaatcagcagttttttttaaccagaggccggcagttctcgacgagcgcatctgagcgtggtcacttgcgtgcaaggtgtgcagctggcgaaggtgccgaagagcaagttccctatttccaggtacagctcgtcgccgccgttccttttgagtagcggttgcttccgtgatctttttccccatttctcccctcacccagggaagttactatgtaactgggcaccctcggtcctccctctctccttgtcaaacgtagcagctgacgcaacatctgctgcgcggtgtttgcagggccctaaggtactcttgaagaggagcgacagtcgccgcacgacttgcttgcgcaggagagaaggagaaagaagagacggagggcagacagcaagtatcatacgggtatgagtccgtcacaggaaaaaaactggccccccctgttcccagtcctggaacggttcgttccagagca

SEQ ID NO: 3591 - DNA, 1328 bp, Toxoplasma gondii
ttttgaccgcctcacttgacaggtacccttcaagaattcgacttggatgcgcgagcaaacgctcacagttatgccaggggcctattatgtggagggtttcacttcttcttggtgatgcggaagaagtatccctgtacgttcaaccaagtggcgaatcattacagccaccggcggctgtgtctgatatttgatttgcagaagccggctcccacattctgattctttctcggtaacagccaccttcgtcatttcagcgaccgagctcatatttgcctatcacctaacgtgacaggaaacaatgccacaacaggcttcgcataacagggtctgaagcttatttcacctctctacgatagtggcagtcgcaaatcagtgtagccgttgtactctctattgggtgcttcacctagtacacctagccatcgctttgacttcgacaaagactttaggaggcataagctcatctagaagatagggtgtggctccctatttacggaatttaatcctctcgtgaccgtttgcttatcgaaggcagggaagggttaagtgctggtagcagctccggctttgaggtcagcaacttaaatcgcctctctttggaaatgcagttatgaccgccgccaatcatcattgcgaacatgaacaagccatttactctctgcagcttagactccccacggccacgtcatgaggtctgacgtggacgacaacgctgtcctcgtggttggtaggtctcatggattaacactcgttgcccttcctgtgatagcagtgtgccgtgcttggataagttcaaccgacaggtgtaggaataacacccggaccgggtaatggtacacttcagagaatctcaatttgatactgaatcttgcacagtggcatgttagcaagagcaccattttgttcagtctcttccacctttcgttgttttgggaacttcagccctcattaacctgcgctgcacgagcagcagatctacgaagggtccggcgcttgatttcatgagctgtatccgctagatttcactgtgattcagacgcttcagtaacgacagacgtgagcctgcgaatgctgcgtaatccatcgtgcatgcagtgttttttaagaagacggcgtgcgttacatgcacggtcgtcttgcttcgcagcatgcgttagccccgcccgccccatgaaggcgtctccctgcagatcatcgccgtggcttttgtgcgggggacgggtcagaaggagcgagcgtgcgcgcgcttttctctgggttgtgagagtcccttcagacagcgttattaattccgttttccttcgctttctctccggttttcggcaaaa

SEQ ID NO: 3592 - DNA, 1671 bp, Toxoplasma gondii
gagatgcaggtgaaggcacggaagaccggaaaaagagagaagaaaacggacgagaagaaaagggagaagggagaagaggcgacgaaggagacgggggagaagaagaaggggaagaagaaatgtgtgaagaggcgggtggggtcgagaagggtgaagaacatgaagaaggcactggggattctgccgtgttttgaaagactcgcaatgcatgtggacaataacaaaacgaagaagtaacctggggcgcgaaagcactggcagaagaaaacgaagacgaaagacactgaagggtggggggagatgccccgagaaagagaagagtcttcctcttaaccggcgacgtcaggtggagaaaaagccgttcgcgtctctgcggctgggagggaggaccttgatgcactgacatgttgccctgaatgttacgttgccgtgtgtggggaggaagagagtccctcccagaaagagaaatttctgtcgcaggcgaaaatggctgagggtcccccatctcccggcttctgtgacaagaccgcggaattcgctgacgccgaaaccaaaggcgagacggcgtcatctcgcctacaaagggcggcgagacagaaaggcacctcatttctccttggcgaggctttcgaatgaagctccgatttcgaacagagtgagcgccagatctgcttttgtggcttatatggaggcgccgcacttgcaagtgcagctggttctgtccactcgagtgaaaggtggctgtgtgcgttagttctttcgtacgaaacaaaacttcaggggccgaagggcgccagcgaggcagaagaaagtgggtccgcgcatccgtggcaaaagacacagagggaatggagaagacccgacggagaaaactctggagagaaaaagcaaaaactgaggacatgcagagagaacaaaagtcgagcagaacgtaattaccacgaggaagttgggaagcaaactgtgagggagagaaggaccaagcgcacgaagaggccaagagtcggttagaggcaacgagaaaaaagagggaaggaacgaaagtctcacgaagcgacaccgcagtgactgctgaaaggagtccttcttcaaaaccagagaatcccaagaagtgatgtttctgaaagtatcgttttctacgtggagtctcgcggttttaccgatggattttgcgtgcatgcgataaacacacacacatgcaggcggtaaaatgtaaagcgtggtggctttgctctccaaccgacaacagaaaacgacatgaaggaaagtttccagaatttctccgtgcgacgcaaactcatcgatttaacgcgcgcgattcacctgcaaaagtccttcatggtttttgtctttttaccgcaactgtgtggttttccgtaggcgaccgttgcagccgcctgttgtcgcaactcttccttcagagtcacacacgccagtctttgtcgtcctgtaaacaaatgtcctttctatccgtttcgggtcctgccctctacttaggaacggagtcgctttcaagatctgtgtgtctgtcgcgatgtgtgctggagtgacgacagtctgtttctctgatgctcgttttccgccgcagacgaagttacggtttctcggtttcggtctttcttgttgcttttcgcttcactaattgatgtgtgttcagacgatccgagcgaa

SEQ ID NO: 3593 - DNA, 2321 bp, Toxoplasma gondii
aaaaaacatgtttccgtgggctgccttccgttctgtcggtcgcactgaggcttacctatgccaagttcttcctctgtgtagatccgtaagccatcggccgttcggttgatcgcgcgctggttgaggcccatgtcctcatcaaaggtcaatggtcgtcgcttcttcttctgcccagccttgctgtgcgctgtctcttttctcttttcccttttctgtccatcttgtttcttccccgcttgcatcacatctgcaaagaggtcgtcgatttcttttctagagtccttagatttcttcccttcttcagaaacgtctgccgtcttgtggtctgcaggcccttcagcagcctgtgtgtgaggagcggccaacttgtttttccgagatttctttgtcacggaggaagcagccagagaacgtggctgatccgaaggggagctggaagaggtaggagactgagggggctgtctcgcgtttgtgactccagggagacctccccgggtgtcggaccccaatttccgcttcttctttgaggcagaaggaagaaaaacagatgcgctacgagatacagtagacacagcagacgacgaatcctgtgcagaagctgtcccctgctcccgatacttccttttgactttctgtacgagactggttttctctgtgcgttccgctctaggacagagaattgcagctttcttatgtttctccttctgcgtcatcttcgtctattctttcaaacggttccccacttttctgtcgacgcccaaaccttctctggtgtgaagcaacgtaaaggacggcaaaacagtcagaaacgcgcttctgggggaaagaaatgtaacgcgtttttcggagggaacaggacggcgagtcaggtgaggcgaaacgcgactgaccaaccaaagaaggagacagagaggaacgagagacgcatgggtaaacccccaactggagacaagtcgtcgatcagaagaagctcctacgcgcgaacaggaagaaaaaacggcgatagaaacaggagaaaaggcgagcaggtggcgaagcgagaatcatgggcacttcggagggaagggagagagaggaaaggaagaggagaaagacgagaaagacaacagttgagcgtacgggtcgcgggctcaagagcgagatgctcggctggctggggacggggcctgcagcggttcgctggagcaaaggaatgacacggatttttgcggatcggcagagaatatgcggaaacataatactgcctcgctttttcagtgacggggacttgctttcctttctcttccgtcaatgaagctacaaacaacgagcccgcttcttccgccttttcgcgtacttctggagacccgagcgcacgcatgcgatggggatcgacatctcgtcgctctcttcttcccccccacctcaagtcctttctttctttgtttctcttttgcctcgagtttgcaagacaaagatagccaagacgaacgaggacgcatcagtcagctctgctcttccctccggagtctgtattcagtccttttcgtctgccacctcttaggccgtccaactctcacagtggcgcgacagcggcagtctccagttccgtctgaacagagaaaagagacctgaaactcacttttcaattgtttttcctcgccttgtcctcccctgatgtccaccgtctctcccatatcgttctttccagtccgcgtccccacgttcaaacccccgactccatcctaccgtcctcccgtgcaggccgccggacctcagggcctcgttcgagagttgtctgaggacgcggcgctcgactttctttcactgcagttgccttctcttcctgctctcgaggctactcgcttccaccctcttcgcgttccacgctcttccagctgtccccgtaaacgtcttactagttcttcctgctcctctcattcgcgagagaagacgcagtgcaggggacaaacgaggacacagagagagaacagcgcgaaagagtccagcctggccgccatttttcctggggcgtcgctgatctggtgagtgacggcgacgggagaggagagaagggaggaggcaggtgcagtgcgagggtgaaagcttcttccctcttggtttcttcagtgtttccgtcctcacggctttccatttgcatctgtcttcttccgcctcggtgtttcgggacccgcgttttccggtgaccatcgttctgctcgccgtcgtttctgtgttcctctgctctcgacttgtgcggaactgactctcagttcaatcctgcgtgcttcaactcagttcgggtctcgtcgtctgccgtcgtttgcctggcctcgtcacca

SEQ ID NO: 3594 - DNA, 1188 bp, Toxoplasma gondii
tgtatcccgcgtattaccgcggcctcaggatgtgacgagccgacatcgaggtgccaaacctccccgtcaatatggactatctggagagatcagccagcattgcatcctattaatagagaactgcataggttttccatgagatctatttggaagaagaggctcggatttccactgtcaaatactctttgtcagctacttccaaaggaccagtcttcggccgaaactgactgctgttgcgtgcttgttttcgttttattggccctacaccggatgatggccacagaccgcatgatctatccgtacctacgccgtcctaggtagtctgttcgttgaaactcactaaggcaagcatcaagaagattcaggccctacttttgcccgcaacaaaggtatttgtgctgtcactggactctttcagtgacacgcggggggaaggctacagcccgaaagcatatgtttttgttggaaatccacacgaaaaggcaatggcgattgccgtttttacccactgaactgaagtgtttcgtgtatttgcatactctcttcttcgtgttatttagtgtagggaccatcgttgctcgtctccaacccgtcaagacggacagaaccggatagttggtctgcgaagttcccactagttcgtacgtatacgtaacccaagaaacgaggttggcatggaaaaatgcacacaccttcaactgatgccacgcagcggcgctgcacccctaaagtgtaactcatcgctgtaagtgaatggacgttcagacaactgaggtacggggaccgctccgtccctgcagcgtgcatgcaccgattccagacaaacgtatgcacactcacataccttgcggctgcgtggaaacccagtgcgtccccactggaaggtggcatctctaggcagtccttctctaataactggtcgctggtaaagagctattcacgcttgctgtacaaattgttatccatgcgcctacattccataggtttgagacacatgccttttggcagcacgttcggcgccgtcagacgcagcgcctgtgttcggttggaaaaacgtcttcccgtgaaaatcgttacttactcgaaggggctgcagcctcgagccactaagcgtgcaagtttgtctgcgtacttgaacactgatctgttgttgacagaatcatcctgtgttgagaccatccgtggaaa

SEQ ID NO: 3595 - DNA, 3016 bp, Toxoplasma gondii
ggtttcaaaggctcgaatatggctaggctttgttcaaggatatagaggcaaagcgagcgtctaagcgggtcaggcagtccagcgcattctgcggtgttaaaagcattatttcgttggcaacagagccacaggaaaggcaatatcgaatgtgttcagagaccgtctagcgcattttggatggaaccgacggtcgttcgctttcgagcacaaagtgtgggtgtctccattttccagtcatctctgcgaccgagacacccttgtagacctcgaaggtttctgttcgccggatccaagtttcagtgtgtcagcatagttaagatgatgactgcagaactcgatccaactagacgccgtgtattaatataacaaggacaatccgggttatctggaatctttggcacgacattaaaacctcgtacatgcagacgcaacaggatttactccgaaagtgcccttgctacagaagaaacccacttggtcgctgaaaactcacggaagtgaacgcgaaagcagaaaatgacacagagcttcctggttgtgttccagagagcgacaaacacggaactttcggcgaacaacgaaaatcactgcgttctccgtcacacggttcgctggacgtagcgtcctttctgagtgcatgcgctcggtgtctgagtggagaccttgacaatggagagctctttcaatcacggggtaacactcattgtcatttctcgacgacgcagggaggatgcgatacagcagtgcgtgaacgtggaaactcgtgtttgattgctgtgctgcctctctcgcgctcctaatatttctggtttgtcgcatgttcggttgtgtccgttatgaactgacgcacacagagacaagttgaagggttctgacctgagacgctggtcaggtctgcgacaccacaggagtaagccagggaagagaacaggaaactgtaagatcacccggcaaatgcggaaccagttagcgtggaaaaaggaggaattcgcggacatcacaacgacagatgccctagatcttcggaccggatacacggagtagacagattcgttgtctatgtctgtcgtatgtcagccacggattcattcagaagctcccacaaccgccacgaggacaccggtgaacaaacaacgtgcctacacgcactcaaatagctctcctcacacatcctctatttggtcctgagtctgcttcacggaaaccaagctggcaacacacgagtcaagaactcctcagagaacatggtctgttttacttgggctttcccccccgtgaagggtctacttcgtatgatacacgcgagaccaagacgcaaatggcttctcctctcattgttgtagcatcaggttttgtttaaccgtgtctatcaccttccattgctatgttatccgccgccggctgaaagttctttccgtttctgccctctctgttggcccgtcctttgtttcgcgatggtcgctctaccagacagcattttcattttcttccaccattagcgattttgagtgcagtccgtccaggtgtaggctacagaatgcctcttttggctgatatgtgcccctgctggtgacacatggtcaagaggagacgaagcttccgtctctctgctgcgatccgatgccagttcgcacatccctcgtttttaccttccgtccatacgcctgttccgcctgtcgctcttttccctttgacagtctagcaggtgagttttctcttcaagtctcgcggatttcaattcgtggggggtctccatggacagagcaaccagcagtggcgtgcactattctcgcactaggcatggtgtagcatttgggcggggtgctttaaagttttgtcgaaaaaagggagcctgcggcgatgtgcgctccagaaagtcgatagtttagtaaagacaccaaatcaagctgcaatggctgttttgattggcattgcgcttttgtgtgggataggcggaaaggggaaggcttctttgaagaaaaactcgagaactgaggtgtgctctcctcgccccatttttgtgttcgattcacaacagggtaggcgagcagttcctctttgcctcagacgttagtgattcttttcgatatacttgagcaaattctgaagtttcctttctctgggcaagcctcactgccggagacaggaaaagcacgctatatcctctcctcggcatgtgtaggcgaaggtagatcatgcttctctcacgtatagcaagcatgattttgtcgcgtatctgtgtggtggtttgactatttatttttgggctgtttagcgtaagcggcctaacgtaaagtgaggcacactccagattttttccgtgaaagcgcccgacacgtcccgcgtgcttttcacagcgacacggaaacagctttgtttgtccttagatgcttctgcggcttagtctctcacctttttcatttgttttccccgcattcccttccgcggtgtcattcccgatctgtcccgtccgcccctacggacacatctttctattcacatataagaacagccatatgtttgctaaaaaatgcggaagcatcaaggacagtcaggaagcggagcgtctctttgctgcttctagttcagctcacagagaacccccagtttccgctttctcgcgcaggttctcccgtggcggttcaaaagcgaggaagccgtctctgacagaaacgcagggttttacagatctacaggagacaggaaagcacagcctcggttccgtttgtgtgccccttggagtcgagaacgctctgatccgtgctgcgtcgggcgcgaaggctttttcgcagggtcgcgctcgtgcttttgctcaaccttggccgttctttcgctctagccgctcaagctaagcgtgtcgtttttcgtgcgttttcttcatccgtgttaatctgtccattcttgtgaccggcgttcgcgcgccctccctgcgttgctggtctttgcgtctggcgttcgtctgtgagtcctgtctctcgtgactcgccttgtctgtttcttgtttcttatcccagga

SEQ ID NO: 3596 - DNA, 2896 bp, Toxoplasma gondii
cagcaacagttcgagcaggcagcatagcctgtgtcagttccctctttgcagccagctgcaggaacccaggcgcagcacgacggcctcgcgtttttgcttgccggagaaaaatctccacagaggcgtctgtcaccggaagctgcctttaaattttgacccaaaagctcggaatggtaagaagccgccagactaggtgtatgcacgccgagcatctgaaggtgctggattgtgtacggcagggtaattcgacgcctcgcgggacaggcgatccgagaactagggaatgaaagagatgcctcttcgttcggtttcccggagtgggcgctgcagcaggagcttcggaactcttcctcatcgtgttctgaggcatttttcaacaaggaatgacttcgctcagacgcaggtgtcggccacagcgcaggtagtgccacgcagtgaccttccgtggtccccaacgtcacttcgctctcatcatatccgccccacccaccgctaaaaatgcatgccgtgatatagccaagactggacgttttccgaacgttcatttgtggctgtgtcgctgccgagacaggtgtggcacgttccgtctcaggatcgaatcgtcccacacacgtcccgtcgtctcccgacgcttcagcacattcttctgttttctttgagtgaagagggaaagacacgtttccttccttcccgcttggactatttctgccttcatgactgtattgtaggaccgagctcgaacggaatgtcgactgctgtttgcactcttcatggcgtaaaagtccggagggcgagagacgctgcgctgtgggcagaggattatcgtccgttggggctgccgccgactcgtctgttggatgtgggacttcttcctcttttacctcatcggcgaagaacggaagcacatgctgtacgccatctcccaaagaatagaaagacagaacaccggcgccggtgctgctgatccaccgcatgatcggaggcgtctcctttcagacgggaaaacgagggcatttagtcgatttcgacggtagactcggtttcctttcaagaaggaaaaatacctttaggaacaagtgaactggacgatgctgtcaagaaccgacgacacggcgcgtggacgaaaaatgggcggtcactaacagccaaagctgtctgcatctctggggcaacatgcgacatcgaaacagtcagtgaagtggtcttggcggcaagatgcgtgctagcaaggtatcgtagacgcagtgtatcagaagaggcgtgaaaactgccgaatgctctcactggggcagagtttacacggagttgtcgactttcggcagcgtggacaaacatgccggaacaggaagtgacccaaacccgacaaaattaaggcaaacctttctccagaaacaaattcgctggccagcttgtctccgtcgcaaagggtttttagacatttagagagcaacttctaaagccagaaaatgcgtacggcaaccttctaggtggcagagcactctagaaaagctggcccgtgatcgtgtgaacgcgcgttggtccttcccaaacgagccggaaagcagatccttcgagcatcccccggcacaatatggtgacctgtctctccaaaaagctgcccctctgacggagttggggtagatttgaagagcaggcacatttgtccgacgactgcctgtttctttctctcggttttccggagcatactgaagaatcgattaatattctggtgcttgagatgccagcctagcagtctctacagctgccacagcgatttgcgagaggtagggccacgaggttttcttttgtttgcgagaagcacgcgcgttctcttgagctccgcatgtagtttaaagggaggcggaagacagacgagagacaccgagacggcaagacagagaacggccggagaaagggtcactctggttttacgtcctctgatctttggcggaagaaaccagctgcgcgggtcgcctgctcccgcgacgcctgtcccagttcgagctcgaggaccagcttgagagagcggcgactctgcggtggcgcgcaagtaggcggggagctacgcaaacatgcagaaaagccgcttgtcgccgcagatatctaggcatatttggtgaatcggcatgttttgaggggggattttcgaattcatttgatgacgaacttcctcacaagccagtaaagagcggagcgggagaactccgtgcctgagcacgagccagacgacacgcgcgtgcctgcggcgaatcctgacctgcaacttctaagttggtctgagttttcaaggttcttctacggaaagaggctggatcggatgtacagatcggaacaaaacgatttccttcttttttgttttctgcctgacgtcctgaatgaagaagggcagttttctgccttctcattcccgtctctcctgcgcgcggaacgaagtgacagccgctccgtgcagcgaacacgcgaaaaacagccgtgggtgccccttaaattccgtgcatctacatgctcaggatttgttccggtgactcttttggttccgcagttgtctctcctgtttgcgggtgcgtccaagagaggtttcctgtcgttgttctctcggaattagatgccgctgcagtgtcgaatatacaccaggagacgctgcggagtttcactgcgtcatcgtcagcccatccctctctacgatcttcttttttcaaaccacatagcaacgcatcggggaagggtatacacaaagctttcttcctcagtgcccgttgagacgggcgttgttcagtcgacatcggaaaggctgccgtcgattgcaggtccccgaaagtctctcgcctcccatcagccgttccttgaggacaagaaagttgaccttcaggtttcaaacagaaaaattcatcaaaca

SEQ ID NO: 3597 - DNA, 1407 bp, Toxoplasma gondii
tcttttcgtttctccaaaaggaaaataccgtcccggctccgactctgatcgacacgtcggcgaacggcaggagaacatcatccacaacagcttacggtgtgagatgactttttccttcctttttcagcagacacctttggttagaagacaagctgctttctgtttcaagacctctggttagaagccaaactgctttctgcttcgatatctttggctggagaaaatgtttcctgtgtctcgaattgcatgtggcgaagttttcagctcacgcatgtggtcgacgacggtctcgcctgggagcacgaccgcgggtctatggaagctgtcgccgcgtcgagtgaactggatgtttgctgcaggttttccgtctccgtctttcagcaggtgttcgtgtttatggcccttcttctttttcgcagcttcccagtcggcactcgtgagctttcttggaggcagtgcgtcgtttctcaggttctccatttctttcaggcgcggtcttgcaggcgaagtggagtcgattctgccctccacgaatttttctgtcggaacgaaggtccccgccttcctcgcttcgttctcctttttcttcgctctttcttcctcggtcgcgaattcccaaggcccgccctctccgtaagtgaccgacgcgcgcggccagtagagcttcccgcccatccgtacttctttccttgaccccgatcgactttccttcttctgatcttgctcgccgccagatttcggcgacgagacagaggagctgtgtttttttctctcggcgccgcctcgacgtcgcctcgacattctgcggtcgttgccatcttgagcgcgcggcgatctggcaccacgatccaaagaatccgaacgtttccgcgacgtttcccccgaacgggtgcttccttcgacgaccgaattcggagagttgcctcccgacacacccagagagtggctagagagttcgagcgaaagcagggaagcgtctgggtgcaggactgtctcgcgatcaggaggcgacgacccgatttctgacggtgcgcgagaaccggaaggcgaaagtggacttaacagtaggggagagtcaggcgaactcatgaggacagcagactcggagtgatccggcgaaaccgcagaaacgtcggaagctgcagacacggacggcggaagcggcttgaccggcgcggcgctcccacgagaaagatttgaggcagaccggcggctcgctttggcgagggagccgcctggagagtccattttgcgtcgggagaggagacaaggcagagcaaagccgagaagaaagagagaatctggtctaaaaaggaaggatagaggcaggctggcgcggaaaagagccggtcgccgacgatcgcccgcgccccgctactatatacagccgctggccgagacgacaga

SEQ ID NO: 3598 - DNA, 1479 bp, Toxoplasma gondii
tttttcctcctgtgtcgcttctctcccatcgatacctttgagggtacgcacagccgttcctctctgcacagaagagaaaacagcaaagggagaaccagtcgaaaaacctcttgtcgcaaaagaacgcgacatgcagaagtggaggagagagagaggaaagcgtctcccctgcagaacgacgcagagttgttgaagacagagaagcttcacagacaccagcaagatgatagaagcgcatgcagctcgtggagcagaaacgacgtcgcagtgacaaagaacagtggacggggaaactgggcaaagcagctctgaaaacatgatttttcagacgagaaatgtcgggggtgaatccgtagaggagacgaaggcggatggggacgagaatctaaaggaattgtcgacaaagaagagcgagaacgacactgcgaaagcagagaaagacgacgagagccgctcgtttcggactggagaggccatcccctctgaaactttaatattaaaggggagaaaacgacttcaattgaaagtgaagatgcggcacgaagcaaagagccgccaaagaagaaacgatgcagaggccggaagaacgttgaaatgaaggagagaaggagggagcgagggggctgtttgcctcctggctgtcctggagtctctcgacgcgaaacagaagtttcgccgatgaagtacgtccgcttctctctctgctccctccagagaaaaaaatgaggaagaaagaaggaggcgagggggagaaaagcaaagaaaacgagagaagaacgccagtctcattcaggcggagaggagagcaaggagtttcgcagttaagaagggaggtctggctgagagttctctcttcgaagagcagttggagttgtctcgtctctttcctcgtctgtccgtcgacctcgagggaaaacagtttttcctcattcatgtcttcctccctcttcgcggcaccgagctgcttctccaggaggttctctcgtcttcctcctacacccgacaagcctgtccagaggacgcagagcgcagatgaacgccggagaggacttcgaaaggcagagcgagagcgacaaggtggagacagaagagcgaagagaagcgcgaaggaaagagagagcgcggaagacacactccgcctggtcgagtccccgtcgcttgaccagctttttctcgtcattgcatgcgccggcggtcggccgcagaggcgactcaggcgcgtttggccggaaaagggagagaaggacaagaaagaagagaagaaaaagaggaaaacgaggaaaacaaggaaaacgaggaaaacgagggaagagagaaaagaagaaacgcgagaaagcgtccacgctggaaacggggaacgcacttgtgtcattggcgtctctccaccctgcctttctgtgacaggagaacttgccttctttccccactgtctctacgcgcaggaaaagaaactcgccgtggaaggaagagttctctaaa

SEQ ID NO: 3599 - DNA, 4780 bp, Toxoplasma gondii
catttcagaaagcaaaggcacctgcgtctgtcgggcaagatcggtgtcagcggccgatgcctctttctccggtgtacgtacacctcgcgtgtcggggccgcgagcggcgcaggcgttctctgatgtgtctgtacactcgagtctgacaggattcgctgccttctctccacatgcacactgactccgaggagggagttctttggatccaccgacctcgactcgctcggcattctcaacagaaaggacagaacaaggactgcaagcttgtcgcgagctagaatcagtttcctgcctcaggtgcctcccctccgccgtgctttccgcatgctcttctccgttgagtctcgaccccatttcgttgagtttaggaaaagagggagcactcccagtcggtcagtaaggccctgtcttgaagacaggagagggtacgagcagcagaagaggagagagaaggttcgcgttctctgagagacagagaaggaatccttcgctcctttctcgttctctggattcctctggacacaagttccctgcttcttctacttcgctgcgctctgtcgggagactgttcgcctctctgcgtctgcgccgtgagtgcgtcgcttgcgccgatcgcgggtgtatgtacaccctgcgtgtgtatcggtggagaggcctcgaagaggaggcgtcgcctgtcgcttctgtatcgaagccggtgagtctttgttgtcctgcctaaacaccgcagaaacactcgcagctcctttcctcagctttctgaaagacaggaaactcggacttccgatttttgggtcgacaggagccgtcagaggtctccattttccgtaagacagccgacagcaggacccggtttcttcccttggcagttgattttcttttcgggactccacgctcgaaggttgggcatgctccggccctgcagtgcggtggtgaaggcggacagctaaaaaatcttacagacgcatgcagtctctatctctagcggagagagactggagtgaaaaagtccgtatgtccagagggtcagcttgaaaaaacagagcacgatgagtcaccgaaacgagacgcctgagtcgttgattcccctctgttgcttaaaatggctttttccaaaagaaaaaaggagtgctgcctcctgacaggctgtcttctcacatttacttctatcgtctggcaatccacatgttgccctgtgactcgaagtcggaaaaaaggtctcgcgccgccgtcagagagacgcgcgagacagatactccacgggaggaaaaacctggagatgcatcggctaaagaatcacagattgaaaggctttcgagaaaaaaagctcgagaagaacgcaaacgtccaaagccgtgtctttcacgatgcagacctcgcttgctctcgcgagtctagtgcctcgcgagcgagagaagcgccttttgaggaaatggagacgcagcaccccgtgcagacgcgcggaatcttcgttttccgtgtcatgaattcacgcatgccaatgtgcctttgagaaatctttttcaagtcctcggtttttctacactttgctcctcaaccgtcgctcgcgagagtgtgcatgcaacggtgtgtgtcgacggatacgccgagtgccgcgaaatcagccagtttgaggagttcgcaagttggagaaaggcgcgtttccgcttttgcttttcgagtcattctcgacagaggagcaaagcggatgtgcagcacttcgtaacacagctcgagtgcacgattcgaaggatttccttccaagaacttcgctacattccactgttcagtgtcgctgcgccgaaaagggccaacacacttgcaagttcagcagaaatgaacactccacattcaaattgcatatcgagtttcttcggaatgggcctccagttgcgagctgcagacaaccaaggtctttatgactgctgcacaccacgaccttatgggtctgcttgagacggctggaaaatgcgagtaggactgtgtgacactggtgcccagctctgtgcttttcctctctttccgtttcagcgctgcacacctagatccttctgtgtcgcgcagacagtctcaacctactgatgatgtggaagcgacagttcgtggacttgctgtgagctccttttcttacaatgccgccgttctctcggtggcgttgtgggagcgtctttcgacccttctgtcaaggttcggggtcgtttcttcagcaataaaggcgacctgtttgcagcttgtacggttcctctgaagaatgcgttatagaagacgacgttcttccgggtaaacattggtgtgaatcgaagggaatacgcagagacactctacgccttgtgttgcggactaagactccagttttacgacacacagacagcacacgaccgcggagaaggcttttcaaatgccgtctctcaaaaatgcgcactagacaacattgaaaaagtcatttcgtccagccacatgtaagggcgcgggctccgtgagtcgactgtcttgggatttcaaaaaagtccacgatatacgcgttgctttcagacgagtgactggggaaagggaagctacgacagcacttgctgccgacacgagaagccccgagcgcatgaatcgtcctggagaactgcgtggcactcggcagggctcaacacagagcgatttgccgaggcactgcgagtgcggcgcttgtcttgggttgcgttgcgtcctcccacagagttttctgcagtctgcaaacagagctggaacgttttcttacacagacgcccccgctagtagtctctctggagacacagagttctctcgaacgctcactgggacgtcgaatatggcgaaaaggtactcgagtcctcggcctcccgcgaggcaaaagcgagacgcaagctcttcctgatcaacacctcggaactcagagagattctgacgctacttcgcactttggactggaggcactgctgtcgacgcaccaaagcacagcagcctactgcacatctgctgtgttctagacgaaatgcagagattcatgtgcattcccttgtattcatatcagcgagagaagcatttagtgtaactttcgtcgaagaaatcagctgtcgtattttctgcttggtcccagtggagccagggggcaacggcttttctgagtagtcgcagacatctacaatcccccattaaaacgattctcggctttctgcgctcttgttcagttcggcctttctccttactcactcctcaccccgcctctctagagctttcttgccccgcgaagtcccgaccacggccgggtgttttcgatgtccagatactgtctgagtcgacactatacagagaggaccagcgtcttccctctgcgcgcggccatactacgcggaaacgaaagaccgtcaggcgctaaaccagcagtccaactcgtcttcacaactcaccgggaaaaggtgctttacataaacccatgaatcccttacaacaccgctaacactcttcgaagacttgtcaagccgcgcatgacgcgacgttcaaccgggaaacccccaattcgagtgaccaaagacatcccagtgtacctcgagaagtacaaaatgaggtcctacggttcccctcagaaaatgtctttctcttggcaggtccagccgcgaactcgcgccctgtcgagcaaccgccaggtccaagcgaagctgtacaggtgattccgccgcgtgcggttcgatccgaggcttagttgtcaaagagtgcgtagactcatggttgcagggaagaagcaatcaaagaatgtaaataaagaaacagtacccttaaggcgtagagcgaaacaaggagatccggtagcggaattcagggcggtcgcgcgaaaaggagcgtccgccgtctcgccttctcgcactggatcactgttttcgacctttgtttttttcctgaagagaccttcgcggcatcagctggcttcagtcatctcagtaattgctctgggctacgtcttttgttaagccaagtttttccgccgcgcacagaaacgcccggcgaaagggctgtcgcatttgcagcccccgatcggttgaacagtggggcatgcgtagctggcgacccgcacttgaggacgcggctgtttcatcaagaaatgctctccacactccgctcccgtttgacttccttgctgccttttcattgagtgacttccttgacgcttctgtacttcttcaccttccttttctgcctgcgaagtgtcggaaacgaaagcgtcgcgacgcatgacggagacgcgcacaatcgaggagaggcgcgcctcaccccgcgaaaaagagcctcttgttgcgtccttcctcgacgtcgctgcttcgtctcgtctcgttggcgagaatgtcaaacagaagttctcgaacacttcgcagtcgaatgcagtttgtgcccccgccatccacgcgtaggctgtcctgcctattctatcctttttgtggcgctctcgcggcgactccaagagaggactgctccgtcgaggccgcgcaggagaggtctttctgcgaagcctgtcgtcgcaaccgggtctggatggaattcgtttaaagcctcgtggcacagaacgtcgacgaatggcggaaagaccgaaggagtgcctcgtcgatcgataaccgccgaagaagagaaggggaagagaccccggacgcgatcgtcccggctccgggtctgagagcgcgaggaagccccgccaactcgctcccgctggcttcgccgcgactgtccgaaagaaggatcaacacagcaacatcgcatgccagttttctcgcagtcgacacga

SEQ ID NO: 3600 - DNA, 2154 bp, Toxoplasma gondii
agtatctgggatgtcaggacagacaaaaggtgcacgcctttggctggcaggtttccgcactgctgcaccatctgaacacattcaagattggggcacagttacatgatacaaaccgccagaccaggagacgggtggatgatacataacactgaacgtatcagcataaactgctggtcgtggaagcgagtagactagttttcctgtacggtgtagacgtgtgatacattctccaatggaggcgtgtactgcaagttctcgtgaccggtttttggtttacataccgcccagcgaagaatgagaaactcagcaaatgagcacggtgtggcagctcctgcgtctcgggcttcccgagggatctcgtgagggacctgccgctggacctgcacctcggaaaagcaatcgcatttcgtatcgagaagaaacttcggaacgcggcgaattttcaaggaaacagtcgacatttaagctctcccgagttctgcatccatagaatcgcagcactgatgggcgcacagcaagagtatggttcatgcagtaaactacgcggactcgcaggtgatgccgtatatacaaggtagatagaggatctaccggctccgctatcaccgtcaggcacaacatgtcgatatggtttcatcggccagctatatccgtccccgtttattgaagctttagagacaagcactcagatttacagaaaggtagaaacggtgcacaccgaattcgtaggacgtccttgagccgcgccccgagttggtaagagtagctaggagttgagggacgccatgtgccccccctgaaatgccgccgttgcatattactttgtctggcgaaacgcttccttgttaaggagctggttgcttcttggaagttgtcaggtgaggaatggtcgcttccacggctgcggagcaagtcacattactttcgaagtctctcaacgccgtggcctcttagcgagatcatacacagcacaaatctataattcgtccttgcacagatagatcgtgaagatgtcctccaagccacgcagctctacgcggctggacagataaaagcacactaatggtcctcaggaggcaaccctgccatacgagcggttccgaagcacagacttgtccaggcaggctggcagccacttaacacttccaaaagacaccgcggaacacagtggaaggacgggagccgaagtgtccaacagtgggaaaacgcggaggcaatagcatccgcctgcgcaacactgacggtaagacgactcagctgctggtgattcttgcaggagggacatgggcgtaggacatgctaagatggcacgagtttgttctcggtgtgttcatccgccgccgagcatccttcgtgggttgccgctatcgtacaagacgcgttactcagtttccacgttcgcacctgtgcttgcaccgacctcccaacaaatttcttatgctcttggactcacctgaagtccggcctctctctgaaagccctgacatcaactttatgagcactgcacagggacccagaaagacggtgtgacctgcgttaactgtcgctctgcggaacagtttttcgatctccctgcctcaccaatatactctttgatttgtggcgtgacatggctacgtgttctgccgggtaacaagcagggcggagcagcggtgcaccagagcattgcgcaaagctggccccccttcgttaacgtgattgtcagaaggcatttaggaggctttgcctggtgactggtcgtcctctgtctggacgataagtcaacaatctggtcgtctgtgtctcgacgaacccaagcgatgtcagatggttttctgacaaagactgctgcgtccttccacaacctttcctaacctctacctaacgcgagactccattcaccgcgaagttgtgactcaacacgacagctgttccagccttccacacacttgctctgtgttacaatgcgagttgttcaaaacgtaggaagtactggcgtaaggaggcccttccagatccattcagacataacgacgacagactttgaggaatgttgtctctctgagtcttcgcgtccccaagcacaccgagtttttgatggcgccgacgagaaccgggtggcaaggcggcggtcggggtgtgcccaggattggaccaggaagaggcgctggagca

SEQ ID NO: 3601 - DNA, 1824 bp, Toxoplasma gondii
cacacagacgccatctactttcaatgtagcgataggtgagtttcgcgcgtcagtttcacggaagtttcgcttctcaccgacgccacagagaaactctctggacacagcctagacagaatcgcattcgctgatacaatgtgaaggtaggaaaaggcagagaaaggctaacggcaacaagtacggactgtcaactggaaaaagcagagctggaactctttttctgagcacgcgacgctgcacagccgctgtggtcactcgagcagggtgtctctgccggagagacagagagccacaggagaggagaactgaaattttgtgtaagtcgccttttctctgtcgcttctcttacaaagacaacgcatctgcggccttttcaagctgtgtcggtcgaaaacgatctgccttcatttggtttctgtgtctgactgccagtgttctctccacaaggccctctgtctctcctgttccctacacccaagggagggaagcaactcaatttccgttgctttgcccttccggtgtacagacacccgaacggaagaagaggcaagccagcgagtctgggagttctacatgggccagactgataattggtgtcgcagggcgagagatctttgccgtcgaacgctgctggaaagccgcctcgagtccttagaggagaaacaaatgcaagagctgcgtggaaagctcagcttccctctgttgaaaaactccttaaatcgacgtggaactcacgttattttgcttcaaaagaacgtgacttcttctgcagtgtttctgccaaggcgcgtgagaagaaccacacacactcccagcgagttccgagaaacgtctctggaaaagtcaggaaaatcctcaaacggggttcggtgacgaaaccccgttgtcctcctccgatgccttgtgtgcaacggagagaaggaatgttttttcggaagtcgatgaaacttcgaaactgatgcgaaacgcccgcccagtgttcaaaacgcgtcgtgctcttctgtttgtggaatcattttggatgctgctgaaggcgctgccacgaaggcgacacctgtctcctgcccatccgtgtctctcctgcatatttctgtctctctttcctctctgcgtttcttccttgtttctttcctgtctccttttctccgtcatctgtcttgtctctcctctcgtctgtggtacgtggaacatttgcttctccgagaggagaaaaatgtaatactttgaggccccctgtcgctcgaagagccgcggactctccaatcctctgtttctctgatttccatttctcggcttccccatatttttcggttgactttcctttctctgactcttgtgaaatccgagggtgacatgcactgacacacagtgcgcgtcaacaacgcgcgcagtgacatgcagagacaggaggcgcctgcagcgaaagggggacttcgaggatcctttttccccaagcagcatttttaggccgaagctccctttaacattttcgctgtaagaaggctttgcgaacaaatccaaaataaaagaaatctccgaagcacccccgatttctttaaggctgcggcgcgcccggccggaactgtcgtgtctccgcttccgcaggcaccacttggccgcccttttgcagacgaaaatctcaccgctgtcttgtctttttcaatgttttccgtttttcacgcgcttctctttctcacttcactcggaacgaactgcaggtaaacggctgttcgacctcctggagggagaaaagcgaggaacggttgtttgtgccgcatgcactctttgaccatctgagatgtcatcatttttcgactgcaacca

SEQ ID NO: 3602 - DNA, 2238 bp, Toxoplasma gondii
ctcttcccttggagtctatacgtcgacgcagtcgtttcttcgcgttccgagcttccatgcaatttttactttggcagagagagaaaagcaactcaaaaacgagagcagagtggcaaacacgagcgaagctgtttcagagagaccatgcactgacgatggaacttccccagttcttctgcatctttttttgtatcgttgagcaaatgttcgtacacctcaaagaagaccagccttctcgtgctcgccagaaaacaaagtgcacactgcctctgaaactcggcgacgcatagaaaggccaggagagcacagtttcacgttgtgcttcagcgcagcttccaggacctttcctaggtgcattgtccggccatcgaactgtctatatttttacctcgacaccgaacagatgccaccagacaatgaaccccaagtgtggttccgcctcctctgtagaaagagatggcactattgatttgcagaggcaagtctatgcaacactggctgcattccgttcctccttgggaacactctgagacgtataagtctgcttagcctctctttacaaatctggtctcgagtttcaggcagcgaagctcagatttgcgccggcaaatgccgagcgcggcaatgtcgggtcctgtggagagtccccgcgtttcgacaactagagttcacttgcgtttgcgttttttcgtgagaactgcaatgcaggcaacccgtcaagggtgtgtgtgcacatttggaggcagctcaatttccctttgtcactctcggaaatttagggtggaaacaactcttccagtgcatctgtttagaggcggatgcctcttggccagtgcgtgagctggttcggcagagagtcctggaatgtctatatttgcctgctgtcctgggagcgcgagcctgccctagattgaggactttcatgcacagtcgcgaaagcaaaacgaagagcattgagaaacgccgcagaaccccctactttgagagcacggaagcgggtgcgtgagctccttctcctccacagacaagagcgaactccacaccgcctttttccgtttctcgctgctcggtgggggcagaagccgcctcagtgctctcgacaggcagtcttttctcagacacaccacaccccctgagattctgcgttgccgcaggctgatacggcgatctaattgcccggccagcactgcgaacatcatccttgcagaggaactgcatcgtcgacagttaagtcaagggtgaaggcgtcctggctgagtcaacgaaatcgttgattgagtctttcgctccggagaactgtagcaagcgtttagtttttccgcggctccggttgagagccgccacctcatctggggaatcatcgcctcagaggcaggagtgtgtgtctgtttgctggggatacacacactgacattccccgcgttgggcagctcctctttcgcctaaaattctcgaagagctgtatccaagggccgttgcgctcgttgtgcggcaaagagagagcctgtgaggcgccgtcatttttgccgtcgactcgcgcgcgtggaagccgccctacttttcgaccgctgacctctttttacgccgttcgctcgacggcttctttcgctatgaaagtttccttctcgttctttcttcggaaaaggaacgggccgcttcctagaaagtcccaacttctctcctttccgctctgttttcttccttcctcccgtctctcctccggcagcaaggtgcctcttctctctcgcggtgtgcgcgctcgtcgcgcgtcttgtgcttgtctcctttcgcctgggggctttgcaccctcttctcctctctaccttggactttctcgctggcgcgtttttccctctctccctaagccgtccagacgcgagttcgctcccctgtctccttccgaaggcctcgaaacgctcaaagtcgacgctctgagggagtcgtgcatcccttcaacctacctcgaccaggatgcatcttagttccacggtttacatcgctctctccattgttttcagctcagccaccgaccccattgccggcgtttctcacctcctcctcacggaagcgccctccagcctttgcgttgcctcgtggcgtctcgctcctctcgctcttcttcgcctcttctcgctcttcttcgcctcttctcgctcttctcgccttggtggagaacgcttgaggactggaggcggcccttggatttttctccacagtttctcaagagctgaggcacca

SEQ ID NO: 3603 - DNA, 1760 bp, Toxoplasma gondii
cctgactaacactctgtaagcaaggtggacagaagaaatgtcattcgtcgagtgagcgacctctgccactctcgcgaaaagagcgcgtgcaggggctcgaaatcttcgctggttcaacatctaagaagtaacttttttccgtcgctgtcaaaacacgagggagaacaacaattcatcataaatgtattgcttccatctatatctatacttataagtgtatatatatatatatatatatatgtgcatatatgtatacttataatgtcttcgagttggactgcggggttcgtttttcaaggtcttttttgcttgttcccagttttgttttttcagcggggattcacgaacactgctgttggcatgtcggcgtagaaacgtttccacggtgacgttcgtttccggaatcgtcgatgtccagttgcatctacgagcgttctctgacactgcagctgagccccctgactccctctcacgtctatccgcgtgcaaggagacagacacaccagtctgcatgcgcacataatacgtttcagcgcttccttagaacgcataaagaggtgaaggtacgagccgaagtacgagtgaaagacctaaatatccaagtgtgactcgtagaacacaacgaccgatgtggagtaagccagtgggacatccacactctgctcgatatcgagcaggacaagagtgagtgccattttttctgtcacacttgagcccgtgtgtgtgtgcaagtgattggatctacagcagaaactaacttgtcctgcagttcgatcacagagagacccactgagagccgtcgcatttccaggcccctttgtccctgcagatttcgtggaaagcacagagttcgcatgtctcgctgaacgttatcagctgacctgaaatcccgtgaattgtgactgatggctggcaggttcggtcgctggtgtcactatcctgtgcagagcacctggcattttcaacaaaactggttctgacggctgcgcgagacgcgagcgttctgctagctgtgcatgcctcgtctgcgtgtgacgttctgtcatttttttctagtcgcatcgcagggaagcctgaacctgaagtgcttgaagagggaggtatgacagcaaagaagcgaaggacataaattggaagggaaaccgcggaacgcggatgatggcctgaagtttgtccacggctggagaccgtacaagcgtttttccccggacagacaaggtgttgttccacagcggtgtgcgggagttcgcaatagagacggagtttcacctgtttagcttttaaaacggagtttgttcgatgcagaaggaatttctttcgcgcaaacgctttatcgcggccgtttccttgaatgttcgttcgtcgttttccccaaggaggcgaaaactctcgaaacctcggagcggctggttgctcggctgtccgtgcttctcgcgggtgtgagcagtcacgtccgcctcgtccggtttctcccgcttttctttccgcggattcttctgtcagttcacttcgccttccagacacgttttcgaaagactgttttctctccagttttcttccgtgcaatccgcgcattctctctcgctagcgaagcgtccagaccccctctacacctgccgcgccggcttctcgtcgcagtttcgtcgttgcgttcgcgcaccctcttcccccctttccagctctgtttcgtgggatacctttgtgcccttgtcttcttgaaactcttctttaaaccgcgccacactcccccgccgccacga

SEQ ID NO: 3604 - DNA, 2013 bp, Toxoplasma gondii
gagagtcaaggcttggctgattccaaagcagctacctgaatgatcttggtgaggcggtgaaggagttcgatgaggacggccggcgacggattctgctgagtcgtgaggacgaagtagagtccgcttctccgcagaaacgcaaaggtgatgccgttgacgcaaaacagtggcgaggcttcgccagcggcgccgagcccgccgcggttcatcatcgcgagcatgccctgggcggcggaggggatccctcgaggtgcgcatgtcgatgacttccccgagttccccgaggctccagcgccagagaactcggaggtcgcggcagaaggcacttgccagcaagtcacatgtctgtagaaaatctctgcggcgcccttgggagcgtcgttccggtagtccttcgtgatgagacagtccccccgcggggacaaaacgtagaactgagaaagcatcgggccacaatcgagcagacggggggcgagaagaaggagtggaagacgagaggtggagcagaaagagggtggacaactggagagacaacggggaagcagcagacgcgtgtcagggcagcgaagaacatgcgggagacaagcgagagacagagacgaaggcggccaggtgaaaggggccggtcgacgttagagacacaaggcgtctggggagagacactgctgacagggagagataggaaagaacggcggcctgtcagacaagaaacggagagtccgggggtgtcgagaacagtggaagaggaacgcgacgagatccacgaggacgcagaggaacggcgactcagaaaagagagaggcgcagacaccacagagaatggtaaagagactgtagtgactctaaacacgtgaaaagaaggaaatacaagtgactccgttggtcacacacacagaggtcacctcgtgaggacgaggcgcggagatattggtggtgttcggagacgaaaaaaacggaaacaaacgggagacgagacagaagcctcaccgtctgcagagaacaaaacaacttccataaaggaaaaccgacaaaatcgctcctcgaaaagtaaaacattccaaagtcgctgggacaggagagcctgcttttcaggacccctggagacacggcaaagccgcgcgcacgcaggttccgtttttcgttcgtctcctttttcgaaatgcgcgagtctacttgaaagcaattaccagctctgagcggtatcacctgtttgtgcgaagcctggcgactccaaccagcatttccctcgagcagtcattttctgggacacaccggtactttcctgcagatgtctgcagcaattgagggacttttcgcggcaggaaacgagacagagcgtccgtcgcgcggacgagaattgtcgcatagaagatgtgtggattccaatcaaagagaaaaacgagaacaaaactcgggagaaccagacgacaccgatgggagcatttggcgacgaggaagctacccgcgatcgatcgatcgagccgtgttccggtgtacatacacctgaggtccccgcgccttccccggaatgcagacaggtttctctttccctgtagagaagcaaacgtacaggagggaaaagagatttgtttcttgtctcgaaaacgtgaccatcactcctctacctcgtcttgctcagtcgcaggcgggcatgcacaacgtgtgctctcttttcgagcttctgcatctctctgtagcagtttgccgcatgcgcgcaactgctcgttgcttcctgggctttccgatcggatcctgcccttgacttcggcctgtggttctgacgtatttcggcagaaaaatcttccattcggtcttctgtttctccgtccgctcgccgttccacccttctcgccagttcgtggcttctgccgtcgtgtgactcgggcgccggagagacggacaagggcaggtgcgacagcgtctgtcaggtttcttccgttcttcttcgtggtttcctcagtgtcgtttccgccgcggtctcccgccccctccaacttgctattgtcgacgcga

SEQ ID NO: 3605 - DNA, 4505 bp, Toxoplasma gondii
tgtacatacacccggcgctccttccgttctcgcctaaaacgaattccctcggacgcgcttttcccccgttttttttcgtgcgtggtccttcttcccgcgctctctgtgtttctcccctgcacccctgcatgcttctttctcgctctccctttgtccttcgtctttctccgtcggtccatctttttcgccgcacctccgagcttcactctgaggttcttgcgcacgactttgttcaggcgaatctttccttcgtcgaggtcctggtcggccaggacgacgcagacggtgtcatgccgcatctttcccttcagaaggacggtgtctcctcggaagatctgcagctcctccatcttcgctgggttcagcgccacgacgctgttgtcgtcgttgatcgcctcctcgacgatcagccgattcggagaccgcttcttctgactctcctcctttttctccgccggaacggattgcggtctgcgaatgccgccggccatcttgtcttcgcagtcgaaagaagcagcgcgtctacgcaggccgagcgttgaagagcaggtcgcaaaaaagtcactggggagagaggcggcagcggagggggagaggcgggggcgcacagcgaaactctctcggctggtgagtcgtcgccaggtgtgaccagcagtacggagcaaggttagcggatggaagcagagagctccgaggatcccgcgggcgaagaaaagaggaaatcgcggggaacggtgtgaagaaaaaaggagagcgcggctgcaggagacaggggtcgtcgagagggaggcgcgaaaagagcgagaagtccgcagaggcaggacgcgcgaccgaggagaatgcaacggaaatgacgaggcgaacgccgcgtgcagaggagcgacaaggcagaaaaaaggcgagggaaacggaaacggtctctccagtgcaagaaaagaaaaaactggcaacgttttctgcagacaccgggaactgcagttcttgcgcgcacgctgcgccggtgtctcgacaccccaaaaaccgcgagcggagttctcaacgcgtccggcgcctcggcgcttgttcagacatttctcggcaagactgagaaccgcgatttcaacacagaaactctctggagacgcagaagaagcttccgacgcgccaagcctgcagctgcacttttcctgaaaaccgagtcgcggcgtccacggacaacaaacgcgcggtctctggggggtggtgttgcagtgtgcgcgagcgccgagcaagcgccgagcaagcgcgccggcgcctcttctcttccctcgtggacagccgcgctgcagatgtccggcttcggtggcaagtccttcttggctccagacgaaaaacgccagccctccagcgatctttcagttgcacttcagcctcatttcagttgcactccaggcgaggaggcatggcgaagagacggacttctctccgtctcggtgctctcggtgagagaggcaagaaggaagaggagaaggaggaggaggatttaggcgcgaaagagccaggaaggactcgcctgcctctgcgcgaggatacgccacacagacgacggaggaaacagaagatagacatttgcacagacacagagaaagagcgaactggaaggaagaaaaggcgcgccccagggacgcggcaatccggacaggagaaaacaggaagtaaacaacgaggagacgcgagagagagacaacctcggagaaccgcctcggcgctcagagggaacagacagaagattcgactgtacaagaacgcttgagaaagggacgaagtttagacaaaggagggaagcacgacgcgcagctggtttacgacagaggacacagaaaacgcgagagattacacacaaacggcagacgacctttgtcgcagccatgctcgtcttcgatgttgtccgcttgcttatatatgtgaatccttcgaggggagatgaagtagagagggaagagatctacagagccgttagtggttcaagacggtgaccttgtcgtttcaacaagcatatggacgacaatacaagcactgtactcccccgtagagttggaactgggacgaggcgtctcagctgccgaagtttctcctgtattacctgacagcaattcgcggtgtgtgtgtgtgtgtacagccggtacagttgtcgttcgaggaagttcgctgcatcgctgacatcagacgtttctcgttcgctgctctgtacgaaatgcgatgcatgttctgtcactacgggggtgtatttatagattcggaatggagaatgcggcatcatgtgagagagggggaactgtcttgtgtgtctccttctttccttcctgtgttctcgccgtcctgcatccttcatcgtcttttctccttctctctcttccagaatatcccttctctcctccgttattcgcctttgctcttgctcgttcctcctcaccttcttctctctttacctcttgtttcattcctccctctttcttccttctcacacgcgtatcgctttcttcctcgtctcattttcgctctgtctgccttttcgcgttctccttcctctcttctccacttggcagtctctctttctttctctctgtctttctctttcgttcttctttctttcgttccttcgcccgccgacctcttctttctgcgttgcagtatgctgcgtctttctcgcctccgtttgtccgttccaggacctgcgcgtctctcctcctcaggcagtgaaacgcgcctttctcgagtctcctgcttgcagtcttggcgggacttggggagacgacgtctggccacagaagccgcgaacgcttcttcgaatgccgagttgtctcgccttgtgcctctcgggcgcgcgttttttctccttcgctcgcttccgtggaaggaggcagtgacgctggaagcctccgcagagtccttcctttccacgcgacggctcttgctcctcgcgctaagaatccctcgcccagagaaggaggaaaaaaggacgcagagcgcgtacccctcggcgtcttccaggagaagaggagacagggaggggagggaaacacagagagagacgcgacacaaggacagaagagaagacagagaagagaaatagcaaaaaaagagaagaaagagagagaagaggaagaaagggggagggaagagaagcgaggaagatactcacgccgtacgtagctgagagacccgccacctgtcgtgttgaatttgatagagtgaaatgagaatagaaacttcgaagaatgaagagaatctgctttttcgttactcttgagtgtcactgttccactccttttccatcctgcgagagtccgcgagcgcaacggatttcctctctcgccgtcctaaagagccttttgctttctcaacgcgcggcagtcagtttcttttcctctgactgctcatatacgcacatcgaggagagaggcaccccggtggtttccctggttttcaggtgcaaacaagctcaccagatcactttttttcgttggtttcagttcccctctgcccggtcggcgcgtggagttcgactcttttctgcatccccccgattttgtgcagctctcaagtgtatgtggacgtacaacggcgtgtgagaaagagaaaacgccaaaagagagggagagggtctctgagcgaggctctcctgttgcgactgttgaaaagggagaggcgaagaaaagcctttcaggtcgagagagactcccagtgggccgggggggatggacagaccgacggtgacattgtctctctctttcttcctcatttcttgacttctattttcgaatttctcctccgttttccacgatcctttcttttctctctctgcagctgcgacgcgccatgtctttcttctctccctcggcccgttggtgtgcagttcttctggaacgcggcgtcggcgagaaacaaactttcgccgttttctgattcgcgggaagggcgccttcgttcttctttccggtcgcgaagtgcagccgttcctttctttcgacgtcctcctccgttcctctttttgcgccgcttcatgcgccgagaagagaggaggagatagaagagccgcgaggcaggccggcgggccgcctgggaagagttcttcttttcgacacaaggcctcctgcaactgacatggtttccaatctccagcggaaaagctgagctggattcaagacgcagagcaccaaccggctgaacacggcgtccgttcttttgaaaagaaggcggaactcgcgtttccacgcagagagaacgagctgagcatcgtgcttgttctctcgacaaagaggcctctcgctgttacgtcctctccgtcttccgcgtgtactccgaaattcttctccccttgtcttttctctcggtgtctctccacatctcgccgtccaatttccacctcagcgacgtcctcgaactctcgagcaggagcctgccgcgcttctttcctcgcgtcgctgcttcttcgtcggccttccctcgcgcaacgcgtacctctctcgacttttttcgctccacga

SEQ ID NO: 3606 - DNA, 2049 bp, Toxoplasma gondii
ttctcactgacggtgaagctctgcgttcaaagttcgaaacgtcctctgagacagactcgcctgacgaagagcagacagcgactcgatgatgagtggggacacaatggcggaaggagggggacatttttgggacgtcggcaaaaactcgacagcgatttcttttcttggcagaaagaaggggcctcagcgatcagagcaaagagaacaggtcctcccgagattgccagatggaaggcggctcttgtcgccaacgcagatccattcagagttcatctcttatggaagcgacaggcgtagggagaagagcgagtcttgtttcttacactgaaagtctccgaatttcgacactgtgatgatgggggcatggtcgaccgaggggaatgctgcggcaagggcgcggcgaaaggcctctttgacctgcacgttcagagcctgcaaaccgcaagaccggaaaaagaatgaattcaactcgcgtcgcttccacaccccaaactcctgacttcgtacggaacgtacggaagcgccgagagtcgcgcagcggacgcggagacgagaaggttgcgcgagagaaacgcgagagagaggggagacggggacgcggagaagaagacgagagaggaacgcgaaggggagcggcgaaaggactggaaaacatacctcgagagaaagagagagaagaggcacgcgacgggagagaggaaaacgacatcgggggggacaagacaggggcggagagtgagagagagaggagaaaacgaggaactcgaggaaggagactgactttgctttcactgtaaaaagacaaaacggaggcggataaaaggtgaaagagggaagtgagagacgcaggaaggagacacccagggaccacaggagagggagggagaagcgtcgaaaaagagagcaacgagagagtctcgcgtacctgcatcgtggcggacagaggagaagaagaagctttctgaaaagttcgagagtccacgaaaatcgggggaagaataaaaatcgacgcgcggcgtctgcaccctttcaagtgttctcgaaagtcggacgccgagggccagcgcgcgtttttggagaaaaaaagtctaaagaagttgcgaagaaactgggagcacccacgaggaaggcggagagaagcgcaagagaaggccgggaaagaaaaagagaagaaagcgttctgaacttgcgaaaaaatccgctcttctgcagtccgtccggagagaaaaacatctctcagatcgcttcccaccgcaggaaaagaaattcagctcccgtgaggtgacagtccacgatggcctttctggatctggaagactccgaacttcctgcatttggaaaccgttcctgaggaaaaaggcgcgaagcgcccttctctctcgacctgtgtgtcttgcagctccgccgcgcatgcaagaaaaaaccgtggggtgacactgcggcgccgcggagacagaagagacaaaacagaggagacagaagagatgagaagaagcaaggaaggcttcggtgttcatgcatctcctttttctgcttgcttcagcaatctcgcattccgcctctactcgctaggcgaacactgtgaacagcaacgcccgcgcagcgaacgaccttttctcgatgttttaaaaaagcgtcagggaacgcaacgcggtttatagtcgtaggaagggtagaaaaaaagcgagaaaaaaaaagtaaacctcgttgagtcgttgaaggcgcggatctccgagagagcaaacttcctctctttccttctgtcctctttccttcttttctctttctttctcttttttttcgcttcttatcttctccctttgcgtctcggttgtgcagctggtgtctcgcccagcttttctctttcgtcttcgctcctttcttcgagtcctacttcttctctcttccatccacggtgcaggcgtcgtcccttctttccacgctcatctttcttcttgcctcaaaagtctcctcttcctcatcgtccggttcttctctcctctcttttcttctctcttctctcctcccttttcttctctcttcttacca

SEQ ID NO: 3607 - DNA, 3067 bp, Toxoplasma gondii
ggttgtcgtggcaaaaggagagggcatctcgttgatgaaatgtggagtcatgcagttaaaggggttctgggggtggggacatgagacggtgactgatgggagtagaccgaagtctgagttcctggcttattcagccacacgttttagtttgcattccagtcaatcgtctctgcaatattcctacttctgggtagggaaaacctggcatcgggtcttacatgtggtgagtgtcgaaaaagggatgagaataaccgcttcgaaggctttccagcctcgatctgagagttttggattttaatgcatttttctcagcaataaagagctgcaatcatcctgtaaatggaaagctttggcgtgttactgcttccatgtgctatgtttatgtgtagttcggagctgggaacagcaaatacgtttctttgttctacgtcggtcgacctggtcaatgcctctgctccaatttctcaatttgtttcactaattttgccgggttcaggaagttgcattttacgggcgtggcgtttcggttagacgtagctgctgtgtacagctaccacacaaacgtcggcagctagtgcagttccctataatagtggtgactttactgtataaggggcgtacacaccaaatgggggagacacgtgccgaagagagccatatttccagtatctaaccctggtgtatgcatgatttccttatcgacatctgctgcggtgccacacgataaaagaacctagtatgactgacgaatttgtgccctgctgggggatgccgagaagtgaacacacggtgcctgctcaaaggaaggcctagagttcgcacgttctcttttgactttctcggaggtttagacagcgaaatagcaagcgtatttgctgtccaccacagtggtagagcatatgttaaccagcgaaaggcagatactttttgatataactgaaaccacatcccgctcaacgctacacacagaaatcttcaactttaccggataagttcggccttggcaaatttctggcgagggcgccagtagtcgcggattttgtggcaaaattgtttggccgactggttcgcagataccactagtggattctgccgctgaaggaaaggggtggcacctgaggcttctgaacaaagctcaagatacaagctcacattgactgttagtcggccatgtggcgttgttacacatgactttgcccctgcccgttcagtgcgtatttgttgatcaacatgaatttgcgtaaacatgagccagggacatctggcgatgtcgtgtagtacttatacgcattataggggtgtcagagctatgtcgcatgacagggaaaccgtgggaataccacgggcctatcatcggatcaaagcgccagcctcacatgcccttcagatacgttctatgccaacacgtgtaggcgtgttgtggctactacgagcgggggaaatccacgaggacaacgtgagccttgcagagcaggagccaaagtgctgggaccataatactgcaagttgccttgaaaagggggcggcaagtataacagtgacagttggatgccgactaattttattttcaccagcagcgaacatgtgatgacagtcgatgataaatttgcgggaaggatgccatggacggtacgatttggtatcatggactcgttattcccagaaacaggcagtacccgtcttgggttaaacttgtgggccgcttgtttacgttgctctgatccctctaatagcccactgctggcagctccttacggtagtggtcatagcgtgcaagtaacatttgtgcaggggtctctccttcgagttgttctttttttggtcacggttcctctggtacgtgcgctggaggctgaagcatctgtatgctgtgcaggcatcctttcccttgtgtcgcgttcacgtcatcagcgccacactgattgctgagagctgctgtccagcaaagtgtcgtttaaatgctgctccgtagttcccccagccttactgtcacaccgatgcgctgttgactggaacattaagcaaggtgagggttcgttgtcgtactcttttcttttcaaacagtatccgaatagtccatgtgacacaccacccgcacgtgttacgcgtgatcgatggcccttctcacaacgccttgtcatcttagtaaaatgccatataaaataaaggatccctacattgaagtcgcctgaaaaaccagagtgatgcatggacacccgcttgcggtaacattcttgcagcaggtccagcaacaacgactgacactgatgcagacacgcacacaggtgatatctcgttttttaatccctttattatattcgccagctgatggattctgcctgtttaccgcaccgttttgaaggatgcacctgctcgtaaccttgcgagcgcgtggtagttcctgtcatggactgacagtgtaagaccacacagaccctacgcagaccctgggacgattccatcatcagaaaagccgtgttcgaagttgagcgagggatcgtcactgttaaagcagaagactcgtccatcgaaagggagaacgaaattggatggtgtgtcgatcccaacacaattttcttttatttgcttttagaattagagcctggggctctcatttccagccccaccgttgtcagcactctttgttagcgtgcccggccgcatgcaggactgccgtttgaatgagacagtatgacacgtagaaaccgaatgtaagcttttgagggtgaatgaacccccccttgtatttacgatgctgtctgtggtagaaaaatctcagataaaccatcaacataccacgagatgttcgcgttcgcgtgtctgacaggcatctttacacacacaaatgtactggctgctaccttctgaacagagcatgttggctaccgtgccacatttttcttagaattctcaaaattttctgtttgaaaggggacgactgaggtgtgtcagaatgcggccagtgtccaagacccagctagtgtcggtcacagcatcggtcatgagcgggagcctgcgattcaaagcttcaagtttagtcgaagtgcgcatgttctgtaaccaataa

SEQ ID NO: 3608 - DNA, 1947 bp, Toxoplasma gondii
tctctagaaaccaagcaaatctcttgtgtcgcacctgtgcatgcgtagaagatcagcgacaaagccgagtccgaggccatatttctgcttcctgcagagcctcgcggatctctgcaacggatgttccgcgctgcttccccagggccgaaacgaggcgttaacgtggaagggaagaacgagtgtctagaaagaaagaaaacttcgtgtaataggacagacatcccaaaaacagtccagagagaaggagcgcgagacaaatatgctcttccatacagaacctcataaaggaattaacgttaatctaaatgaatatatacattataaatgaacatggacatctacatatatatgtatatatgtatatacttttatatgtttatattatctgagggaatttcagcgtacgtcagtcttgactgaggcagaagcggtataggacaccggcaagagaggaggagaggccaacgcttggaaggagtcgggggcgagagtctctcgggcattagagccatcaacctagtacttagtggagagattccattgtccaaccaatccccctacggatgtcaaccgcacagggacgcaaaaacctcctcatcgtctccttccttcctcataacgtttccttgtgtctctcagagggaggtttgaagccagcaaacatgcgcagtggttttcgacctgtcgttttttaaacagcctctccagtgtacgcacagagaatccacagtgtattgcctgaggctcttggcgcagccgccgcgatgcaggaaagaaaaagtaacttccgacggtctcgtctcgtctccgtccgactcggagatcctctcagagagcggatctgactgcgaccctcagtcacgctgcatgcatgcacactcagccatgcgcatatatgcttacatttgtacatgtctgtgtatgcaaaaggtttgggaagacggatgcggagctacacagagagaagacgccttctcagatcctagtctaaagccgacataccatcgaacgactgagggtgaacaactctgaggcaaagggaagggggggcttgaagacgagaaaaatgtgaggaaagaggagcgcgatccctcgaggcgaacgtacaaaaagcgagaggagtgaaaatggagaagaaaacagaagtctctctaccctgtctgctcgttcgttgccgcttggagacaccggagagacacgacggacgcgcatgcagctcccgcgtctgtgcatctgaggaaaggagaaggagcagagtcccaacagtgacttctcgacattcttcagctttgactagttcttgttttctccaccgaaatcccttggtcacagaaaaaaatccaggttagaagaggaaacgaggccggtggtcggacaccgtgacatctggtgcatgcgcagatgcgactgggcgctgtcgattgccggcgaggaaaacgcttttctttcgaagtgagctgtgaaggaagcagagaacaactttggacctgaaagaagaacgcaaacagtctggtgtaaaactcgaggagaaggcatttttcctccgaaaaaaacctgcgttgtgcggttcaccacggagagagagcgacggcgaagaaggctgcaagcaaagagaaggtcaacgaggacatgttgcctcttgacaatttctttttttcaatcctctgcagatatgcatgcgaagaaccttgaagatatgccttctttgtcctccgttttcctcgtctctgtcgactccccagttggaattggaaacgccgagaccccacaaaggcagagtagacagcagcgccggaacggccgaagagtttctgttccgactgcgacatcttgcgcgaccagaaagggaggaaaacagaggcctccgtctcggaggtgcaagcagagacgccatcgtgtctgaaactcgaagaacagtgaattctcgactctttacccttcggaaaa

SEQ ID NO: 3609 - DNA, 1772 bp, Toxoplasma gondii
gagcagctcatgcccatcatacaccagcaacctccaatctaatcctccttctcttggctacaatgccgatcaaaggaatttccaatggacaacaaagacggttttcttcaccatggccggcggactggactgtgaaaatctgtcgtgagctcccgcagcatgcgtaggacgggaagcagacaatcacacgaaaggaagcaagaaatgagttcagagaagtacggtatctcgcgagcattagttttatcttcggctccgtacccactcttctggacgggactgcgacaaaattactgctgtgtgcggaacggccatagaacactgatgtcgcaacactctctcaatcctcgcgaactcgtgcgctgccacgcagtctaaatctggcatttccaatctctacacttttcctcaccacaggtgtgactccaacactattcgcactcgataatacagtatcgattggtctatcttgagaagacatttgggaggggtaaatactgacccagctacacccaatacggacttgtacgttggaagtctcagaatgggtcttcgtgtgcatatgtagtgttccgcgagtgccagcgttccccttcggcaatcaacacttcttgttactcgagtgcccggatcgtggtggcagctcaagtgacgtcgctggtttgctgtaggctgtggttagtcacagaccataggaaattccgacatgaaactcctgttcctccgtatgggttccaaaatcgaacggtgccgctcaggacgatcctgggatcctacaagggacgcgaggtccaaagcaagtcttcgcacccaatcttccagctctaaataccctgcacttcttccctgcatgtctggggaaggaaattactttcagctcccgtttcgaaagcatttaccgtatgaggtttcagctgtagctacattgtttttctttcgctcctttcgttttgcctgtagatgacggaaagtttttctttcgatctatatgtgatgaagtaattcgtgcgtgaggggcacggcagctggcgtttttcgcacagcgggttgtcttgtgatttcttttcgcaaagaagccgaccagaaagtgggtcggtgggagggagagcgggcaaggcgcgtgatcacaggattgtgtgtctcctgggacagcagaggctcgggagtctaaactcttcactgcaagcaaggagaaaaatttactttttcgcgaacttcatgttgcttttgggctccagaagcaaggcagaattctggacggtctgcagcatgcatgggggttggcagcattcggcttccatccgtcacttgccgatccctgcacacttgcgaccgtactaggtgtgcgagacggttttcttcgctctttcttcttttgttggggaaataactcttgttgaacagaagacggttcctttttcgttttgggggaggcatttcgccctgcaccttcccgatttccgaaacacgctccctcaaaagtcttccccgagcggcttgttgccggatgctctaccccctggctctaactcccaagggcatgaggccgctttctttcgctctttctcctcaaacctctccccttccatgcacgtctttttacacattgatttctgaatttcttctcccggctgcctcccccaaatcaccacgcgctctcccggtggccagttccgtctcattgtgccccagcccacttcctgcggagtatcttctgtctgtaactttttctcacattaaggtttaaaccttagacacgacagtactcagca

SEQ ID NO: 3610 - DNA, 2722 bp, Toxoplasma gondii
gttcatgtcgaattcaggaggtagcaactggtgtctgagggagcaggatcggctgagtgtttgcgttttctgtagccgagacgcgtgcaagtttcttggttttgtgaagcgacccatatttcaatcttcttcgtctgtccgctatcaaatcaaactgaaggttgcttcagtagcgtcggggaaatatgaccgtaggtggactgctagacaggcatacctttctgcatgcgtcccgcgtcgctgagaatgtcattggttgcttcgctcgttttgcttgcctctgatcgtgtcccaggagtctggtgacacgacacaacaacctggcggtcctgacgatgccgctgaactcgacagacctttagagttttttgtaaaagaaggaaacagctctggcagtcgacgcccttatgagagagcgccagcttcaagaaagtgaagccgctacgcagagtatctaccatctaccctctatgatccccccgcatgcaaactagccttaaacacaccgctcgtcagtacaaaccgtgcaagcactacaagcattaattatgtctatttgtgcatctaaggtggtacttggttatatatgttgaacgctaactccccgactagactttgagctattaaacctgcctgggatcattcgagaagactctgatgacgtcgtcctaaaagtatctccagggcccaccggtggtttgtgagtctctatgtcatcaacatgtcaatgaagtattgatagcgatgaaggtttttgatcatcatagcagcataaaaaggctaagctgcaccttcagcatgttaacaaggcggcggcgataattgtatcccaagctcggttttaggttcgaatgcaccactgccgccacacggttttccatgtcagtacaatctccgcgaaagttggtgtaccataggtgaatattaaccctgcctggtcacgcaactgtcccaaaacttcgacttccgttgaaaggccatccaccgtaactctcggtgctcttgctgctggctgcagccacactcgtcgtgggggaagaaagttcactacaagcaaacagttttctttccgtaacgcgctcaccacaccctgaaaggtcttgatcgaagtggtgatgtgttcgacggcaacagtacgttccacacggctgcggtgatcgtctgtcctccatctagtggttctaccgccccagcagaggccgtctgttttctcgatttcggttttcgggcgctctgcttccttcttagatgcatgtcgaaacgctttcacaaacgaacctagtgacatgcgccctgtccggcaaatgcaagagaaaaacaaggcaggatttcgtgctatcagtcaagtcctccgtggccgtacgttagtatcacaagcgacgccgtcgtaaaactggtggatctaaagctctgctgcaccataagtctcacacccacggtttctaattccagcgcccaactcgcatttgtgaagacatgttgacttcttcgttatacacgcctctgagctgtcggcagtatgttaccgacttctgtatcggggtgtggcgcagcatagaagcccctacgatgttcgggacatgttcttcccaaagacttcggccggcgggcatacaagaagtattttatttactaaggccgcgaaacaactccaaaactgccgacagagtcggactcctgatcagttgccgttgctacaattcatgtctgcattcctccgacgctccgtaaaaagcacgggtgcatgcgatttccgcccggccgcgggttgcggtcttttggtgtcgatttttcgctggcgcgtttgggcaagaactgagaaattgattcaccggaattgtggctgcttatgactgagtgaacacttgataaaatttccacagtctcaaagtgacttttccgctgcggttcaccgccgaattctccgccagcgtctgcacgcaggaacgaactcggtactgcgcacccagtggtgccgttcttgctactctttgtgtttcctagtggctggtgcgccacgagcgttgtgtttttcttttctccggaaagatgggcgtctatcctccagtagctggcgggcctgtttactgggcgctccgcaacatgttcatcggagcccgccgctcatcccgtcgtctcatgcgcgtgtacgacatgaactgggacatctcgaaagttgtctgcaatggtgttccgcggaactcgtacaacccgagcgttaacgagtggatctggaacgtcgacacagatctgtggaatggcgcgggaggcaaggcctggttcgttctcagcgggcagatcatgttcacctttttctggtcgtttgccctgtacagcgttatcgagcgctggtacgtcaacggcaagatcgacactttcagtaagtggcaagaccgcgcgacagattaaagcgcacagactgagaaagcgtgactcgcggcagccattcgacgcggagaatggacccttctgaggatgttcatcgcgacaacacacttcccttgagtgcaggtttgcattcctcggaacctacgccgaaccgtccctctctcaggtcgccgacaacgctcatgttcatgtcctgaattacacagtcaatcgattccgcgatggttctgcgccgtttccgcgggtgtaggtgggcgagacgttgctccagctttcgagctgcgtgatcaagatggtgcctgccgagcgagttggcgcgtctggcaagcatcga

SEQ ID NO: 3611 - DNA, 4028 bp, Toxoplasma gondii
cccgaacggcttcgtcgagtttatgccgatgacagcctctgttgaccgttgaagcatttcggctaccttctgagaatacaatagcgcatccatccctgagtcacttgcggaactccgaataacactagccaagttctgtaatccggcaaaactaacgggtgtctccgcagtgtgataacccgtttggcgctgtccgtcacacagttcacgaatgtcctcccatgacacacctgcgaatgctgctgacattgcggactttgtcggtaattggctcctctgataggtcgtcggccctccttgggcaaaggaaaaaaccgcttcatccgaacaggggaaatggacttgcatgttctcgatattcttgctgggaaatacagagctggccacatgttggcaatctttcttcgataaccctccgttgcttccgcgtcgtacagccgctttactctggcctccaccgccacatttcgatgtctcgcttgatctgccctttccagagacgcacttttgcccggaagtgttcaactgaaccacagttatgccggggtagaaaacctggactggaaggaacgcatgcacaggaacgcgataagttatttcaccacttgactaactaacagcattgtatcagtgtgggcttctcctgcctgatggcttaccgtcaactcctttaaccacgcctagcctcagcttcgggggtttccgtctttctttcgtaccgtgtgccttccagcagtagtatacggcgcaccgggaagtttcgtgatcgtcgcattcttcggtctgcacacagagcagccagaaacaagttgcctcttggaaggttaacagtgacacattgacgcgggttctccctgcagtgagttaagtagaacaatgtgccagcttaccttatatagcaaagggtggtacacgatctcatctcgactgtgcgcaaacggacagttctgaccacgatggcacaggaccgctgtgatgtttccattggacaccacgaggttgctacacgcaactggcaagtagcgcagcagcgcccccgtacactggtggcgatcatcagatgaatttcgttgctgatgagctaccacagagaaaaacggcggccgccgggtccaaactgagctgtggcagtactggcagcggctggaggcaccacaaaacggcacaccaggtcaagtcacatgctcaggagtgggggcttgcatatttcaaatggtgccgtccctggagtgtctagaagcactagaccgctaagaaagagttcccgcttactctaggccgaagctgcacgagccctgggcgagacggagacatgcctttgttcggaagcgcagcaggtcatcctcggtaagcaaaggggggcacgccatagtgcacgaagattgttggagctgcaacaatcggcgtttgcgacgctcgtcactccagtctgaccggaactcctctcagtattctgttaattgccagatccgcctcccaggagagccagcacgtacgtaaagaactgaagctgtggccggtcggcatcacacctccaactggcaaaacggttggatggatgcacctcgcatccgcgattcgtttctgaactgtttgagcacaagaacacggaagacaaacgccacctgcagtccgctaaaattttgtccgttttcatttgtaaagagacaagaggatgtgcatcccttcactcatgtagcgtgcgggctgaagacacacaggacgcctacgagctagccgtatataggtacgtatcgaaaacaacagactgtcacgtgtggcatgttcttgttgtcatgctcatgccgagaacatctctggtgcgtggaacttacttttgagggcctcttgcctgagtcggtctcaatggcagtgtagcgtctcaacggaaccagtacggtaccgccctttacatcatagctaaccacgcggcctgccgccagaattaaccagacagccgagaaagtatacggtagatcataaaaatgtccagccggcatcccataggactccaaaaaccatacttccccgcaaaggcagctcccctcaatacttccagacactctacacactttgcaggtcaggcgacgaccacgtgcgcacacattctggagccggatgacgacagcgccctaaaccctaattacatagcccattggcgagcctaaacatctcgcgctggcacaaaaagttcccctcgccgcgagagcatcgtacagaaatgttctgttgacaatttgagtctagcgtggccctgtcagtgaccaaccttagtgtaggcgtctcaatggttgccgctaaaaggatggtgaccacggccagttttctgttcggcggtgcctgatgccgttggcacttgctggctgctcgaatcgcgtctctggcgctggcatcgcattgcagctttcctcaggactctaccgggcgccgtagagcttttaaccatggcgagtgtgttgagtgtgacccacaggctagtgagtccgtagcattaatatacttagccgcgttgctggtcaggccgtcagcaatccgcgacatccgtagacgccaccgagcgaaccgtttcttacagagtaactaccaaagaaggtaaatcctagttcgaattttcttggccacatcatcctgttggttaacaaagcaagggttgtgtggatgcagctaacagatggtccgcgtgcatgcggtatttggcctacaagagcagcagaacacgtgggttaccagtgcttcggtccgaactagcagtgatagttgattcgagcgtgcggagagctgcgctaacagaatggcctacggtgaacaccgaagcacacgaaactacctccaggcgtcaagatctgccacagcgagcgttttagagtacgccatcatccacgccggttaacgttgactccacatttcccccacgataacccagattaatgcagacgacctgtacgcatggttagcgtagacgcgagatctagacctcattcgactaatacactgtttccaaagagtgaagggagctgtccattggatcaattagcgctggtatcacttgtaaatgagctcgtcaaataagcatcgcacgcttctcaggcacttggcacttccctgtgcgagggatagagcggggtgggcgggcatgaatgtggtttccttgtgtggcaggggaataaggataagaattatgaacgtagctttggattatacaaggctcctcctcgcctgctttgttgcggagatagccgtggacacgacacaaaggctgcaccttgtataccccgtcgtcactgaatttatttataactcgcggggatatcactgaatatctggagatgttcctttatgtcggttctttgtctcgctactgtgttcgccaggatgtaacccggaattcgatgaatttttactaagcaaaatcctacggctacgtggcttcagtgttagcacgagggagccgtggtactggggtaccggcaaagctgcacggaatagggctgcagccagcatttcgcctacagcacagcgcgctcggagatggggctgggtaatatcatagggaaccatagtttgtttttctcgtgaaaactttcggaaattacgaacaagtagcactgtacgaccaagactcgtactgaatgttttcgctgtatctctccgccgcattattcaccttcggaggcatgcgcatgtactggtgtcgatgagacaagagtccggcagccgaattagtttgcactgaagaatctatatgccatttgccattattcctgcgcatagctataacgggggatgactcgttattggcggcagtgttacttcgtttggggaataccatcgccgcacgattctttatttttgcctgctctgctggttcgtcttctgtggttcagtgtgtctcatatgcctcttccccatcttgttggggtgacaccaccagcttgtaccgtcaccgcttagtcactcgatttacgctttgttctttcataggaaaaggagacgttggtgacgtttcccggtgttatttttggcagcca

SEQ ID NO: 3612 - DNA, 1566 bp, Toxoplasma gondii
aagaagagaaggttattcctccaatcacatgtcgcgctttggtaggaagagacatgtaaagaccgtgggtagtgaaagcagcgaatccgataatatatattggcgagcactttggctttttgtagtcactgtattcaacatggaatacaacgtgcggagaaaagctttttttcgcgccacttctgcttctgccgtccaaaggattcacgtctccgtgtagatctacaaaggaatcctaggctttcaagtcgctatgccagaactgagtgaacctacgggaaaactccgatttctatccttacctgaagcgaaagtacttcaagaggtgcttccggcagatatggatcagtgcctctcgactaggaagttcgttgcagtacattgcaatggtaatcatttggtggcgacatcctgtggcttccgggaaaggcactcctgccaggttgctactcgggaaggacatacgccggggaagcgccgagacagaaggcacatcctgacggaattcgtcttcggagtccacgttgcttcccccgtcatcgctcaatacctgaaaaagaagcaactaaacaaagaaatgccagactgatgatgcagatgaagcccatttctgctgaagaaatccagagccgtcttcacccctgacgcctgagggaaaaaaccgtacggagacggccacaaaacggcgaagaagaagaagtcatcacgccgtagcggcagtccaaattctcttgcttctgcacgcaatacaggcataggtttcgctagcggacaaccaaacttcctcgcagttgccgaccaggtgttcgggtgtccgtgcagtcgaaacgagtgaaaatctctcgaaacgctgcaggtcaccaggacaataaagattgagtgactcaagttgaagccattttcctgggttgtctacggtttggacttctcattgtacccgagccagttcaggagtgaccatgtttgtcgtatcaaggcgctgtgagaccaggcattctagcaacggcacccttgcgctatcgtcacgcttttcttacagagtcatcatcagcgctggcatcatcgacacagttcgtggtccgcgaggttcgtttcctccgcttgaagagtgagcagaaaagccagaatgtgaagaggacggagtggtaagtaaatacaaccaaaatgatgatgctatccaaaatgtacaggaacaattcggtggtcggtcgaaaaagtgcgatggagaagagccggcgcagaaacgtcagaaacacaaacgacgtcgacgcctccctcttcgagggttcacagagcgacgatttctcgagagccattttggagaagcgacggagagtaggccgtcgacaacgaatttcgtcctttcttccctgaagcggcgtatcccatcacaaagaaagaaccactcaggcaggttgtgtcggctgcgaaggctgcacctgatcgccgtaagatggcacagaggcgagtcacttcacggcgcctgtgtacacagtctcgtacaacgccactacagtcctttctggtagacggctccagtacgcaagaaggaataagggatccaga

SEQ ID NO: 3613 - DNA, 3163 bp, Toxoplasma gondii
ttcagttttcagcgccacccgtgatgcttcttccacaccaaatatatttatatatttatatatatatatatatgtgaatgttgattttcagtaaggaattgtgaattatggggtcttgttgatagggcttgacgccgcacgagacggactgcgttcttctcccgcatatattgctgtcacgtagcggagaagtttccagagaatcggaggatgttgaatagatgaactgcataaacacagtcggtgaaagctcattttgtattatttccatggtggttttgtaatttgtctgctttgtctgtcacctgcagctacacgtacaccaatgtcttcgataggattactgtttaaggtgggggtggattgtaaggcctctgccagatgcccagaagaggggtgtcgtacgtttcatgtgcgtccggtttcgcacacaagtcgggcacaaacggttttttttctcgcgtgcacgagagacaattcaaaggtgttcggtcggataagaccgcatatctaattctctgaacttgctgccgaataccattgctccaactgcctggaagccaacccgatatggatacagagaccatccggttctgatagaagctcttcttttcgttcaccggtcactctccttttagagattggaatcgtacctccggtttcactgggcaagagaaaatcagtgaataggtgccagtgtgatcagtaccaatgtactgagagtgagcatctctgagacaggatagtagtcggttggtccgcagacaaattctaagaaggtcgttggaaaaagacgcgtgtttctctggcaaacttcatgttcggctgcggtcagaattgccggtctcacatttgggttcacaatcgattagtggaggcaagttccctgccttgtcgtcgctaaaaaccaattgcaggtcatttgtatcgcatgggcttcctccaagcgacatgtgttctcgctggcaattcatacgatttgacgaacaaacagcgaggttcagatgattcggttcgggagtctatgttccttgcggctacgccgtcacgaacgttctgtttcaacagagcaaatgtttgccttctccattaaagggaggggctgcagcggaagttttcctgcagaacattgcctgtgccccgccaaaaaaccgaactgcttttcaaaatgaatcatgcaattgctcgctgaaatgtatacctgcagtacatctctgacacatgcagcaacaacagcgatgtagacaaaccggacacgaaactgcacgcgatttgtctcagagagagcggtgaagcgaaaacctccttttgcagagagagacttccatgcctgattttcgtgtgattctcatgtgaaaggcagaagcgtgttggacaggtcggcacggtgtcctgcatctcttgctgcagtgtcacctgcacctcttggcaggttgcaaaggtggcagatgcaagacgactaattcttttctatttggaaaagtgcctttgaaagattcgttcgaggccacaatattgctggagagttcactactccgtgatacgtcatataggcatgagtgttaggttgaaatgtccgaaaggcgaaattctacggcagacagtggcgcgtctttcaacacatgtgagggagatttgaattcacataaagaaaattgtgttgaggcgtagacgacttgaatagaagcgatgaaggaaaagctgaaaaaaagggtcgttgtagcgcttgggtcgatcattcagcctcaagagcccctgtgtcgaccagaatatgtggtaggcgaaaacgagggtggctggccgttacggccgaaatcgtgaaactgcttcatttggacgcacaagaaggaccgggtccagccagcatagttaattcattcacatatgtacaacaatagagcagaagaaccaccgtttccggtttaccgaatcgtgtgttgtgtgtctgtcgatctatcaaatccgtggttgtcagcgagagcagctcgccatcctgaatttaagtttcgtgagaattccgtcttaactgacttctaagcggttgtctgtcatccatttggtcttcgtaggtgatttttgtgccgggcaagaggaacacaacgcgttgaaatataccacggtcttgggggtcacaaaaaaggttgggtcctttcccgatcatgcatttccttcggtgacttaaagcacacacattggaaggtcatttgagtcactttcagcgcatcgtacagacagcagagcaaaggccattttggttcaacgaaacgtaggaatcgaggttacgccaaacacagacagtccgtgcttcgcctaaacgatcatgttttccgtatatgctttgttcaaaaacgcatgtattgctcaagctttttggttacacgcttgcttcgtgtcagacgtggttttagtttccgagacttcaatgtaatcactgcactgtaattctcgggaaagtgtctaaatacgggatgcctggacctgtactgtgggaagagactgccagtggcacaacagcgcagctgaagcatggagagagacagtcagagagccgtttgcttcgtttgcttgatatctccgtcgagtgtctctcgtcgtaaacgtggagtttcagaggcctatatatcaatggaccaacaaaaaaacgttcgttctcgattgttgttgtacaacctgtacaccatcagaaacacccttgcccccttctaccacagtgttcccggtcgtttccaagttagagtgttgtgctgtccctttgtgcgcctcattcctgtttctccatctcctggaaaaaggattctccttctcgtcgtttgacttcccctcccctacggtgtcgttttttcagcgttggctgtcgtggagcaggagcaaggtcgaaaggcatttgcaataccatcgaagctgcggctgtaactcgctctggtttgcttggtgtgctccggagcctttgtttttcagtgtcatgtctgtcctgcgtgcacagcttgtaacttaccgagttgcgggagggacatgtgcttcttttgtgtcctcaggcattcgttttagtggttttgaaacctggaaagaaggagtaacacgttcattcgatccagagtatagggtccgtgatattccgatccaatgattacacagacacccgccagaggcggcaatcgttcaa

SEQ ID NO: 3614 - DNA, 2885 bp, Toxoplasma gondii
aagaaacagcgagacgatgtcttcttttctttccgatgctgaacacaaaccgtgccgtctgcgccggtgttgcgcatctgcgcatgttcatttgcaaatttgtgtctgtacactcacactcacatctctgtgtgtttctttctcggcgcgtatgcatgacggaccagtccgacgcgaactctgctcagttctctcggctgtatctccaacttgatctgctgtccccactcggccttcacctgtcgatacgtgacccgcggaatctgacggggtgtctcttcctcgcatgtcgttgtgtgtctgcgcccgcatcatgtgtgtatatgcaaataggtagtccgatacacacacatataaacatgtacacaaacatatatatacatacatatatttatatatatatatatatgtatatgtctatatcggctcgagttccctagctgtgttccggcttttggtgggcgctatcggtgcaaccgctgtgttctccagttcttcgcgtctatgttgcacgggtgcctttgtagtctatgcgctcgcccgtcggctgcccatcctctcgctgtgtggttgtttgcctcttcttctgccgtctccatcgtctcgtctctagtccggctcctctgtattctcacccaatgcacaccgttatcctgttttcctcgagtgttgccgttaccgccgcttctgtcccttgggtgtctccccccacggtcgtcgccttttcctcctcgtttcttccctcagtatttagttgtcttgcttcagtttccctttcatgctctcccctgtccttcggcatctctgccttcgcgagcaatgaatgcctgagacgtcgtgttggtcgttactgcagaatccaggtcagccctctccatttctcgtcgtcacgtttttcgacgaactggggaccgagaagaatctcagtttggtccaggctgacattctcaggggtgagtgtctctcgaaggcagagggcggccacttgctgagtcttctgctgctcttctactcggacccgaatctgtcgagatgggtgttggagttcaatctgaagcctcgcgagttctcctttgacgttttccaggaagaacaacgtcggtggtttaacttcccgctgcaaacgcctccccgtctccagctctccggggagtgaggcagtgttttcattgcatttggggggtcacagggggtggtcttcgcaggaagcttcccctgtctcgtgggagaagccgatcagcctaaacacccacacagtcacctctccactgacagcttttcgcatcttgaagcgcgcctaagtgtgtctttgaactgctaactcgaccgaagtttactttccctcctacaaacactttgtgtccacgccccaaaaaggtgacacaaactcggtttccacctcttaaccgaccgcacgggaacgggaggttctgtcagaaatcttctcgtctgtagcgttccccagctttgcgctagaggcactccattcggcacgcattcgagcggtctgaacagagagcggtcagaacagagagcggtcagatcgggggttgagacaaaacggagaatgaatgccacctgcgttggtcactgtagaatcgcactttagcatttacaccgcacactcgagttgggttctctcgacttttcttccagtctggctgctacaatgattagggcgggcgcttttcgctgattgctccaccgttcagttgcggtactggccaggcgctcagcggcagcccgtgttgaaagcagcatgtgtgctgttccttcgacgatcggcgtttgaaaaacgcgtgccatcaaaccgaagccgccaaagaagagacctcaccgtagtcgaactcgaagtgtctactccgcaaaaagagggagtttacagataccatggaatcgcgttttagctgtccagccagccccgtagtcactacgtctgctccgtggtcgtccggcgagacgcactgcgatcgagaactccgcgttgctcgagcgggcgacacacaatctggatgcgacgagtatggagttttcggatgtctgtcgctctgtactttcgttatttcggtgcagaaattgcctttctggcgcttgctctttcgagatgtcaacgcacactctgaccgttccccgtagtctcctgtgggttggtctggtctgtcttgcggtctgtactccgcggtgcaccctcttaggctgtagccccgacgaccccgtctggtcaattccgttggcgtgtcacgaggtcgtttccattttgaactgcctgcatagtccacgatagtccccgccgccagtgacaacggacgttttgcggccgcggcctcaggaaaaggcgagccgaagcaaatgtggggcggacagtcactggccagggtaacggcggccaaactgagagagtcttgaccttccgatgtcagctccagtgggttgcgctgggaggggttcgcagcactgaacttccggtcagtgtcgacaggaggcgtgaaggttgtaagtactctccacttcgtccctctgatacgtcctacgacagggtcagactgagtttctggggtgctacagtgttgttccgagacacccagatcgtctcgcctaggtgaactgaccacgtttcacaactacagtctgtgacagcttgtttgatttccatgaacagagttttgccgtgttcagtgccgtgtaacggatgtgctctgaaggaaagtagctcgagttttccagccgctcaggtgcccggtttgctttgtcgccgtgtttttccgtggtggtgtgccgccagagtgtgcgcgtgtcgtctgcctcaagcgcaggcgcgccactggttagatgacgagcggggcttttgtagcgtgtgtcgagttccagatttggacacagcagca

SEQ ID NO: 3615 - DNA, 1908 bp, Toxoplasma gondii
aactcccaggtgcagcacacagatcgacagctctcacaggatacacatcttcttcttctccttcttctccttcttcttctccttcttcttctctttcttcctcttctctctcttcttcttcgcaacacagagactccgcgttttttctagaagcctttccgtctccgcagtttcgagtctctctctcttctgtctcttcttcgattagagaagatgttccgtttgcgtttcttccttctctgcggcgtcgggagagagaaggaggggagagaaagtgaagttcgtcgtcgagctgcaggagcttgtaggcagatcgcgcccggtagccctcttctttcgctcgtctgtagtaaatgtctctcctgtctttggacaacttccccattttctctgaatcgaaaaacgagaacgttcctcgaaggcaatcgagcaaaaaaccagtccagagagaacataaacctgtgaggaaaagactcgtggcaaaaagacagtcctgaaaaaagagatctgagaaaactctcaaaacaatcgctgcacaccctctcgcgcggcgtgcatcggctaatgtacggagaagaacgcaagatggggtacggcgaaagagggagagacactgagagtgttcactttttttaaagaggaaaacgaacagagacagaaacagagacaggccgcgcacagagagagaccgactcacgttaatagaagtccattagttcctacctttacatgtctgtattctcattcgttccaacagtagacctgtataggctaaatatattcgtcacgaatacacgtatgcaactacatacatacttcggtagacaaggtatagaaatagatatctgtggcggttcggcttggggaatacggagggagacatgggagattttctactcaggtgagagcccctcgggcatgcagaagcagactgggaatttgagaagttcgcagaagcgagaaaggaagaacgaaggagagaaacagaatcacaagtaagagacagtgcataccgcaaagaggccctgcgccgtctccgtgaggtgtatatacagcgtacaagcggcaactgtctccacgacaggtgccagcgagatacgcaaaaaaggaatacgagaaaacagttttctcttttgagaaatagtttcatgttgaggctttgaaaaaaatcgttcctcccctcacagtgcatgcaagagtgtcacgaattttcttgcatgcaggaatgtcacgactctttttcctgaggagagagaatcaagtcgcgaaacgtttctttacaaaaaaatgcaggggaacacacgccgtatttctagcgtttttctaatttatctcaaacgagttttctctgaaaagcatctctgagtgcctgcagacggcgagcgagcttacttcctctctgggtgtctgtacacactcgccagcagcctctgcaacttctgtgcaggacgagaaaagcgcgaaagagtatccttctgtcgctgtcttctgatattctttgtgtgactcaggcggtgtctgttttccttgcctccgtttctcgacgcaccaaggtctgcgctacctctctgcgccgggtgtctctctgctctcctcgagactcgacgatcgtctcggctgcacttcttccctcttgtttccgtatgttcttcttcgttcagctcctctttctcggttcttctcgcttgcttcttggccctccgttcctcttcttcaaagccttctcgtccccgttcgtccgcatcgcctctgcagggaagggaacgcctcttttttgctctcctacactggaaaacgacgacgggagtgaagggacttttctctgaggacggagatcccatcgctcccgcagcaagatggcgcagacgcagtaattccagagagaaaaatctttgctgtttccagaga

SEQ ID NO: 3616 - DNA, 3017 bp, Toxoplasma gondii
tttggccttccacctcagtctgaaggatttggagcagggacaccatgcgctgggcgttccagtggctttcctccgcaagcgccgggtcggggaagaggcccccctcgaggtcgaggaggccaccccgcagggggccggcgaccggaaggaaggggaccggcgggggataggggccgcggcgtggctgaagaagagggaagcgggagaggaagaaggtagaccggtgtccggggtcttcggaggtttcagagagtcgcttgaaggaaagaggcgctttgaggaaaggccaggctgggttgctcgttgtgagcgcttccgaggacgtgaagggttcaagggcgtactgcgcgcaccccgggagaggcacactgggaactgcagtttccttcagagatttttcaagacagtggtagaggcaagcgctgtggctgccaacagtgtgggaacgttattcgtaatcgagaacggatgactttttatcaaatctgcgttttccactttcgttcggtcccatcggagttttctcagcgaaatgaggaacatggagagtcgggagctcgtgtgttggttcagttttcccgtgttggttgtctgtgatggagcggctcggggacccacgatacgcgccacttgaggtagtctatcgatctacgtaaaggttcactcatagaggattttggcaaaacttctttgcctcttgcatgcaagcgagggacaacaagcatgcacttacagggcggtcctgctaggccgtgaccacacttcccacttgttgctggctttcagcgcttgagatggaaatagactccggagacatgagagcgtggcgcgcgcggcaccggttgaaatctaaaatggagaaacacgccggtgggatccggctatagagggagttttgtctgaggattcgtgttggcggccgttaagctacgcgaaacaaacttggttttccctggccgatgtgcagttcgttcgaaaccgctagaactgtcccgctgcaacacagcggtgcaagtttttaggtaccggagagcaggccgcgtcgatgggggctcctcaaaaattcctaacctggagcgagactgtggaattgcggcaattaccacaggagtgttaaaatgttcagcgctatattctatgcactgacgatcgcaagcggaggtaggtcgcgtaaaaaggggaatgtttttttgagggcacctatgtagcgttttacgtggaagagttggcaaacaaaataacactgtgctcggacgattataaaattcgttccaacgcttctcgtgaacaggcgcccagctcgagtgcatgaaacactcgcattcttgcctccgttgacttcttggaaacggcagactttccgagtgacctccgtgccgacgcatccgatgctagaatcgtgaagttcagcaccatcaccagtggcaccatttttttacagcgcgatcaattttatcagtctgacccgtcatgcacgtcagtttgcttccaaatcatccaagagacaaacatgttaacataatctaaaacatactcagagaatcttatccactccatcaaagccccctcgatatgaaaatgcgcttcacccaccttacagaaacaacacttccgcaagtgaatgcgtacatgttttgcacgaggtgtaattgcggtataaatgtgaatttgtagcgagtcggtgggcaacaacggcgaaatgtaatggaaacatgtgtgtactcgcacgaccgagaccgggagacccctcacggccacctgaggtcctgggccacttgaaaaacggtatgcaagtgactagaaagagcgagtcttatgtctaaatactcggattttaagaccttattttgcgtttatatcctgctcgaaagagtcgtatagctggcagttcgataggactccgctagtggtactgaaagatggataactcttggctgttgagcacaatcgagcgtcgcgcggccggccaaacgaggtagcttctttgtagtgaccttaacgtcgctcctcagtctggttgggaagaatagcgccgtagaacccgcttgaagacggtgtctccatgtgctagcctactacaagaaattgttgtagagcttcttttatccttactaactgcagattgtttgcagcaggagcgatcggtgttcagtatcagccccagcgcatgcgatctcccgagtgtatgcaatttgaggggtgctcagttgagactcgcgcgatcccctttgcttgcaggacgaaaagcaacatttcctctgtggacagttttttacaacatttcatcgaacaatttgacgggtctgattctggcgattaactggaacaatgatgatcgaaccacagaactctggacagttacgggtacccactacgcgccctgctttctttccgaggctctgaatttcctgtgcggacggtgtgttcgctgtcttctcaactgcaacgttgaggcgacagtccacccgttttcgatttcttgtttctccatcacgtttcttcttgttgacgatgcttccatgtgtgaacttgacccgctccgtggcgaaacttgagctgaaatgggggtcgatcctgagaaagcttccaacagccacactgtcacgtacttccgttcgctttgtacagtggctgcaggcagctctcttctccccttctagaaatagacacgcgcgacccagcagctgctttcgtcgagtgaatcgtactttttgctttccagccaggtctaggcagtggcatggagaatctcttttttcatttagattggttcccggtttgtcgttgacaccgccggtcagttgctgcagatcgtggagtgccaaagcgcaattccctacctttttctcgccggaaataggaggcatgagtccgacagcagtctcctgtctcactgtggcttgtggccggtgtgcgctgttgtctacctgattgaaacgggcgcgacgagagacaacttcatctggattcacaggcgattcacaacctcgcctggccgtgttttacattcatcagta

SEQ ID NO: 3617 - DNA, 921 bp, Toxoplasma gondii
gatgagcagcagttcacgaaaatttcactgtttttctgcatctggtgaaaacgagttcatgacagccgcgattctgacatcgaaaataatgactgttcctcgtgcctcgactccataaaatcgacagctgcgcggggtcgaagcaggttccaaggattactaagtagcagcgtcttaaccgttttaactgaagcagtggcacaaggatgcgtgtgtaccagcctccgccagtcccatgttgtggaccagtacgcagatcactggtcactcgagaaagtcgtggcatcgaccaaagctgtgaccagacaatcgtcctcacagcaggtcgcccagcttctgatgtaccccagcaggtattttcactggttcttcaaattgttgtgtttgaccactggagtgctgaagcccgttaatacgcaagacaaactcccacgcacctgcaggcgtgttttgcaccggaaattaagtatgaagcttcagctgaaagctgtatgttggtggcgtactaaatcacgacactggttgccgccctcttatgtggaagcgctgtgaacgaagggtctcagctgctcttgtacaggtcagagacacaaaggcggatcatcgcaagcacaggatgactgccccaagtataagcaagcagtgcaacaccaaattactcatcgcagcattcacagacgagtggatatttttggatatgggccgcttcagtgaaattgtgactggacgtttgcccggattttacagtcacgggccaacgggctccggagtgtacatccactggtaggaaacaccatgggaaactgagggcgagccaattcgttgactgcggaactgtctgataaccgggcaggacgagctgcttttaaggctgctgaactcctctaacactgcttttcacgtggaaaagttacgcttgaa

SEQ ID NO: 3618 - DNA, 1853 bp, Toxoplasma gondii
tccttcttcgtttcctgcttctcctcctttctcgcttctccctgattctctgcgtgaagacgtctttcggcgacgacgcgacccggaggggagaagtgcgagcgattgcgtctgatgtttgcgaggaactcttcagcggacgtcgagaggtttccagggaaacgaacggagtcgaagagatccctcatgagcgcaccgtggacagccgcagggtcgcgcgccttcggagagatgacgccttggacgcggatgtatgtatcgaaggtatcgggcgcgaagaagatgtcgatggacaactcgtcgaagccggagaccgtctcgctctctttgaagaagtgatggcagaacagcggggagaatgcgagatgctccggaggagaaaagaagtccgagtccgcgaagaccgggtggaaacgcaccacctggagcgcgttcatggacggcaaagtcgccccctgcggagacaccgagtctccgtgacccgtcggcgagggaggagacagagggcgcggagacacgccagacgaggcctcccgtggcatgctggagagcaggcgagaacaggcgaagaaaaccgagagcggcactcgacgcacccaaggtggacagattctcgtcggggaaagaaggaaaatgtagagaaacagaaagaggaaaaaccagagagagaggaaagagaggagaggagagagaggagagagaggaaaaaccggagagaggggagagaagaggaaggaaattggagaaaagggtgggacaaggaggcagaagcgtggaagatgaacgtgtgaaacagcactgaagaaggagaagagccttaaagagaaacgacagagaagaccatcgtaaaagttgaggcagggatccgagagcagaaaggggaacgggagcccagaaggccgcaccgagggtcggaaactgcgtgacgttccaaatggtcgagaatttcaacctgttctttctttgcgctctggttcgcctctttcgagtgcctggacattcgagagagcgaagcaaatgaacaagaaagaagacacacacaccgagacagcgtgtacccggtgtcgggagcggtgcaagttctcacgcgcgggatccctgctttctgagagaggcgggagacgctccgagaacacaaaggaatacaaggagacgaagaggaaagagacaccggaaaagaacaggaacggtctcgtccctccggcgctcccaacgcgctgtcttcatgtgtctccctctgcatgcacccacctgcgaagaagctgcgtacgcgccgtgtatcgacacccgcactgtcgaactttttccgccgaaggcgcagcgacaggaaaggcaactgtctgtgagcagtgtcttggacttgacgtcttgcaaggaaacggagggaaaaaaagagtcgcaggcgcatgctctcctgtcggggggtcggcggctctctcgtcgttcatcgcgcgcgggctctagagagacacggtttgaagcctcacccgagcaagaaaagagagacacgaggaccaggaacgaggaggaagctttttgcgtccttggttctcggcgtcgtgtcaacttcctgagtttcccgcctcagtccgtggttgagcgatctgcggagacaccgcaggaagaaccgcatatcctcgctttccccttccacatgcgctccgtgtctctgtttcgagtccaagcgctctgcgcagctctttgagtgtttgcgccacgaaacatccgaagagactcgcgacttggtggacttggtcgtctctcctctgccgcgcttcgtcttctcgccgaggcgaaggcgggaagtgcatgcactgtgtcaagacaggctcttcctcgccgttgagaaaaaa

SEQ ID NO: 3619 - DNA, 4635 bp, Toxoplasma gondii
tcaaatgccctgtcaacctgtcctctatagtttcacaaccgtttccgtcgtgatccgtttctggtaggtttgaactgtacacatgtcgcgagttttggtctgccgtttcctcgacaaattttccgaatccattcatgtcggggactccgttttctgagggctctaactccaccgtgttctttccttcctcggtcccgcgttcgctcaccacagacactttaggttcgacacctgcaactacacagcctgggtttttcgcctctgtggtggcgccttcacacactgtccatgactgctggcagcacgcttggttttcggggggagtcggcccaaattcccctgactctgcaaatgccccacttgtttcaatagatgtctcaccacagacctcttttccttgaatcgaaatgtttgtcggttcgcccactgcaagttctgttaccgcttctatcttctgaaacatttgtttcacgtcgtcccccacgggcttcgcgcctcctccctcttccccgatgtcgccaacgaaaccgactctcccgtcggtgtcgatttctgggctttcaatctgttcggtttctccagcacttcttgcttcgagcgtatgcgggacagcaggtacgctctcgctgcggaaatgtctgctttcttggtcgagacctgtcgagtcgtcaatttccagagatgttccctgttccttcacgcccgctgcttgagaaacgagcgcaggaaatcgacctatgagctcggccttcctcgtttcagcttctgaagtttgtccacatacagtttcatgttgttccttttcagtcgcagggaacagtgacttcagcgtctgagcttcttccaggatgtgcacgaacacctgcagttgccacgccaaatgaacgtgcacgtttcgctgctttcgttttctgcaccagaacagatccaccacgcctctcggacttagcggtgaactcgccgctcccgtcacatccgtttcccttcctggcgattttccagcgtttgatttcctcacgccctgagggtcgtctgcctgctgtcgaacgaaatgtctcagacgagagtcgcgggaaagcgactctctggtttcgttgccctttgtgtttttcaaagaaaatccgagagggaacgatgagagcgatccgatgctgcgggcggccgtccatgacgcggtgtgactgctcaggtttcgctgtccctgtcgcattcgagtttcctcgtgacaaaagagcagcaacggccatttctttttcgcgctcccgtgacttgctttcatactgtctcgaaggcgccacacaaacgagaacgaactgttcattcggcgctgcacaagcgcacccgtcagactaatgccgtcagacgcagggacgtcagagaagtctgtaaacagtccacggtggctccggaaggcacacaacggggaactgagtgcgggaggcattgcggctacgagagtcagacacaaagcctaaaagcagaacttgtgccggagaacgaagccacagcagtaacgacacgccgtggaagattcagttgtttctgtcccttcgaagagcccaaggagctaaaccaaagtggaaacgcgaggcagccgcttgagaacgcacgacagaagctgagcaatgcgccgtcatcgtttacggaagccactgtagcgaaagttccactgcacattggaacgctgcagacgctaacagacgacgctgacgcccgccttcacagtaagacagtctttctttaccttataacaatcctgtcgaactccggagcgtccgcatctctctcgaaaacgcacactgcactggctgtctgacacagacagtcgatttccaaaagtgaataacgcaaaatgtcgacacacgggagcggcgacgagatccataggtcgaaggcaaatgttcaaaacgcacacaatctcagaaaaaccaacagatgggaaaggatgcacggtagacatgcaatcatcaccacctcaaaaacttcagcgacctcctaccagcaaatcaacgaggaagttagctgggttcgctggaaagcgacgagtcgctcgagcacacagatagtaagacgcaacaatctgttcagcagctttatctagaataagtgagaaaacgaagactaatttgaaagaaatatggtgcagcttacccgcttttcttagtggcactcgatcagcgaaccacttcgagcagcggtcctgtccggtggtccaacggtacacagtgacgattgacgttttgcagactgtgttcaaaaaacacagtgacgacctgataattcctttcacgacgtttgtttgcaacgaaatgtcgcaaaacgctggtgacatctgttacgattaatcgttcacgggtcactgcaactgaatcaaaagctaagagtgaatttcgattccgagtacaccataaaacaccaggtgtgccccgagtagactgacacatatagggtgtgttcacaaatacaggctagcacactgaaacttggatcgggcaagcgctgacttccgagtctctttttgtggtgggcatcagctgtttgtagcaacagcacccccattcttgcggtgcgggtacagaaaagtgacaaaactgggtctttcgctgaatgaggactccgtcgaaacagaaaacagtgacaaccggtttcgcctgtgatacccgcacccgaatgacggctgtcgaactccacttaaggtactttgtctttgacacgtcacaacagtgtcgttgcggggatcgcgcttgatcttctggatctgatttttccaagtcgacactgtggaaatggcagtgcgagacaaaaaaggtttcgacgaactccaccaacgaatctttacggatgaggagccaggaaagaaggaacgacttttttggcaagagtagtcgtgctgcgaaggttcggagatccgttagtgtagaagatcgaacctaacactaaacaatttagtacaacacgcacgcttgtgcctcttacgctgcacaggaaaggatcgatctgcgaccgagtgaaccaacgtagcagatgtcttctgtagagtcgaaggcgcaactgtccgtgtgggcgaattggaacgaggcagcgcaggcagctccagaaaggttgtttccattgtggaacatgaagatcgtcccgcaactgtgacgttgaaacgtgtacacgcgcaagcagatggcggttatcgagtgatggcactgctaggagcataaccgtgacgaattctcacagacagaaaagatcttgactctttcagatctaagaaaagacacggttcccccccgagacccgcgaattatccactgatacctacagcttaagaaggattgcaagtaattaccaaccgtcctcggtgtgattatgccaaagcgtgcatctgtgctcacactctgttacataattagaagctcacttccccgctgtgttggaaactctgaacgtgtcgaagttgatacttggttgcaggattcctcactgtcagagaaagcagcttctatgcttgtcattcacaggtaaagcccttctctgttttttctcgcacttttttcgatcatcgcttgtacgccctgtgtaacaacagtcctgtcctttgtttcagcagaagcactctaccgagcgttctacattagaataaagcaaagcgcttaaagcttgtgagtaaagtagaagcgagaatgtcggtctcggtaccgtaaatcctgagaagaatcgagtaccgcaaaaactcagaaggttcctgtgaaaagataagccccgatgtgccagcatcgaggcaattcacctgaatctgtgagcagtacagagcaaccaggttcttttctgaaaatccacttctggacttggtgcagacgaaccacttgaaaacgaagaacgccggctctgcgcgtggtgcacgaagacgctgtcttccctgctcttctacgtttgtgtagcgtctcctgtctcttgaaggaggagacgggatatagctctggcaaggcagctgctaggccttcgcacaagaagaaaaacagtggatactaaaggagtgacgaatcgagttagggacgtcgatgcagcgcagaacgagcatcgaggagcaagcaggtcgtgcggtcgcccgtgtctcccgcgacggagacaaaagaactcaaagcacacgcaggtcttgctttctctcggacttctccaggaatggggatgcgccacggtggtggcaatcgtcattgctgcgttctgtccgtttccctggctgcggaaaaagccgtacttttgtgttcacctcagaaccagctgtcgcttctaactgagttttcgagataggaagcccccctcccccccgcacagttacgtgaggtgtttctcgttttcagacggacaaattgcttctcactcttttccgtgtgacacatccaaagaattgtgccataaacaagtcccgtagttcacaacaatctctcctgccgcccccgctcgtcgtctctcagctgtcacaccactcaatgtcaccccctgttcgtgctgttcccgtcgacttttcgacctgccgtctttccatttttctcgactcttttctttcctcccctttctcccgcgtccctcccttcgttctctccgttcatttccatcctctcccaagttctttgccctgagaaacaa

SEQ ID NO: 3620 - DNA, 2309 bp, Toxoplasma gondii
tggacagtgagaacaaccggcagtcacgggaataaatatgcgaatgtgtggacagaaaacccgatcgacaactatacacctatgaatacggcgagagggtacatgggcacttcctttttttgtgtcagctattctattaccggacatgctcattgaggcaacgataaggatgcagtttcgacagcataggcaatggtggtgtatctgttctgtgtggttctaggaacaggggactcacgcatgcgttcgcccaagtgaaatgacaaacccagaggcaggggcgacacaccacgaaaaaacatgaagaagaacaacaactcctacctttcctcttcattctttcgtcccagtacggaatgaagtggcgaacgaaaccgaagcaaagagtggcaagaaacacgacccctgctacgggacggacgaaaggcgtgggaagaatgagaagcggcaacgaaagagtggcgacaaggaggagtaggcatcttgacagacacagcgacggttgcagcttgctttttggtccatcctgaccagaagtacgttctgccctcatttctgttgtgaaggaggaaagcgcgacagtggcgatgcacacaaacacattccacgtagcgtctttccaccgcatgggtagtttccagcgttgaacgaaaagaggataacgcgagtgcagagcagaaggaaacgcacaccgtgcaagtcggttccatccaccaactgcctcgtttccgcgcagcgcaaccaaacctgcctgtgttcttccgacacagaccgacacgctaaagatattccgaagaatacaggaaccgataagaacgagtgaacagtagcaaaggtgggaaattggaacacagaagcagaaaaactaacatcccaagcataccgctgacgggtttgaaccactggcttggagttgtcaccgttcactcatgtgtcattggtacgtcgatcacatcggggagaaaaggttttcaggtggttttggtttgaggacctgaccagaaaatcgccgcattcccttttcctgctcactcttcctgggcgacacactcggtggctcgcggtcctgacgagctttgtggtcggaaagggtgcgatacagacggaagaagctccggaaacactatgaggaatccacaccaactaacttcacaaagtgtgtgcgcatcagcacagctgcaaacttttttcacgcagacggggatacgatttttccttattttccaaacctcgttacagccagcggtctctcttgtatgcaaaaaatagcgcagaatttcggaagtaatgcctgtttactttccttgacaccttttctccatgccgtgcatttcattcgcgtgatagtaatttctcaaccgtctctaggaaacgcgaaaaaaagtaccagaccctctctttcagtctttgtactgcggtctgttttccgctcgctgtctgatttgcatgtgcaggtgaaaatgtagtaaccgtgcatgcgtgtgcacgggggagtgaccctgattcataaaactgttgcaagccatggtttctttcttgaagaccaacgctagcttctcgttgcgcttcgtttgggaacgatcccggtgcaatgatgtaaattccggtgatccaaaatggaaattaaggagagagagaaacgtctacatgcaatcagagagcgtggatgccgacagcctgcaaatacacatcgcaggcattgccaggagtgctagtgttttcaaggttcccctctaggtatttgtgaaacgaatcaggttacctccacctacgggagggctaatgccacagcgtgaaggttcgtttggcgcctccaatacagcagggccagtaaaaagtgtgaatatggcgcttgactcgtgagttcaggagtgatggtagttacgccttctctgagggcaggacgaatgcaaaggcaggggacggtaaaaacttgagtcctcggctagccttgttcttcttgacccccttgtgattcacagtcgcgtctgaggtttctcaagacgttgttgccggttaccggctacctttgcggttatgtgcctactgaaaaaggaccgcctgaaccggggaacgagctttgctatagcaacgttgctcaacgatgttgaactgtgctcagattgattcgcagccaagcacttaattgcgaatttgaatggttttgtgtgtaggcggggtggggtgctctagtttagtgttgccagctgaggtgtaaggacagtcaggtgcaccaggttttgaaattgccgttcgaaggtaacttgctcccaccatgatttatccagatcgaatgccgtaagacacga

SEQ ID NO: 3621 - DNA, 1867 bp, Toxoplasma gondii
gcctgactactggagtcggacggcaggaccttcgaagacaagcagttgcggacggggacgaagagtcgcaggccgatgctacgtctggtgcatgcgacgcacattcacagcggcagtgcggggaaagacgaatgaacggggtctttccaaagcacagaggaagacgcggcgagccgcatgcgcgagggagtgaacgagaaagagaagacgcaagtgttcgcttctggaaggcagctacaggacgcgctgagagacaccgcactgagattggagcccacgagaattgaagcagtggcgatagaagaggattcaccttcttcctttctctgttcgtctcctcgggaaggggagacgcttcagtctctccacggaaccgcccggctccccccgtcgccgcggagacaaccgagtgctccattctctctccccaggcgtagtcgccgacgctcccgagagaacgcaggcgcatgcgccgaagaagaggctctcagcgacggtgaaacaacacgagccgacaagctggtcactaagaaacgagattgccttcgctctcgcgagacaaacactgtcggcaaggagatcgacgcagctgagctgctgaaagaaaaaactactcagtagttgcctcctcgtttggcaagaacgctcagctgacggcagaagcgaagaggaaaacgcagcgaggggacgagcgtccaagaaggagcgcgcggcgagctctgtgtggctcggacatcttctcctcaggatcgtctagagaagaaccgccccgctaaaaatcgcagaagttctctttcgtttcacgtcttctggaattggtttcgaggtcctcttgatccaaaaagaaggcagccagaacttgtcacgggcgacgtcttcagctgtccagcacgcatgcttcgttcttcagggagctgaatcgaagcagaagaagttctcttcatttcctcgtgttaataaggccgacctttgtttctctggacaaagccgaaggaggaaacagctgcgattcaaacagcctttcgtttgtgcagcagcacacttgcggaaacagtctcgttcacacaagcgacaccttgaaaaaacacacatgcatgcacaaaaatacatacctggacatgtagttatacgcaaatgcacataggataaatagatatatgtactacggatctatgaataaaccttggatcactctcttggcgtcgtttgagactgcatgccgctcgggaacctgtcgaagcgcatgcgtaggccgtacacactgtctggcttcctttgccgacaagtgagacgtatgatgcgcccatgccgcttgagacaagaaacgaccgggacgctatgaggaaaaaaactacgtcttggtcctccttttcctggtctgctgtgctgccttggttcgtcgacgaggcggcgctcgccaggctcggcagatcagctcgcctctcacgttcaaagcaaggacgtattcactatagtacgaaaatcacctttttgcgtcttgccccgtcggtgaattcagtcgcacttttcttcaccggcaggcgctcgcgattatttgtttgacccgcctgttactctcaatcgagttcttcgcatgtctcctcgcaggtcatgcgtgagatccggagactcggctggtgccttgtctggtctcgctgcgcctgcattctcccatgttcttggcgtttttgctgtcgcgtgcttctcaccttcacgacttcagggagtctttgtttgtgtctctccccttagtttcctgttgcacggctgttcctactaccgtttcgttttcggcgcaggtctggtcacgctctcgtgactgcatttctgtttcttgtcgcttcggacgttactcacgccttcatca

SEQ ID NO: 3622 - DNA, 4905 bp, Toxoplasma gondii
acggagctctgcacaggcacgtccttttgtctccacgaaaaatctccacccgcttcacagacagatccagtgaaagtcctctgcacagtcccactgtgtgtggctttactttgaggcgcgggcgtttgtttccctgagtctttgcacaaagccgaggcaaaatgtttctctccgatggatgtctcttgcattcgagccttctctcctcactctggagggattcatgtctttcagtccagaagaaatatgtctcggaaaccggtgagtcgcctctcacccgcgcactgcaccacgtctctgctttgccgttgttggtcgactgcctcttcctccccgtccccctcgttttttcttcactggcgcagcaagaacctgaaaaaggaaacgcgaagtgaagcggaactcgcgaggcagatcggccgacgtttctgatgcaggcccgcgagctccggaccgccgctcgcgtccgccagcaactgtatatacaccgggtgaaaccggcgtctgtcgagggccataaggtctttttctgtctggagaatcgcgacagagaccttttttttcgcaggctgaaacggggacagctcgtgacgcccaccccgtcgttgcggcgagtgtcttttcaaacgggtgagttttgccatggcctctcctcctcacctcgcgcacactcatgagactcttgacggcgagacctttgacggccagcgcaggggcgaagaaatgacccagggagaaggccgctgcgaaaaagacactttcaggaattgcatccgggcagaagtccagaaagtcgcgtgactccaaactcgagacttgcgcatcgacggtgcatgcgctccgcagtctctgacactgcttgaagagtgcgttcgtcgcctccactgtcacctagtaccgaagatacggaaaaaggaagggacagagggacgaagaatggagaggaaatgaaggagacgaaagacatgcagaaacacaaacgagcgaagaaaggcgagagagagagagggagaagcagggaaaaacgaaagggtaaagtgaattacgaaacgtggaaaggcaacaaacaagagagagggcagtggagagacgtgcaaagagaacaatcgatgcagagaactctgcgtgaaaagaacagaacggggacgagagagagaggcagaagaaaacatgcaaggaggccagacatttcagagccatacttcgtcaggcacaaatttcgagaggacgcgggcgcgattttggccagcatccgctctgaatcgacacagacactctggatggctgtggagatccgtgagaagacgtagcaagcatccttgtgaagtgtgtgactggagttctccgtatttcgcaacttctggacaaactgtagcttgcttcagagtccccgtggttggccgcagagtcctggaactgaacacaggagtcgtctgccgaggaggcgaagcactgttctcactgagaggcgcacacagcttcccagttcagagaccatgggccgtagtagtagtaaggacgcagagttcacgaggttgagaaaacgtcttgtcgtcagtgaacgcgcagttccctagacagagtttcatcatgcgaagcgccagttctgggatgaaaagtcgcgaaaaccttaccccggcatcgattgttttgaggacatgacgaaattcagctcgagagaaaactgaattgcctttggctgtcaccgcctgccgaaagcgacttgttggagtgaccatgctttctctgtacagcgaggcgagtgaaacagagaaaagcagacgaaacagtttctaagattcgacgttgtgtcgagaagtcgaaagtcctttacctcggttttctgtgtcgcagtgatacctggcgttcctgtctttttacttttccacaaactaccgccttgacggatctctggaaagacagcggaagctagagatctcggcagcaaaggcattgacgacgcaaagctgcaacccaactcgcaggatctctactccccagacgcggatgagacaaaggagtcgaggtcgagacagggaatgctcgaaaaacagagcaaggtaaagcagctgagagtcaaagtgctttgtgaggtttcttctgaacgagtttcagcgtttcttcatccctcggcttccctttttttcgattcattcttcactcttttgcccccagccctcttctcctctcttcctctcatctggcttccaccgccttctcgttcttttcttgttcttcctgtcttctcttttcgttcttctttgttctcttatcgttatcttcttctccccggtcggtcttttctcactgaaactcggcgacgtatgcgtcgacgaccgacttcagcagcgccgttaccggcagatacgctgacgacaggaattcgcatttgaatcaagaagaagaacttgccgattgacgtggaactgtgaggcgaagaaacatttcgcgcatctttggaaactccaagagacaaaggcagtcgtttccgtgtcatctgcagcacggtacttcccgtccatcgtttcgaaaaggtttcagtcctgacctatgtgagatgtgtatctcctgagcgcctctggattttttagaacgatcgcgttgaccgacaaaaacgcgagaatccagtctcatgatgaatgtagagaacgtttactctcttcttccgtgtcgcgattcgtatgtcgctgttgagcgttccatcttgctttcttttttcccctgccgagttgctccttttttctttgaggtgctgtttcctcaccgtcctcgagaggggagggaggcgagtcttcacatttcgtcgagaggacgcagtcggacagagtcacacttccctcgagacaaggatcgagaagctttttccacgcttctgacggcaaaagcaagcctgaccgaattaacacctacgccctcacacaccaacaggaggaaaactcgaagctgtattgatcctaaatcagactgagtttctggtccaggtcaacactgcgtagatttagtgccaggagaaaggtccgactgtcctccaaattttaacaagtcgacgatcctaaacaatcactggcgaactcctcttgacagactcagctccttttccatgactgtgcatcagacgaatgcgctggagttgccggatagcacccgcgagacagcggggcgtcggtctttcgtcactcgcatcctgttctgcatccaagcgccctgcagatgtggagcactcggagttgaagaatccaccattctttgtcgatttctccgcctaccatttcgacttctgcatgcgacagctggaggggaactgtctcctcaggtttccttcgttttcgtgcgagtttcgcctccttgcgcttttgttcgagacccgcgggaaagtcgttgacgaatttctctcgcaggaactcgagaagaaggtgctttttcctctcgccgagcgtcgccgtctctccacccccaacttcctccaagtccctctcactttcctccaggtgtgccagttcttctgcttcttcttcctgcgtctccttgtcttcgcggctgcgagttcgaggcgaagcagacgggtgccacaaaacgattcgcatgcacagcgcgtccagcaaaggatcccagccgcgcgcaggaaggcccctgaggccttcgacagccgctgcaaaccccacagaggcggcaaccaggtgctgcggaggcggccgcagatcttcgtcctctcgcgcgtttgctgtcgcgtctctcaattcgcgcatcgcctccacacgagctgcgtcctgcccaggaaaatcatcggggaaagcggcagaagaagacgaggaagaggaggaagaagcagaagaagaggaagaagaagaagaagagaaggaagattttctctgcggagacgcggggtgcgagaggaaggaaggcagggaagaggcaggtctgtccgttgactttttcgactcgcggactgcctgacctccaacgcgtttgccgacggagtctggtgtgaagagcgaagcagcaggagacgcgaccctgctgtcggtcccgagctgctgtttcccccagatctcaaggcgtttctccttcatcacctcttgcagaagtttctcttgctcgagttccagttgcttgtttctctctttttgctgctggcgggcgcgacgcagaacagagagcgagttaactttctcttttctccagcgactgcactgctgacgcacaaacagaaagacgctgagaacgggagggggatagtaagacgacagctcgcaaaaacctaaaaatctgggcagagcgcacaagacatgcacagcggcaggcatgtggcgaacgcgacagaaaatgcacacgaacgcgctcttaactcgaaaccatccaaacaacgagagagagagagaatccgcgacgcgagacaccacaagtgtggggaccgaactcaagaaaacacgaccaatattcatcgacatacaaaggcctccatatacatcagcatacattcatgcacaaatatatattcatacacagatatacatatatatatatatatatagatatatatagatatagatatacatatatatatatatgcatatattcgtatcaatgagtacatgctaagcgttggttgtggaccgccggtgtgtcttgacagaataggagcacatggggttgtcctttcggtttcttcttctgtttgtcttgctgcgtctgtacctgacaaacaattggagctcggtgtgtatgtgatctgtgttttctccggcttggtgcatcagcttggagagagcagagaggactcgagcgattttcttctccgcctgggacacgaggccaaattcctcgacttcaaactctcgccaggcatctagcagagaagggggcgaccgcgaggaaacgattttgccttcgcgagaaacggcagaa

SEQ ID NO: 3623 - DNA, 3547 bp, Toxoplasma gondii
gcaaagagaagcttcggagagagaatgacgatttttcttggctcttgaaatcgggggctgcctccctcgtccacgagcgaggctggaggaatccaacctgcaggatgcggcagctacggggaagagcccaaaaaaaacaaaaacctttttctccccacgacgacgcaaacacgacaaaaaaagacgccagcacgcggtgccacactgacttctactgaaaccgcgacgcctgcaccgcgaccgctgtcgaacaaagtctctctgaagcgtatacaaaccgcgcgctggctgctcgtagcgtcgaactcctcaccttcttcagggcttggtacaggtggtagttcagcttcttgttcgtggagatgtcgctcctgacagcaggtaggaggacgagacaaaggaatcgctgagcaccggcgctggacaagttgcttgtgaagattttcgtcgcctcaaacatcgcctgtcttgaccagctttccggctgagtcaaaagcaaaacttcctcccacctctggaggcggggcagaactttgaaagccttcggcatttttccacttctgtacttctgcagaaaggatcccatggctgtgtacacctcaacaactttcggaggcaacgcactgcagtcctcctcgggcgcttcagctgcggcgccgctctgaagaaaaaggaaagacagaagacgcagagaactcaagagaaaccgactccggagcgcggctgagaacgaagtgaaccgcgacagtgacctgcatacgcaaaaggcactgcaatgaaactcaaaaggaacgctccccatgctcatcgaagacaacctcccgcatcatacgccttgttgcactcgaagcgtcccggcaggcgagggaagccacctcgagggagaaatagcaattttcatgcaatgttcgaacagaaacaaagaacgatcacccaaggacgtcgattcactcaccgactctctctcctccttctgtcgcaacttctccaagataaaatccgcgagcgtcggagcagccgccgcagttccctgacgctgctgaacgcgctggacatacagttcgtcttcctcgtctgcctcgccatcgatgacgacgaagccttcagaatctacgtcttccccaccggagtcccggtcgacatcctcggagtccagctcgctgccgctgtccgcatcggggccgttctctgagctggacgtacaccagacacaaatccgaaccgcaacgaatgaagcgcatttcgccatagaatgcgaaaacgcactaaagcacgaaaaggcgggactaagaagcaagcgtccaggttcgctcaaagaaacccacgaagcgtaggcatggaaaaaccatattgcattctgatacctcttgagcagtcagggaatatatagattgtcttcaggtagccgagaccagggcctcggtcctgtcagatatatgcttgtcaagaaatcatcctcagctcgagagacgcgagcacatgaaagaaaccggtgcatttacagtggcaggaaacgccgcatggcacccttcatctggcattcacctccaaaaatccgtaccgacgcgagcagatacatccgcgaattccatgaggtagggaaggcgaactcttgaagttcagaagagaggcatgaaaccgtgacacagatgtacgaatgtcgcctaaaaaaacatgcaacagacgactcccagtgtcccttgcgggaaagaggacagcggcaccgttgaacgtatcatgcagtcgggaccccaatcagagggaaatccgcgcagaaccgagatttacatccgttggaaaggcctggcttttcttcagagcgataagggatgagtaagagattatcctcacgggaggatcagaaagaaaacttcatcattttcgccaaggactgacaacaacctttcctcccacactcaaacagagttgaagtcggaacacgggggttttcgcgacgttctcgggagacccggacgcctcaccggtggtgttgctgttcctcgaccagacgaagaattttcttgctgagtctccggggaaccacgccgtcggcatcttcgccttcgtcgtcatcggccgacctactcagcctcgacttcttcgcggccttgcctttcttctgaaacaggagtcccgtctcgggtgtatgcacacccgcctggccgaggatgtccacgtggagagggttatggcggttcgccaccttgcgcttttcgctctgcactttcggcctgaagaagcaaaacatccacgatggcaaagaacaagaaaagatgagaaagagagaagattgggacgaaagtccgtcgagtgtcgacgactcggcgccccacacattgactgggaaaaagacgcggaggaaaaacgaggatgttggttttactgtacagagtcggcaggcaacgctaactccagaacgaatccacctggcccccgcagacaactgcaccgtgaaaaacgactcagacgcctcaaaacggcccatacttttcaatactatatacgcgctcagacgccggacatggatgaagcagcctctgcgaacagacttgtgtggcgaaaaaggaacgagcgcctgaatgggcgcgtgtataccgactgagccttgtcagtacttttctacattgatccagaagatgctgtgcgatgcgacttacatttcttcgggggatcgagtgaccggcagaaacgagggggtcctgtcgccacgctccggagagtgtgcgttttcgggcagagcacaaacgtcgaagaaccagcgcgtccgtctcgcgaagcagagaccagactcggattcgtcgatcgcgaggatcgaacgaactccggagaaagcgacgagtgcagcgaaccccacaagcctggaaagcccagttttttgtgcaagcaggtccccccccgtcacggtcgcgctgctggacgcgctaagcagacagcagccaccggaaggggaagggagcagatacagctggttcgtttccagcgactgttggagaatgaaagaagtttaaatgaactgccacgcgtcaaagaaaggctgcagaggtttttcgcgaaggatctcgctgcagagtcctcagctttggggtaggccgactcagggaaaacaccccgcaggtcgaccgccaggtgtgctctggacgcgcgggggaagtgaaagttccgcgggctatctacagcgaaccgacttcccgagaaaaaggactgagaaaagttgacgttcgtgcgtcctttcgaggcgggaaaaaccagcgaaaatcgaagccgctcgcgagccccacactacctgaagttcgggcggtttgtgcgcagcgagggaagtctccgcatataagaggaccaccgtcactaagcgtagaggccgagagaggcctacgggtcgttgtgtctccgcccacacttgagaaacgctctttgttggcctgaggcgaccggctttcttgtacgcgccgcggctgttccttgtcgggggtttccaggggaagaattcactactcttctgattttcctgcacttttccgtcctcgtcgccaacgtttcttcgtcacga

SEQ ID NO: 3624 - DNA, 2634 bp, Toxoplasma gondii
actggttggcaaatcggatacctttagtgactgggaccagcccgacagagcctccggttggtcgagatggtgtcttggagcccgtctgttgcctgcgctttctgagtgtctctctaggagtaccgtgcaccacgggaagagtttgttgctccgcgtagctcgtttcgattcgaaatcatgcattcctcctatctggagcagcacaccaggagagaccgatttctgctgcgtactggcactctccctgcagtgaaagcccctccacgacccgcagaggcctgcattggtgtgtggaaagaaagagagacgtggaccatatcgatatatcggatggcgtctctgtgccgaccagcgtttaccagaacgcaacacaacctgctccacagaatcacaaggatatacacagatctcatggagaagcggacaaggggaaaggaaactcgcaggcgagtcgtctacctgtttcgggttgccttgagtggcaggagcacgaaagaccggggagaaatctgacgtcaagtgctcgggcagtgtgggttgcagtttgtgagggtgcatggtacctcccttctgcctgtttatccggaagggcgtggacgcaaaggatccatcatgagaaagttgagggtggacgcggaatcgtcccgcgacttccacatagggctcgttagccgatgcggtcgggccctgacacaccaaatgccgcctggggacgtaaaacagtgcccgcgagtaagaggaaggactccgcctcgccgaattcgtgtggatgctgccgttttctggtgggagtcttgagaaggggtgcctcttgccgcgtgttggcaacgatgcgtcaaacaggaccaacccactacatccttgtagaacaacatgaaagaaagaaatgagccttaaaattgcagtgacagacattgtcagtcacagtctggcccgtcctcaaagagaccgttacgacgattgttcgattttctgcccaaacgcaaggaggggcacgagaacatccgttccgatccttgtatgttcattacgttagaaaacaatcggaagccaaaaacactaggggcatattacaaagcagcttaacacttggcatttaaacatatctgcagcttatccaggagagctggaggaggcgggtaagtcgcagagtctcaccgactggaagatctatccaacagtggcggggacacaccacagtgggcatgaagcccacatagtaatgagaaaaacgaggcctccgtctcacacttcttgtcaaagactattcgtgcccctatatatgaaaactgttgaaggaattaaggcttcatctccaaaagggaagccctgttgttggtactgttactgggttgcgcatgccacagcgaacgcagccatcaatcagaggcgtgccgttgaccgaatgcgatacgcttggattcactctccaaaaggccgcagctactgtttaaaacatgtttttctacattggctttccccttcagagatatacgcaccaagagaagtcgtgaaactagttggtcctcaagggtcgagcctcaacaggaccttccataaactctcacgcgatcagtgacatcgggctgccacgtcctgcacacccgcggagtctggtttgatcttccacgaagtcgaacaagagtgacagggatttgtcgtgcaaaatggtttcaggtaaatgcagcaaacaaagcaacggattgtcgactttcgccccgcagcgagtgctttcaatgcgtgtcttgccggatcgacgtgtttcgagtgacctacccgccgtgtagaaaatggggttccaaaggcaagaacccccacggttcgaagagggaaacacgagttaccagtaatacatgatctatcaaaagcacagtgcagaaaatagggtcgacgtccgggtttgcagtaccggtgcagggactgagtcctattccttcgggcacctcggaacgaccccaacatcgacgcatgcgaagacaattttgcgtcaagagagcaactgagcacatgtagcttctggaatcgtgagcaggaacaattcatgaacgaagagtatctggtgaccaggccggcgtcgactacaagaacacttcgttgttgccccggcggtcttcatcttttctaccggtgtagatggatgacgtacgaccatacgaccaagcgctgggcgggcaggaaaagaaactcaggcttcccaaccattaccaaacgttgttgtggtgcattacggtcatccagtttctacaagagactccattgctccaattgttctgctgtggagagtcaatttctccgtgtgtgccgcatccctcgttcccccagcgggagttctctgcggatagcttcctcaggatcctctactcatcccgtgggtcacggtgtggccagctccgaaagcttcaaggattttgaattaccactcgcagtgattcgttcgttgtgttttctgaatttcatcttgcggaatggcgcgcctgtatatcaggcatggacacggaggaacaggcgattttcctgctgcatcccccggtgggtgataagtcttctcctgcaatgtagacagcctgggcgacgtacgccgggtgttttcgtgccataggaagtgttactaagccttatgtgggttgtcctcga

SEQ ID NO: 3625 - DNA, 3587 bp, Toxoplasma gondii
gcaaggcatgcagttcggtgggttcccgaattggccagcgttgcagagagaagcgtttccgccggaagccgcttgagaaaagggggaacttccaaagacaaggagcgcaagggatagaaaaactccttgcggagagcgcttgagtcgcagctgcacacccaccatggtgagcgacttggattcgtttgctctctcccatcgaaaacgtggaaggagactcttcttcttcactcggctaagacggcgggcatgatgctgtctttaccggtttgcttcagtttcagctcttcatctgctgtttctcctctgtctgcgtctcgtgtagcagcaggggacggtgcatgcagttgaggctcgcgaaaggaaggcgccacaggctgcgaggatgccgccgtcgttggagcagactccacagcggggaaggttgcgaacgagcggcgagaagagagctcttgcgctgacgctcgcaactgaaacttctttccctggaagggcaagcatgcgtcggcagtttagcgctttctcgttcatcacagaagcgaaaagacctgagagtgagaggcggccgtagagcgagaaagaagactgagggaaggccgtcaacgagtctattttttaggggaagatgcggacacaagagggccgcttgaactcgagaagagcgtctccactttgcaacgtgtgtcttgtctttctgccgcgccgaactttgatgtctccgtattgccagcctgtccctgattcccccttcccccgtctctctcggcctccccagcttccccggtgtatgaatctttttccccgtctttttcgcgactcgcgactccggggagtccacagcgcagaggtcgccgtgggcagtcttcgcgtttcaccgacgggaggaagagacagaagagaaagacgacagagaaacagtgttcctcatgacgcccagacagaagcagtggtcttcgcttactgccaaagcttgctgttgatcgaatttcctccgtgtcttgatcaaaaacgttcgtgtgctcgccagcggttcggggacgcggactgaagctggggacgaaaaacgaaacgagggatccaagctctccgagtaaactggaaagagtgaaagaaaagtgaacgacaaaatctacctagcggtgagggaatctgtggcttctctctggtcgctgccgccgctcgattctccgcgaagcctcggcaggtccgccgggcagattcagagcaagacgacgccgaaaaaaggctaggaagaaggagggaaggggaaaggaagggaaaggctacagacagaaactctggtagctggcctttgctttttgattcagaaaatcagtttctagcgcgttttcttaaagtctcttcggcttctccacccagccggctgcactcgctttgcgagcagctgtcaatcgagacaccggaaaaaggcgcagctcgagagtcgactgcatgcacacaagcgaagcaaggcactctgaacagcgttgagcagaaaaggaaaaagaaagccgagaagaccgataaaggcctctgccgttcaaatgtatgcattcgtcttcgcggcgaaaaaaactgaagagaagttctgagctgtttgtataccggctgatcccccttgggtctcagtgcagatgtcgtcgacacgaaaccgcgagtttctgattatcgccggatgaaaagcgaggaattcacaaagggtttgtttcacagaaacagtggagattcactttgagtgttcttcagctgtcttcgagtcttttaagtctgaaaatcacccgccgcggggaagcggtctagcgcacgattgcaagtctatttctctcttgcgtggtgtgtctcccgtagccagtggatggttttatgcccttacgaaatgaaaaacggataacggacggggagtgtgcgaacgcaatctgctgtgccttgagaaacaagctgtgttccacttttgattgtgtctcagacaatctcctacgactgcctgcactggccgtttccctacgatcacggtacgcgtgcgtggcaatgtaaacacacaaacctacgtagacttgttcaaggagatgttcacatggcgaggaacagatgcgacagctgtatacggaattgcgctgcacagagtttctacgccccggttcgttaatgggacgtctgcatgcatggagtcagtgaagcacgggtcgacgtaaccgattgagcgcgaaacattgttaaaacatagtttttcgaagacaactgaaactttaaatcgaagaagataaaagatacatctggggagcttcctgatgcctgttaggtctaccggcgacttattgtatcatggtattgctacactaccgtaatacagtgctacgcaccgcctgagacgtcacactcgtgagcgctgtacgacagcttcacatctttcctcctgtctgtgtcaagtattttatcaggtaaacaattttgctcagatccttcagagtatcgtgaagacgagcaaaggacgggaagtctccgaggcagcttcgttcgtcaggctacgcacgaggaaatcgcgttgctgcatgtgtttgttttcagacgcagtcaaacaaacactgttgaaagcagaatctgttcaagagatgttctttttcgtttgtttcttctcgagttcatttgtagcatcagagagttttcgatctcgtcgcactccttcaactgacaattctctagacacacatatatacatatatattatgaatgtgtgcatgagaatggttgctttgtaggtattgcatcaaagttaaggctacaatttgcaccacgattttgaggatccggtgacactgtgcaaagggtgcaagccagacggcaactccacctgcatgtggcgtcagagcgtgttgaatcgcgttcacgaatcgagcgaggttaacaagtagaacgactaagactctcaggagacagcggaagaaaagtccttagatgctaggggctgagtggtgccgcagggacgccgcgtggcagactccttgggattttcgtgttggatgtatttctggaaataaaaaaaagtcgatcgcttgcagaggtgggtccttggaatgtcagggtacgtgatttggtgttctttcacgaatcaggtgacgaatgtcgcaaaatgagcgtggcatggggttacaaagaaacagacactgcgagactgcggtacttgcattctctcatatgttgaatctagaagtacaaaagccatgtgctatcaatagatcctgggcgcatatcttccccgcttatcttctcagtgaaagccgttaaaagaacaggaacacagctgctgtgattaaggttccaaatatgtttctaacagtcgaaaactcacgacgcgaaaaggcaagtctccattctacgacatgcagagttgaaaaaggcatccttttagcgtctgccttgattggtatgtatttcccagaatccgcaactgtgaccgacaatccagctagcagaagctttgaggaaatacctggtagccggatttcgctatctcaagagagggaatcagtgtgtagcactgtcaaccaagacagggaactgtcggcgtccaacggctctctcccatcgag

SEQ ID NO: 3626 - DNA, 2720 bp, Toxoplasma gondii
aacaaagccaaaaggtgttgttctgtatatcttctgtttctgtgtgcccggactgactcaccgtgttcagggccgcgactgcatttatttgagctgccgagttactccgttccacaccacgctggcggagcaggcgtgcaagcatttctcgcacggcgtttgttcaccggcccttcgcacactgctcgtcagagcctcccaggcagctttccgcagtggcgggacccgcgctccggcaaagactgcttttctatgccgtaccagggtagccacgacagtttgcctagtccacgggagcaaagcagagacgccgcgagtctgagcgaccaggagtccagtatcgtgctcactgacacggggtcgcacgctcgcaggcgtgcgacttggaggctccgtaactcgcgtccagacgagcatgagggcgaagatctcggcgaaacgtctgcgtgctttaacgaagatgctgattcctggcccgtcccggacagccgaaccctcgaggcagatgccgcaaacgacgaggacctaccaggctgcctcttttcacagccgcctgtgactcaggtgctgctcagacggcaaatacgggagctcggatacgccatgaattgacagagttttttcgattaggtggagtttccccggtgaatttctctgttcgcttccgatgttctcgtccagaccgcaccggtcgcattgtctgcgtggttttcttcggtgaccctcagtccactgttgaaccaaagggtccatactggttggtaatgaagcactaaactgacacgggaagcacatgttctgaagagatacacgtttcgctgatcatgcgttcattcgtggaataaagctccaccgattcagtggcacgcaagaagtcgtggctacgacgatggtccccgccatcaaacctagcgactactgaagtcagctcgacggtgcctgagtaagtcctagctttgtttaaacgccagcaggcgctgacgcacacacatttgtcactagtagtttccattgaaactggctcttcgatttgggacaagctcaagtcgcctcagattctccgcggtggttggcaaaaagtgcgcgcctgagcgcgggcggcaggagcaaaagaaacgcaagctccgatcttacggggctctgaagtgaacgcagtcatttcattcgtcagctaacagtgtggatatcagtgcttcgtcacgccgccacaggtgtgaaacgcgtgcatcctccacgtatctttcaccagagaactggcagtcctatcgtaagaaacctgagaagttggccaagtgcacgtttcgctactcagaaacactcatgggtggtaaggtatgttctcgctacctgtggcgagtctggcacgtcgttatcgtttacgtgattacagaaacaagaggtgcgcactggactattccctcgaaggccgagccctgaagctgcttcacgctctgatgggagttcttctctacaaatcgactattttccccgaagtgaggcggtgcaaccgctcagcaccacaattgtaaggccactggattgccaaaattatttcccctctacgctacggtacggcgacgtacggatgaaaccccgtgccctgagtgtgtgttacggattcctgcaagattatgtccctcagcgaaaggaaaattacgacatctggatttctgtccccatcttttggtttgtctcacagccataaagggggaggaaacggagtggccaacgcatcctattgaaatcactgcctaaacgcgagttcagagcatgtcgtcctacgaggaagactcgacctcttctgcagggcacacctgagttccgaacacaccgtgttatcctgaattaaactggaagaaccttcctggaaccataagctgctgcgtaagcagcaaaccaaaactattatccatgaaacgggagatacgtcaatatcaccctgtactcctagacctggcgacgggctgggcggcctttgaaacaccgcaagtatcggcaaaccgaagtgcaagtacaccaccgctggaaataaggcggatgtcagaagagttttcctcaacagggcttgccggaagaaacacttggtgtccagcagaacggagaagttccagacaaactggacggcatctcgcgctagaaaaaactcactcgacgatacggccgcgcggatgttgcgccgccttctgcctgagcatgcagcgggtctctcggtatgcagggtatcatcccggtgtgcccagcgaccccgaagggcgcagtgtctatgttgtcccagaaaaaacagagtcgaaggaaaaaaccaggttttcttgcggcatcccccttggccgctgcaaggccgctccctcggcaaagtcgtcaatttacgctgtcgtgcgcccgaagggcgcttatcctcgcgacctcgcctcattctcagctttcacgcgataaacctgggccgccctcaagattttccgttgtctgagcgtttgctcccacactggcgaccaccgaccggcgaagagtcttgcctgaaatccaagtgttccgacagcagttcgtgtatcggcgactctggacgcgccggaagctggcgtgctgtgaggtgctcttgtcgtgcaggcgcctccgcagcctttccaaattcgcatgttccttcttccagagtccagcaacggccttcgatgtctttggtttgactgccgctctggtgccagagtcgcagtgagtcgggtgta

SEQ ID NO: 3627 - DNA, 3168 bp, Toxoplasma gondii
ggcatttttatgcggattgacggacccagctgacgtgtcattcatctgccgcgaaaaactgtacagttcaaatgaattcatgccgttgtttaccaggtgctgccaacctttgtcttgtgttggacagacgaaagcatcgtttacccgatgcaaagtctcgattaaacacacaagatagccggcagtcagtggactgcttgctatacgagttaatacgaaatagaaatgcgcagcattatcatatgtatcgtgtggtgcaatatccacatctgcattactaacagccgcgcctgctgtatcttctagagtatttgttcttccgtttgtttgcacatagacgattttggaagtggaaggaaaccatcaagtgtcgagctgcctacagcctaagcaaaagtaggagagggaagacttcgggaacatcggtggaatacggaatcgtcagcagaggaagggtggcgtatttagtgtcattaggggggaccaagcagccaatagggtaactcagtgtcaccacatgggttaccataattagtgccgggtgtaccgcagcaaaatatcgataggtcccgcgggttcattttgatatttttgctaaactggagcatcctccagttgactatggacgctgaaagagtgtgaaacactggtaacttccttacactgccttgaaaaaagattcttcttggggaccgtcacggtttacacacaatatcaattttcctcccttatgtcacgaattcaggtacttgcatcagaggataaggatagaaattgatcgcatgctccgggtggacgtgtcgggtacattttcccgcttgatagagcacgccttgaaaacaagagtccaccgagggctttcactaggaagtatgatgcccacgtgtacggatgatggcggctggtttccggccggtttcttgaacaattccgtcgagtgacacaagagaactagccgttgctgagggtaaacgcgtggagtttggaccgcggcgttctgtagaacagtcagtgatacctcgttgtgcactaggtgacagaagggcgactttgtttctggagccatgtgctgcaactcagtcgtctgtgttgttctgtcaatcaaataaattccgtcgtcactggtagttcattggcatgttgatgacatacaccttagcaagccacatgttccagatggaattactaataaaactgcaaaaggcgccacgctagcacctgggtatgcctcagaaacatctcgtgcatttgctatcgttcagcatttggttagagaagtggcaacaagacgggaatttaggatgttgcctgctataacagcttcttgtgtggccctcgccagaggacatcagatccaacagcgtgaacaacagtgtatttgaaacctttccagctgactggcggtagtccgacacgctgcagcctttacgcctccatgaatccccccgtctacccttgaaaccgcctacaaacgtcgtgttcattccctaacacttccctcttgtgttccgaggcatccttggctttttcacgtccgcaaaccggactctcagccctgggggtaactgatcttaaccaagacacggactctatccagctcagtatgtgtgcgacagtgtgcgtgaccctgaaagtggcggaaagttgctggaagacatgactatagcaagacacactgcaatttaatttcacatctgccacctggccgctgacaatttatcgtcgtgcctcgacactgctgcgccctgcagctttgtcacacaactgacactctcggaagctcgttttccctcacttctccaccggttcgtgcatttgaacccgtttcccccgcgtttccacccgcacaacttcagatgaaaagtctgtaaaccaacgcgtagccagacgacatatttccacagacattccttccctcagcacacacgcccgcaccagaccatcgatttccagagtttcgctgaccccgccctcgcagaagaccctgtcgcctgagggtttctttcgcagggaacgaggagaagacagaaagtcaggcgcattcgtgaaattagttgtgggcgtttgcgtcaaacaactcccggaaaacagcacgaccctgcgaggcacttgggcgggacgtgtggtagcccgttggcaccgggaatgtgcctcgatgctgtttcgcagctgtcagtgttacgcggtcagaacaatgggaactgccggggcttcctagttttcgcggaagtttcctctctgtaaaagatttaggagaaagccgaaggttaagccttgtcttctcgcctctgtttcgcggttctttgccgaagtcgagttgtgagcttgagtgagaacgtagggagacacgctggacgttctcgagggtcctggcgctgatcgcgagaactgccaactgcggcgtttctcagggcctgaccctcccattgtgtcaccattcgtcgattgttttttcccatcattcctgacctcgccgtcagttttttgcagtttcttttgaccccaaacaaagcttcggtgtggtaacactttcttgtgccatcgtgaagtttcgtttgtgtgttggttttcctgggtgcaagtggcggaagcgtgtcgacacagccgaaacccgctttcgtgctttgtttttgttcacctcctgtcgtcctagtttcctgtctccgctaagccgtgtcagtcaggattctggcgttccgcctgcgccttctttgcaccctcaatttcttgatgcaacggttgtgcctcacgcgaaagcacagaggcttcctctcgtgaaagcggacgcagaacagtgctcttccgctcgcggagggtttgcgtcttttccgtctgacctgacgcctaggtgacgcgcgaaagagggcacagggacaagagaaggaggaagatggactgcgtcgcgacccgcagcaactcttggtagcactttagttcccctcgccgaaagagagacatgaacatcgaacggtgcaggtcaaagagtcggagggcttcggccggaagagagtgtgttctgattctttctaaaaaggaaatgtgagtgcatacggcagcggctgtgcagaagcccgtccgtctgtgagggggactccgagagagaggtttctctctctctctacgaacgcggaactcctcgtttccagtgtttcgacaaccgactcaaca

SEQ ID NO: 3628 - DNA, 2404 bp, Toxoplasma gondii
cagaattttatgactctacgtactctggtgacagtgtatatcccaacatatattctggttctttcaactttttgaagcacacgttttaatcttacctgctttcgatgtagtcctccgaacactatgtgttcgtgcagagccgtcttcggcggcccatctatgaatttaaccataggttgtattttctattccatgttctctgatgtgtgtacacatgatgactgtcagcctagaggttgatacactagcgtacttgtcagatatgataattacgattccaattcctacgggaactcagatctttaattggataggtacgtatatgacttgtcatagtacgacacgaagactagaactatgggctgcccttggatctgtttttctctcaactttaggaggcacaacaggtgtagttacgggcagtgcaggtatggatgttgccgcagagtacccgttgtcatactgcaagtacacaggtggattgtgcaacgagggagaaacgccagagtttatctagcaccggaagtgcagcggagctccatgctgcactttcgatgagtcgccaatgtggtgccataacgacttcgccactgctctacatataattgcaagccgacacacggtaagagttgacgccaacttaaatgtaccggttccataagagggaggcggaaacggagaagccgaacaattccaggttgactttgttgttgctatccataggtacggtaatctcatcgagcagcagaggcgactggggcccatccacttgtggcaattatatggaactgaactgcaaaaacacagcactactttcctgcttacagtcgcctgtccggcgacggaggcaaaaagaccccactgcttgaggtcggtctcacctaggttcacccacattcttttgcgagactctcttggaacagtctgtgttcccgcaccgggagtcggtgctggactgtcttgtgttgctcgacaccgcaataatatctccattcaaaagcatgtgaccaaaatgctttcaaaattcatctttcaatcgttttaacagccctgtgtcgggtgaatgaaggaaagggagccattgtagtagaaagacgatagcatgatgtgaattcggcctggttggatgcagattctgtctggcacgccactcactataatcgttgcatgctctacgtgccccgtgaaactcgaatccctctcatctcaggctaagatccttgtgcttctgatgtccactaaaaagtgtgtggggcaaacacgaaaaaagaaggatgtctggttggtcgaagtcctcacacaaaatgtcgcccagatttatggcaaacgccttggtgtggctttgcggccccttggaaagtgtgccgcggcgaaacgtttcggtggagttacagaggcggagtcgcatcactaacgacgttatcatgtctctctcaccaaacatgttcacttgttgtaaaatacagtacgggatggaactacctttctaggaaataccatctcagccgcaacttcagagtatgctcgcgttacaaatgcgccatctactaggcaacccgccatggaacactcaacgccccccacctcctcgaaggtatgtatcggtacggaatgaagctccacctcccaggaggatacgcgctgaccgctatcgaggatcgtgtcacctctcgttgaaccgaaagagttcttttcatacttgcaagcagttgtaacatttcttgccgttgtattggacagtagagtcgcttggctcttgagcactctttctaaacccagcgttgctactgtgttcaatacatgcgggatgcatgagctgcaggaagcgttgcgcagccattcactgcaactgaacgactattccgttgtgattttttcgttcaaatgcggctccgaaggcatccgtgcaattgttaacgctgtatctcactgaattgatctggaaacaatgttttattcgttccgtgagcgtttcaacgtgtcgttgctttgctccaaggtaatcattagtggtagtgggcgtaacacgctagtctcctccaccgcggaccttacgttctctattgatcgtacacccgccgacaagattcctggattccttgcttatcctggcatattcatgaaaggctttttcagtaaccggttctaacaccgccagtgtccccgtctctgccgctgcatcgacgactgcgatacaacgacagcggcaccaccagcacaatccgcagacgatgagggaagcatcatggccgagagtgacacgtgcattctcggttttggtgcttctcttgttcggcgtgatgcgatcattttcaaccgtgtttcggcactgccgtaccaatgacttcgagagcttctgcgtagctttacgcgagttgcctgaatggtataaatgttaaaaaca

SEQ ID NO: 3629 - DNA, 1738 bp, Toxoplasma gondii
gctatgcaaaagatcttcgttccttggcacacttacatcggcagtatatcgcgctgctcgccgtagagtgtctgttgtggaccgtagaagtgcgaggcccgccattttcacttcggcaaggcctctggcccaagaaatgaagacgccggcagggaacaccagaccagctgtcctggcgtagcgagaaagatgtcggatgacgacgacagagacaacacgcaacgtgtatcacctggattcccactagaagacgcaatcaagtaaacagggaagaaagagcaacgcaaagcgaggtctcgcctcgttatcggttgacctcaaggctgagaggcggtgccacggtgtacaggcacggggctctttagcagagccaccagtggaagcaggggacgagcaggcgcccagggtaaggcggctctttcgcctacttcaccgtaaaagtccgagttctcggtgttggaaaagagaagctaacgaagacgcgtgacgccacggaacggggagaagtgcgaatgcaaaacgaactttcctgacctggaaaggatgcagcgactacgcattctgcccgcacacctgatacagagagtactgtccggtattaggtcccttttcaaaagatgtcgaatttggggaagtgggggaaggaacagaagtttcatgcttctttcagttacgttgaaatttgcgtgagtcaaatataaccatgcttcggccgcattttgatccgatgctcataatgtggcgcaccggcagtggacggagaaaatagggcacaaaagaacgtattgatagtgctcattcctggcggaaacgccatagtagggcgtgtggcgccgagtggtcgcatacacaaatcgtcgcgagatgaaccggtcgtgtcacgggctagacgcagcgcatcccattcccgatgataatagcgaaggaagcctctggcacggaaatacgcaataatacttcagtagcataaggtgagcatggcgatgggcagtctgacaggaagagggatcggggcatccgctcgcaaaatggggccgccgcagataacagcacccggcaaaagtgaggagacaacacgggcgatactttagagctgcgttgaagcgaaagctcctcagacacggaacgaactgctttctttcaaaagaagtgcaagcgatggaaaaagcgacgatatctaagcaacaagcgcgctccgcacacgctacaggacaggatagagaaacgagtcacagagcacgaaaatcctcagcttttcctctcgaaccggaacagaccggctgttgagctagcagtttccctgggtgttaatgaagagagaacaacacgaagaacaaactctagaattgatagatacacactaacctgctaacacgatgtctaccgcaatttttgtcgaggttcagcgtgtctctgcttcctacactcaagaacagccagcgtcgcgagccgagttgctgcgatcagcactacggacgggcatgctgcatgccgcggaaaggtggcaccgtacacgtatctggttcttctgagcaagacaccaccgaagaaattagagagtttttttacatctcttcgtctgtgcaaaggacgatgggaggaggagagcgcagccattcctgtgacggtcatccttaagccagtgtggcacaccgaacactggcagttggttggtcgcagtagagaagatgcctctcaggtggatcgatagattcctggagagatgagtacaattata

SEQ ID NO: 3630 - DNA, 1851 bp, Toxoplasma gondii
catgtggtaatgagggtagaaaatgaacgacgcaagacagtgctgaacactggaccacacagagggcgcgattgatgaagtcgcttctttggtgtgactttctgtcgaaaaggaagcatctcattcacaaaacacgcccagtattgggttttccccaacgacagggactgctgagttgcttgttgctttctcgcggattgcaattgggcagcttgccccaagtctggactcccgttcttcagaacagtgttagtggttttggcgcctctcccagtgtgttcgatcacgtgcttcagggtatttcacctgaacccccgcatagctgtgcctggcgatgtgttggccacccaaaaatgagatccaaaggattcacagtttcaccggagtccaatttcaaagaaatgcaacgatgttcacagatgttcttttgatctggccatgtcgcgatgcttccgacggggaaacccaccattttttggctcgcaggcgaacgcgcgagctccactgttcgagaccgtcggtaaaacggcacagcgttcctgtgcgttccattttcccgcaaatctgcctgtatcagtctccttgtactaggttcaatccattcaaaggtcgcagtggccagccggctaaggatcgtgagcagatctgtgcgctgactcgcggattcgtctaaacgtttccactggacgacagcgaaaccgcaaagcggcttctgtcacctctaccaaggcgctgctggtaaaacggccgggagggtatttacaggttttctccgtatacataaaggggagagctttaactaacaaatttctcgccgcatttacctgagtcgcgtgatgtcttccaccgtctaactgcatctagcaatggaggccacatgccttgaatctatttagctcgctgtgtcggtggtatcgcagcaaaaatggttactatgggtccaacggaatagctggctgcgttagttcttcgagtaatgacttccgaacccccagtttacggacaaaaacgctttaatccacgcagcactggcacactatcaacccgttgccgcagtcatcacttacgcaaaaagcccctcccagcctctcctaatgctcgagaatctctcagtcggaatcctatatgaattgaaagtgcgtgaaactcgcctgtaactccgatttggaggtcgagagaacgaagacacatcctggcacatgcacgcgtggcggcttcctcgactgcattttctctccggctgcgaaaaaccagcgttcgtttacacgcgtccttttctgtctctcccgtctgcctctaggaaaacgagcagcgtaatgtctggaacgaatgcgagaaacgtgaagaaacaacaggaaaaacggcgttcaacccgcgagttcagcgtcgtcgatttttcggctcctcggcgcatgcaacgcggcaccggcgctcccacgcagaaatgcctcagagtctccagttggcgtttctcttttcgcgaaaagagtcccgatttgcattttgcaaaacgtccggacgaggttattctcggccgtgcgtgaaaactcgagaagacacaaactatcgcggcgtggaacagaaagctgctcgtgtcccgggtgctgccttgtggacgcctacaccctgccgtctcagctgcatctgcggtgaatccctgtggatcttcgatttcttggttttgtttcacgtcttctttcattgtgacgactcggaaaacaaaggtgagcagagaactgcttctcgacgcgagcgcctgcgccgaaaggagagcaggcacacgtcccgtttctgcatgccgtggcggtaacgcgcgtcttcccagcaccggtctgcattgcttccggtgta

SEQ ID NO: 3631 - DNA, 2042 bp, Toxoplasma gondii
actggttggcaaatcggatacctttagtgactgggaccagcccgacagagcctccggttggtcgagatggtgtcttggagcccgtctgttgcctgcgctttctgagtgtctctctaggagtaccgtgcaccacgggaagagtttgttgctccgcgtagctcgtttcgattcgaaatcatgcattcctcctatctggagcagcacaccaggagagaccgatttctgctgcgtactggcactctccctgcagtgaaagcccctccacgacccgcagaggcctgcattggtgtgtggaaagaaagagagacgtggaccatatcgatatatcggatggcgtctctgtgccgaccagcgtttaccagaacgcaacacaacctgctccacagaatcacaaggatatacacagatctcatggagaagcggacaaggggaaaggaaactcgcaggcgagtcgtctacctgtttcgggttgccttgagtggcaggagcacgaaagaccggggagaaatctgacgtcaagtgctcgggcagtgtgggttgcagtttgtgagggtgcatggtacctcccttctgcctgtttatccggaagggcgtggacgcaaaggatccatcatgagaaagttgagggtggacgcggaatcgtcccgcgacttccacatagggctcgttagccgatgcggtcgggccctgacacaccaaatgccgcctggggacgtaaaacagtgcccgcgagtaagaggaaggactccgcctcgccgaattcgtgtggatgctgccgttttctggtgggagtcttgagaaggggtgcctcttgccgcgtgttggcaacgatgcgtcaaacaggaccaacccactacatccttgtagaacaacatgaaagaaagaaatgagccttaaaattgcagtgacagacattgtcagtcacagtctggcccgtcctcaaagagaccgttacgacgattgttcgattttctgcccaaacgcaaggaggggcacgagaacatccgttccgatccttgtatgttcattacgttagaaaacaatcggaagccaaaaacactaggggcatattacaaagcagcttaacacttggcatttaaacatatctgcagcttatccaggagagctggaggaggcgggtaagtcgcagagtctcaccgactggaagatctatccaacagtggcggggacacaccacagtgggcatgaagcccacatagtaatgagaaaaacgaggcctccgtctcacacttcttgtcaaagactattcgtgcccctatatatgaaaactgttgaaggaattaaggcttcatctccaaaagggaagccctgttgttggtactgttactgggttgcgcatgccacagcgaacgcagccatcaatcagaggcgtgccgttgaccgaatgcgatacgcttggattcactctccaaaaggccgcagctactgtttaaaacatgtttttctacattggctttccccttcagagatatacgcaccaagagaagtcgtgaaactagttggtcctcaagggtcgagcctcaacaggaccttccataaactctcacgcgatcagtgacatcgggctgccacgtcctgcacacccgcggagtctggtttgatcttccacgaagtcgaacaagagtgacagggatttgtcgtgcaaaatggtttcaggtaaatgcagcaaacaaagcaacggattgtcgactttcgccccgcagcgagtgctttcaatgcgtgtcttgccggatcgacgtgtttcgagtgacctacccgccgtgtagaaaatggggttccaaaggcaagaacccccacggttcgaagagggaaacacgagttaccagtaatacatgatctatcaaaagcacagtgcagaaaatagggtcgacgtccgggtttgcagtaccggtgcagggactgagtcctattccttcgggcacctcggaacgaccccaacatcgacgcatgcgaagacaattttgcgtcaagagagcaactgagcacatgtagcttctggaatcgtgagcaggaacaattca

SEQ ID NO: 3632 - DNA, 2623 bp, Toxoplasma gondii
ctggtcacactaatctttgcacatgtcacttccacacatcctccgatacagacagcacatttatcatctcgataggagagggagcgctggcgacagcagtcgtttctgacatgtctgacagcacatttgtctcgcggggctccgatcgtctcgaccggagcgtgccgcatatgcatcactgagacgttggtcgtctttcgaagggtttcgtttgctttgttccccaaactcaaacgcgttcacgggggagtccacacaaatctaagcagacagctacagacttgctggaacggcaaaagaggtgtgttgaacctcggcagtatacatacgattcacaggaggggcgaaacggggggctggcgtacgggctgcgtggaggaaggttttgggcactgtgaaacgatcgtcggtttgtgtcggatgaagagaaaatcccgacgctccggaaggggcaccttggtaggggagcagagaccttggcatttgcaagggtgggtcaaaagggaaacttgctatgggatgtggagcagcttggggcggacacggcagctgaggtaaaggtgcaccttcggaatagaagatgcacgactcttgcggaggagcaaatgcgttgggcacacacttcgggaatatgttttctgccgggtaatcgaatgaggaacctgacacgccgttaggcacatgcaagtgttcgttaggacgaggttccggttggtacacacgcaagttgctattttgaataggatttccaaagttgatttccgggtaactcggcaaaccgtgtggtgcggttcctgagtcctgattctcaagggcgtccacaagaattttacaccgctccgtgtaaggggcagaagccgccgccgccgcatgaaccccagccatcgtgtatattcgctcttcttgcttctcagtgctttccacgggatgctggggttggattctcatgcccctgtggtgcacaaaaaggtagaagagtgtcatgtacctccgcccatacggcgcagaggcgatttctttcgccagggcaaccacggcactaaagttacgttgggtctgccttcccagatgcatgggtctgtcgtcactattcgactggcacggcgggaactggaaataactgcctcgttccgagagatcctctttcgtgaaacataaaccagactcagaacagtccaacctcgcgtgaggcatacggaccagcggcagcaggttttggcagaacagcgagaatgctgcgtcagtgggaccttcgacattcagacggaaatcaccgtttctggcgccttccatgccaagcccgcgactctcaggaacctccgtgtcctgttcagcaattgtctggggaatgttttcgtggaggaaggcgccacacgtcgcaaaactcatctctccttcgtgcactccaatcggtgtgtttcccctctcctcgccctctttgtcgttcaacaggtagttcaccacactggccgccgccgaatccgagtggactgtcgacaagttagagaaaacagggacaggtgaaccgaaatcctgcatgccgatacttcctggattgtagccgttgtcgaatggtctcatgtcatggcttgtttccgaaagctgcccccgttgagcgtggctgttgctgagcagggagtgcttggcggtaatgtgaacagtactgcgatcgttctttgcttgatgcaggaagccgctgttccacatttcgcgaatcgctatgcccgccggatggaatacatgttgaaagcgatcttcacggggaggagtgtgtgaagcttgaggaggatggaatgccgaaaagagctccgcgtacggtattttctcatagactggtagtgttgaaacttgagcctgtgcaccggagaaaccggaggaacgaccttgaccacttgcaggtgccctcaagctacggaacacctcctgcggcttcaaggtttcgtgggacattttgtctgtttcaggctcaggtgtgacgtcgcgcatgtttcctccatgcgttgtggaacatgtggagcatgcgttggagtattcctgtccgtccttggcgaaatgcgtttcccctctagcactcacagttgagtcagccgagcatgtgagaaacggtattggcatctcctcgccaccaggtagaggtctatccactctcctgagggacaaaaacggctgatccagctctttgggccggttgcttccttgttcaagatcccagaagggaggtccgtcgctgccagccgctgccggctgtagcaaagagctgttcttaggtaagtgaagagcaaagttgtctttggcaaagccttttgtttcttcctcggagcgagtgtcacgagtgtccttggatctgcattctgctttcttgtctgtaagttcgcaggactgagaatttgtctgcaacagctctgggttaagggcggatggttttggagtctgcacgttttgatcgttccccacatagtttcttctttctcccgcgccagctggccatggtggtatggctggactgaactgtgaattggattccctgttccagcaaaatgccccatccgccttaccaaaggaaggtgtgccccgttccctctgctccgcctgcgttttccgctgcgtcttttgccggacgcta

SEQ ID NO: 3633 - DNA, 2009 bp, Toxoplasma gondii
gtcttcaactggtggcatctctgtcttaaagcgtctactcttcaccgcctccgctgggctgctacatatcccttctctctcgtctagtgtgagaattgtgggctgcgcgtcctcctcagcgcgccactgcctcccccgtttgtggcagacgaacacagagacgaacacacagtctcccgacggtctctccggtctcgaggactctgcgtggtccaggtacgaaaaggatttttattttttctcgcttcgcttcgcccccgaaacgcttttctgtacgcactctctgtcgagccagaagaacgaacgacagaagccgacgcggaggtcgctgacgaaggtggacgcgtggtggatgtagaacgcagagaatccagtgaagagccctacgagggcggcgaggacccagacctcgagaacctcgaacagctggcgcttccccggtgtacagacagtccgcttggccgtgaggagcagccgccgcaggagagccgcaacatgcactgcgaggagaaccgccacgcggagcagaactgcgaaaaccagcagcgcaggcaccagacaccaggtgtacgtacaccccgcgacgcggcggccgagacgcagcagcgacgccggagcagccgcatgcaggcggcgcgggcgcggcagagctccacgtctcggggcgggagagaagagcggcaaaaaagaggcagcagaggcttcggagtcccctagaaaacgcgaactcgcctccgagaaatgatgagtttctgaatccttgaggaggatgcgctcgaaggagggctgtcggccgtctgtggagagggactctcgctcttcttctctctgggaggatagaggcttgagcggaatctcctgtggccgccgctcctggcgagaagagccggagacgagcccaactagcggcagcgcgaccgcgaaccctgaggctctgacttctgagaagctgtgcacagaggcagtctcgcgcccgtgtggagactccgcagaacacaccagactctcaaacagcggagaagattcctccaaagacgcagacgaagaaaacgggaacgaagaggggggagaagaagagaagcaacaggaagaagagttctctggattactcagcggattgggagcaagggggagagtcaaacgttttgatgttgtgccttcgttgacgtctctgtttagcgaaggaaaggagggcagcggcgcggtcgcagaaggcgcatgcgtggaaacggagtcgccagcctctcgctggctgttcttccccgcccccgtctgctgtatgtacacctctcgcgggctctgtgactcccttcttctcctgccaggacgaggctcttcccctccgccgctcggtgaagctggcatgatgcagagacgaaggggagggagaagaagagaaagaggagaagtggaggaagaggacgcaggggcagctagccgagtcgtccggagttactcgccactgccgccggtcatgtcgtcgcgcttttgtcgaaggggagacatgggaggagagtctggtggctttgacagagcatgagaaggatggacaatgaacagaaaggtccgctgtcgctgcacacagatacgagggcggtgaacggcgcgggcaggcggttcagcagcggtcctttgcagaagttgacgtagagaagagaacgcgagtctctgggcttcgagcaaaggatagaagctgcgtggttggtaccatctccaaatatcagagataaaagagcgtattttgtctccgggagaacgtgcaggccgcgacgctttcgatataggcacacgaaattggctgggcggagtcaaaagaggggggaagagtgcagaaactcgggcgtggaagtggagagagaagccgcttttcgtctctccctgtctgcgtctcgtctctctcgtttttctcagctctctctctcggtcttctttgtcttctctcggggcctctgtgtggctttgtcgtctgcgcctcgccgagcgcgggcgaggttggagcagccagggaa

SEQ ID NO: 3634 - DNA, 1499 bp, Toxoplasma gondii
gtttataaccgtatgctcctgaatgcccgggacgtgcagtaaacagaaaactcctgaacttaaactgaggagccgaaacgaaggtacaaagacatacaacagctgtgtctaggacacttggcgtcacgcgcacgtctgtgttacaaaaatcctgttggcatttggacgagtatgagctaaggggagaggatttttcggtcctaggaatcaggggagctcaggtgcgctgaggtggaaccacgtatcagcaaaaagaacctccaaggcatcactccgccaagaaataagcatcgacacgctgggcagctactaccttttcagtcaacgcggaaccactcgcactcttttttgcacagtttcctttacgtgcagaaggtgcacggcgggcaccattaaaatcaacgaggcgatttgtcttgcggctggtcacgtagttcaaactcgttgacttcagtgaagacgcgctgtgtctacagaagaaaagacgtggatctggatcgagagagtgaggcacatgaataagaaagagacaacgtacagtggacgaagccttacgatggaacacgcgttctggaggcggcttgttcaacgaatttcgtcacaggcaaatcccactgggtttacctctctatttcgactacttgggtcacctctgcaggacgagttctgaacctccaatatacagacagtggtacaaacaaatcaccatatcctccacacaaaaccagcacctgcagtttgtctgagagtatcaagtttgatcttctgcaccacccgctctgaaatcgtggttgaccatgcggtcgcacgacacctgcacatggctggagtcccacaagtgacaaagactaatccaggtgaatgtgggaagctttcgtgttgcgagcacacgtgatgtcgtacgcttgcaagttttgagggtctgctgaagctgcgtgagtcttttcctgcatgcatgcaaaaactacacatgcagagaccgacgggttttcctcaaagaaatgtcgccaaaattcgcctgtcttctatcatttcatggcgattatttttttgttgacttttcgttccatcagtatttctccccagctacttctcgcgtttagaaattgctcttgacaccatttgctgtaaaatcgaaaaccgtctttgtttcgcagccttgtaaaagaagcgtttcaccactcttgagggacgatcctgtgtctgcagcgtacgccttcttccgctcgtgccgtgtttcttctccaaacacacaggccgccctgtttccgcataaaatgacaaatcgctctctccaccgacttttgcgtcttttgctccgctcggaaagccgaccagtcaacttgcatgcgggcgactgcctctgacgctcgcatcctgcgcagatcctcgtcgttgcctttcgacttctcctagcagctgtcttagtcgatctgtctgttcggcgactcatcagtcgacagttcgcgttgtgcccgcctcttaaaacgctgtaaaca

SEQ ID NO: 3635 - DNA, 3798 bp, Toxoplasma gondii
gagaagacttgccgccagcagcaagactccaaggagtagcgcacatccaggaggtgggcaatgtggagtgtttagccttagttccattccacagacgcggattcccttccgcggggttgctgacgacttgttaccgagcgctccaaccggctcaatagacgcccggaaaacgcgtcgacccccgcgccattcactcgcgtagaaatgggcacgtcccgatgcccgccccagcctcttggaccggggacaaaggcagccgtagagaggaggactacctgtgtcccgctcggaggccgaggtgggttggctgtcaggcaagcgatttcgggaatcaggccaactatcggaattagatctgacgtttttgccgggcgccgacttctgccctcctgaaggagatccgggatcgccgcgcgaaccgcgaggtgcttctcttctgggcagccgacatcttggctgcgagtctgcgccacatggattgcctgggggccgcacatgccgaacagagcgtgcttcttctcggggaaacggaccttgttcagagaggcggggcccgtaacaccgagcgcacctagaggccttgaacacagctgcggtagcactgggattggcaaggcagaagaactcacctccaaagacagggttcttggaggacgagaccgtagactgatgtgacactgcttgtcccagcccggcctcatttgacatggaggatcttgtgctgtccatcttataccgcctggctctgtaccgaggcaatctcactcgactacttcgtctcggttgtgcgatcggagatccgtgcttcaacatgtgaaatgaagaacggaaatcgataatggggtagtcgtttttttctctggttgggcaagcagcgtcgatgtctctgacaatcgaacatcgcgagtcctgccgggtctccggtgacctgaggaaaatcaagacactctgggcacccggaagacgtcaagctggggcgacatcgatatgttttacatttcatatagtggtagtatagagtaaagcactctttcgacgtctgagtttcgtatacaaacacgagagacgtcgcaagttggtctaagtcgactgaaaccacggcaacgcggttaacatgaaacacactgtgacgctcaggcaatggttgatcttttgtttggtggcggaaaaaaacggcgatcgaaaaattaaaaccagtttcctgcgtcccgtggaaaccaaaaaaagatgggacgcctacatagattacacatgccgatataaatacggggagacttgggggacaaatgcggccactggcatgccaggaattacgtgagacttcgctgcacgcatgcaaagggggcattatgtgtgcgggagaaaatatcgcaacccgcagaaaaagctttgacatcaattcggacacatctactggggaaacagatcatttgtaggacggccgcgttcgagtctcctggttggccgtagtccatttgtgcgttggacgcgacaccctttggcaccctgcgtgccgcggttgcgaagcgcttccgctgttcggttcagtgccacttgtccatgagaaacaacacgtgaacttagaatggtggaggacacccaagaggcttcttacgttacgagtagggtcgtctgataacaatgcagccgtcaacgaacgggagaaggcccaggaatctcgcccttacaaagcgacatcaacataacatgcacagaaattttaatataaatacctacaggaccaatgacttcgacacacggtctgtcatctgcagaagaggcaggcagcttcatgaagactagcttttcgttccgctgacaccggaaaacgaccgtagactacagccgatcaaccagggctattcccattgagaccagtcaagctgctcggtcgcgatgtttcaggcagacatcagcgaactacgggactcgctgagtgctttcggggcgacacaagagagtccttcgcttcagcgaattccacagcctgtggcgacgaagtttgtctacctgacgttcagaaccgcggcatatgagaggttctacatcaacagttgctggcggtgggaatgtgagtgaatagaagtagcaaatgctggtagacactcgtagcctgtatctagtgatgataattttcagagaaatatttactcaggtgaagcttgcttgggcgagtccgcactgaaatagaacaagaccgggtcgccaagattaaggaattacagcgacaaaaggtcaaacactctgctgttcacttcctggagcattatcactttcattctgcgattcagccagcgttgacagaacaggaattactgttacgactatcgccagagtgtgcactcacgctctcagtctcctttgaacctttcactgtggctgggcgatgggaccgagtggcacgttttgaaaaggtaatctccaactttctaaagcttcagtgacgaatgaggatgacacgtccactggcacgtgggatagacgtccaagacacacggcttctagcgaacacgtggtagcctcagcttcatggccgctccatttttcgaagtgggcacgaatggtttgtgcattccaaaggttatacagaggtggccaagacgcaaacagcacaacttattttagtgacagcaggtgtgttgaatcgcacaggaccgccagtcgtacagagatacaaatagaacggaaatacctacaatactgtcatttggagtaaataagcttttttgacacatccacaatactgcatcagcgtacgcgcttgctgagatcaattacaatttcaggtcatctgtaacttcagtccactttctagccctggtttccggagttatacacggaaataatgtgcgcacacaacccgttcctatactgtacgaggccggcaaagctagttgttcagcaaggaggcaacccccgaagtactggaaggggaatgacgcgagggagtccggatgaaactagacgctctcggacaccagcactgtcacagggaataccggctgaacgagccaccatgtgcgtgataccacaagagctgtttatagcgcacactgaacacacgtgccgctcgcagcgtgtacgtaagcttctctgtcttgtcaatgtgcttgcttggcgcaatcattgttcatgtacctctcttctggaacttgttccttgaaggttgacactcacgcacaatggctaatcatgcaaatgtccaccgaagatgcaaggagcatcgactatatcattccacgagaccttttattttttctctctcacacgtgcacaaatatgctgcgggtgaacgcattgggaagttgtcagaagaaactgagcataatgcagcgacagcatctctgctgtggcgtgcaagacaaggacaccagacgacatgtaggtgggacaaggaagggcagcaccattacgtcatgtgtacccagttaattattacggaagtcttgttctttgatgccgcgttcagatgtgtctcctgggctccattctgatactgcattagattctgccagcacaaccaggaaaaaaaacgagtagggaagcagactcaagttcggtaattagcaagtctgggtcggtttcgccatgagacgcgctaacgagcgagatgccgcgtctcttttcctggtcaggtgcctgagaaagcgtcactcagacatatgctattctgtagcagcatacgtgtacagtgctagcagaggtgaatgtaatggcaatttctttttgataaagaaatacctttttgctctcgtgctaggtcgcaggtgccggaggttcccactgctaagcacaaaa

SEQ ID NO: 3636 - DNA, 3745 bp, Toxoplasma gondii
ctatctgttacctttgtgtccttgattccggcttttgcggaggatatgctagcctcttggtaccaatcacgatctgccttgtcatcgcgcgttagtccagctgttctgactctggttgattcacacaaacggtcccccattcagttcgtctggtcgtacacagcactttctctcgcagatgcggagcagcggacaggtggggtgaatttcgagaaaacggcagctcagatgctagcatgatcaggaccattgtgctgggcggactaccctctgaggcaggagcccaagcgtgttctcccaattcctttgtaaggtgaatctagattcagaagacaccgacacaatacgcgcccaggatagagtgtgtgttctcgaaggggcaagtacacaccgtacaaagattatgtccacatgtacgtctcagttaatatcgatcttatgttcgtcgctatcttcccggcttcgcactaccatttgtttacgcagatggcgactggggaactgcggaggatattcggagcgaggacgagagcgacacaacagagccagagacagaaggggggaattcaaagtgcaaaacccggtgattttttccttctccttgcactttggccagcatccaactgagaaatgtcttttccaaacacaaggctcctgtaaacagggaaacagcgtgagagtggtagagcagcgtttttgggcatttgcaagagtgctcgcgtatgcctcagaaaagggttgactagtaacgagaaacctggaatttgcgtatcgtcggtgggtctgtgtctcgaagtcgcgctgagtgttcactgtatttaaatgcaccccgtggcgtttgtgtatctgaatatcgaggctgactttgcctggtcaggaggcccttctctcggtgtttcctctcgaaaactttgaggacgttcgggtcatgcgtttctgatcgcggcctcggtctttggaccctggtatttctgttgtcaatttcgtttttctcgtgtcaaagcggccgagacgcaggttgtttttctcagaagagcggcgtgatcgtacgtgtgtccacacgtatatgcagtaacgcgtgtgttctttatgtctattcgcccctcgttgtcttttgtcatgtcgaggcgtttctctgttccgagaacggccgcttggcaatggaaaaatcggaggggtttgaacacagtgctgttctgctctcctttgtctttgctcccgcgggagtgcagcgccaggccacgccgggttcctgccaatcgctactgtgagacatgcgtcgcggcaaaaacggatcttgtttgtttccaatctgaaactctgtctacattcctaaacgagagaccttgtcttgcctaggtcagaagccaatactttgttttcaaaggcaagctgacttctatgggaaggattagaaaacagaaaagaacgcacgcttgatcggaccgtttccggaacggactcggatagtctcctggctgggacaagtggtccgcgtccttcgttatagagacgtaaaacagatgttttatcggccacttttcttgtcagtgctcttgcggtcagctgatggagggtttagggtaattgagttttcggtccgtcacagttgtagggtcactttgtgatcagatacatcgacatatcagtatgtttcggagcggagaacagtagaaaaagcggacaggcgggctctcaagggatgtgatacagacatagtaccaccgcttttcccggtgtgtgaaagctcgcttacacgtttggtgtcagcagatagtagtggcatgagtgcgtcttcgtttttgtttagaccagaaaaggaaatgctaagttgaaacactacgccagtctgtaggaggctcgatgtctgtcagcttcgctggattgcaacattttgctctggacaagcgtttggacgtttttccgaccttaaaagtgaatgatgagaggccctgaaagaacaacacgagcggggaagaaacacgaatagctccgtgtcgtctttgctgcttctgcagattgctcctgtctgtgcgtagactatcgagggaacagaagttttccaaacgcttccaatccgaaagacaaacaaagtcagaaaaactttctttctgctttctgaaattgccgctggtatcattctcgttttcagaaacccatttccagcagttccccttcgaaacaccgagagtcctcgagggtcgattcgcgttcccttagggtcgcgaaggcgccttttgtgcaccttgccaggaagcaagatttcatgttccaacagtttacgcggagagcgaaccctttaatcatacggagacatgctcgaacatgcgcgcgaagtgttttttttctttgagatttcagcacgccacagaacttggaagagatattttgcgcgtatggccgagctgattgccatacaactgtgcgcctcttgttttctttgccaggagttagaaattgagggggatagcggaggcgagagatctggtgtgtcaatcaagaacgaacaatttgctgttgttcctggcgtgtcaatgagctttttctgccagcaggttgactcgtggggtcctcccctcagttgccggagccgcttgttgagcctgtaacaggtcccgtaagatggttttcttgtccatgactccgtcacgcgtcagttgttgatttcgttccggttaaaaaacagcctgcattatttttgatgaaaggagagcgtcctgtccgctgaacttattgtgcgatactaccatttgtacagtgcctacgtgcttctgaagaaatggatgattctttagaaatgcacagtgcaaaacctttgtttggtgagcatacactacgagttggactataggtttggattttgaaggtctttgtctattgttcaagtatctggagcactagcgacgcaagctatggttcgactgtcgccgggggccaccgtgacgaatatcgaaaagggttctcaaggtgaagtggctggaaaatacagtggacggatactttcttgccgccttgatggaatccaacaacacccgtgtattcctgtttcttgtgacagagaaacgggcaagtcgtaaaatagactcaccagaaaagggtagttcctgtaagcgtaagaatcacactctataatgcgtaacggggactgtagcttcagttgttatctggtcggtgctgcacgcctggtgacatactgtgactctagcatggtttcgagagcacgcaatagatctatgagtctgttccgggcacaccttgtacttcataagtatagaatacgggagttctaatctgcgggttaccccacacctccatgtcggctcattactaccattctattgaacacgattccgtttcgagcgtatagttttagagtggaacgaagcttcggcctcgatacggtgtcctcgttccctgaaaaatgaacctccatatataaaggacaaaacgtgcaacagacaggatctctacttctagatttcgggcttctctctagaattcaccgccatggcagagtcaacagaggagtcaggtaagggaatggattttgtttgctgcggagggtgcacagagtaggctgcatatttctattagagtcctgcgcatccaaccgtaggttgaggcccagcgacactaatcatacagaacatgtccattggtcacttatctcccactccttccgcttttatagaaaatacctcgtgtacatgctagagagaccatctgtggtcgtcgggggttgccg

SEQ ID NO: 3637 - DNA, 3748 bp, Toxoplasma gondii
ctcggcctccactgctgccgtccacagcatggatatttgcattctggcactcctccgaattcggagacggccctgaatagctgtcatgttgttttgaaaagcctccgacaacacacgatgcgtgcgaactcgacgcatcgccgcccaggtcgggaccatcttgtgggcttgaccatgtgcttggaaaacgacgctcactgctgagacctgagagactggctgcctcagcagaacctcggtcggcctccctactttcgtgtactgcatcgacggctgaagtggttcttccagagtcgagcgagtcactttgtttgctggcgctcgtgtcatttgctggtgccatttgcgactctagcgggagaaacacgacgtgcaagataagtttttcttacgcggaaaacaataatcggcacgcgagaccggagtggacggcgccacagggcacaaggacgcatgaagaacaacaggggaaaaaccagcaaaagcgtcatttgacggttgtgacactgagacagctgttgcctttgcctgtcgggcaatctgagtagctaaacagtaaccgtcattgggatggatgtacaccgggagcgtttgacagatgctgcagaaacctgccggatagcggcctccctggttcgagacgtaaacagggtgcatcagctctccttttggaaggaaaagagtcagtcacactacgtgtatgcggctggcagaatggaaatgtggttcagtggttcttagaagaaaatcggcttctgaacgacgagaaatccaagagaacagacgcgcttggatggacgtcctgggtgacgctgcctttggaagacattttcgggaataaatgaaacgcactgagtacacaaagaaataggcgaaccactgtgacgagctgcatcctattcatttactacagaaatggagatttcgcttcaaagtcgcagacaagaaggactcgcgcctttgcgaaagagccctgagaagaaccctcagtggccgttggaaaacagtacttggtaggtcgtttcagacagtgcattggcgtcagtcttgaatcgagacgcttttcaaaggtcagtgtttcccaggagggcaaaaatctaaaacgaagtgtctccaagcaagcgtttatttcgaatcgatttctgcgggaactcagagagctatctgaacggctgctgcatgcgcagtaaagtcggaaccacggtccggcgtaacaggatcgttcagcggggactgccaggaataaaagcagctaaaacgactctttcaagccgttgttattttcatttgccacgttcattcggtgttccttacatgggggagcgctgagaaagctcgacgtgctctgggtggccatgtctgtgtgtgtgcatcatggtgactcaaaatttgacccttgtgagcatagttgaacagccgcgagtgggaacctggcagagtatttcggaacagagcatgtgcagaagaagcagagtaatccacgcagcgctcgcgtgttagagcagttcttcagtttagttgtatactgttgctatatagagtgaaatgatgtcgcctgtgtagggaaacacgattgttaccacccaactgtgtgtgtgtgtgtgtgactccaaaatcaacccagttgacaagtgtcttttcctgccggcgttgtagagtgtggcgctaaagttgttcaggcgaggttgttagggagttgtccttcctggcacatagcgacttcgatggtttaagtgtggaaactgtggaattctagctcgcggaaaagaaagatggagttgcctcgcaaatggtgttgcggccgccgctgtgtggtggcataccgcccacagtggagtcagtttacaaagagagctgtgtcgagcaaacgcggcaaaacagtgtgtgtacgcggtacatatggatatgtgccaggagaaggatgatccgcatatcgggtacaatgactaatgaagccgtcatgatagcgtcgtgcggtactggtagtcaaattatcgcccagacaaaaggaaatcgctgggcaacaacagggcagtggaagcgctaacgagaatacttttgcagcaacaatgccagtggtcgcaagaaagtaaatctgaaccagcgaacttcagcttaccgaggcactgacagagctgctctgtaatgtaaatgttagagttcgaacaaacctgttaaaacgttaccaagccgaaaaatttgaaagacccgcttgtatagacgttcttcgtcggaaaagacaatgtgtcgtcttccctgtgaagcagcacagtgaatacactcgctggcgagacgtccatgatactggcagccgttcttcgtgtttgcgtgataggggcgcagccatggaattggtcaagagcagactaacgcatctggagttaccgaggtcctttaagctatcaagaaaggagtgtgcttacttttttttgagctgagggtcttgttttgacccagaaaagcaagcgggaagggagcacctcagaggttgactggtcagtagcagccctatccattcggcagccaaagccaggcctggaatgtccatttgagctctttcgatttgtgtaggtacccgcattacatcaaacttacggaatgcatccactttcccgccttctgtttttctgtcactctccacctcggggcagatgatgccaagacggtgggaatgttcttgcatgacttcaaagtcgcaggggactgtgtgatccagcccatcctagagcgctcacttatcagagcagtcgtcgactttggagcggataatttgttgacactgaggtaaaagccgtcattggccacacattacctgaagatactgctgttggcaggtgcggtttcgttcctgggatagatgtcaaaaggtttccacaattgccaagtggacgaaaccggcttcctttacgaggcggtgtgccttttttctgcatcgtagagacaaacgcaagtctgcacgttgttccccactttcagctatctcccccaaacaacgtaccaactgcgatgcaactggtttcgtggtagaaccagtttgcttgcttgaacatacttctcagtggagtgtccgtgtcggctataatctccggcaacagcgttgggcttcgttcgattcccagcagctgaattcctcattccgccgcattttggggggcaggagtcgtccctcactctgttgacgcgtttctgttggttggtcgtcgttttttggggcacgtgtcagttgtccatgcgccgaggcgggtatgaggcgagtgctcgttggttagagtgcgtactccaattctctgaattgctttatctcgtcccagtttgcggacgtgtcgggccatcagcggccttgttgtctgtacttgcgtcgttttcggtccaagcaatcaccgttgtggttttcccggtccgcacgactttgctgggtttcccaggcggtcttcattgtctgcatgttttctccatgtttgtcatgccgagagggactggtcgaggttactctactgcactcgtttgaaggcatacgaagtgttgattacgcattggtttctgttgttattttgagtattcgcatgcacgccttttctgatctgtgtgtttggtgcgcgtctctaacctataaagtcaagcgaagaatctattgaaagcacgacgagaaggaaatcgcgcgcttggcgtatgcctcttcagcaccctcttcagccttgtcaggtttagatattttgctactggctgctttatttgctcgccatcctga

SEQ ID NO: 3638 - DNA, 1731 bp, Toxoplasma gondii
gggagttcactgtccttctacgagaggcaacagagacgactcgaccgcgctcagaccctcagcagggtgaaccggcaacggcgaagagtggaagtcaagcactgtttttttcaggaggagccgatcaggacgggagcagcattcatgaagagagaactcagttgtcactctttcctgaacattcgcgttgagcagacacgaaaggtctcgctgcttctccggctgcaggccgagttcctctgaaaggctggcgtctcgagcgcccaggctttcacttcgaaactgcatcacgcttgttgtacctgggcgcgttcgttgaggaactccttttcagcctcgatgtaccacggggacttcggcgccctcgtcttcaacgcgacgacgcctccgtatcgatgactcttcagacgcgcaactccacgcctctggtctaaacaccatgcagctggccggcctccgagagagggaggagaaagaggagagggagaaggaagaggagagggacaggaaggagagagagaagagagaggagaggaagaggaaggcgaagacgcagcgagaagcgagggataagaagtcgagagagcgaagagaggagaagaacgagaagaagaacgagaagaagaacgaggagaggaagacgcttcagacagggacgaggagagcggaaggggaggggaagcgcgagaccgggccgaggacctcccgtcgaagcggagaagaggattcctcttcgctgctgcccccaacgccttggtgggcgagaaaatccgacgcgccagagaagccattccacttgaagagagaagaagaagcagaagaagacgaaggaggagacgacgcaggtacctgccccctttaagaaaggtgcatcgatgtcatcgctgagttggccaggcaagttgacttgaagctgcggagagcggagaacggagagttgttttttctctgggagagacgagttctacgaacccagtgacgtctcgtccgcttcatcactgggagcggctggtcttccgccaggcgcggcctgaagccgtacgagcagccggctgagggcgccttcgctgcgccgaactcggactcgagcgaactgcgaatcgcggcgagaaatctgttccttgccgaccgatcctgaagccatatggaaaagcctcgccgcaaacaagttggagacggaaacgacggaggggaggatgcggccaaggctgtcgggggctgtcttcccatgtgcatgcgcaccgaaaagcgtacgtctcagcgtcgatactcaacttctgcggggacgcgagtctcgcttgtttcgtcggaaggttcgcgtcgaataaatcctcgcagattgatcttgcttttaccgttgtctctgcttcatcttcgcgttttccagcgcccatcccctcctgcctccgcgcggcttgcccctcgcgactgacacaccgccctgtgtcgttgagtcgtctgcagtcctttcacggtcgtcgtctttctcctctctgctctcccactgtctggccagcatccagagttttagccttctcttctccttacgcgtccttctcttgttctccctcttctcccctggatgttctcctcgcgcaactgcgtttcagcggcttcgcggtgcgaaactggtgagccgtggacgagggtgtctggcgaaggatccgaaggaaggaagaacagaatccgaaggaagagagaagcggcgagagtcctcgaaagaagtcaaga

SEQ ID NO: 3639 - DNA, 1991 bp, Toxoplasma gondii
gcagaacgttgccggatcatcgatggttttggtccctctgttgaatgacacacagtcggcatgctttgctgccataagtgtcccttttttgcaagtttcgaggagtctgaagaacagatcttttgtttgactgcacgtcggccctgcttcgtagtctgaaaattgaactgcgcagactgcgcctgcaacgtctttgtagcaggactaatccaacaagatgcaatagttgaggtaactagaacaaacaatttggttgtctgctcactttgtcgctagcgccgaatctacgcaacgtatcctggcaattacgtaagatatggagctgacgacgggggaatgctgcgccggctctgcttacctcgcctagtccccgatagggttcgcaagactgagaagagcaggcgagtgtagaaatggtatttcattaaatgaactccagcgtacctcaggtgttttgtattttgcgaaccgctccccataattgctgacaccactactgacataacggcacacagcattctgctcgcatgaacttcagattaggcgtgaatttgggggttagcgcggaagtgcgagggacatactgtgtttcccgttccaagaggtagttccgccgcacgggcgacagacacggtgaagagaacccatagaatcgagagctctgagaggagtgacatcttgagcagaaatatccaaacggaacattgcctcctgaatgtccaaatttccggtggaaagcatcttacgtaggcgtgcggcagcggactcgagcggtcttactagctgtacagacacctaaaccacaccgggatttcctacccgtttggatacacttcgtcttctgtattcgattaccttcgagaaccacaccctactgtcggcggtgaaccgattcaagtgattcttgtgctgcatctgtgcggcactggagttaaaatgcacgattttaacagggggggttcggaaattcaagtggacagatttcggtcgcaggctttgctctgtggactgaatgttacgaacatcataaacgatgtgtatcggcctcttgcttctggctcgatggagctatagttccacttgttccatgcagtaccttaccgaaatgagacctgcttcgatgctgcaagcttttctggcggaattgtcgcatgcaaaatgcgactgggctggcgccgacatttcagcgccttatgttccacccgcctgaactggcagtactacttccagtccactctcgcgttagaacatcatatcgttccaaatatcttcttagtgcgaaacaaacaagtacagaggctactttgcaattggcacatcccaaccaagcacctctgtagttcttcttcttaggctatgctgtgagggtaagcgatgttctgcatgcagacagctaactacgtgtgtttttgattccgcaccttaggtatcgcatattggtagcggcggggggaacggagttttcagcatttagcggagcagtatcttttcggtgaagcgtcctgttggccatcatctttcaaaaactattttacccctaattccagaaaaaagttccgactatttgagcacgtgaatgcgtcaactgtgaaagaggttgctgtgtcagagattggggtcgcgagagttattaagctgtctcgtctgctgatcagttatgccagtgtcgctgctgttcgacatactccttactcggcgctcatcgcttgtttgctgctcgctccgtactgggcgaacacagctttagtttcggcaaattgaaagctttttcatacatacagttacaccgtcgtgaaggccgggtgtgttcgtcttgagggcgctgacaggtgaacagtttgtcccttgtgtcggagttcttcgagttgctgtctctttcgtttgcagtcacacttcggtcaaatcagttgaactgcttccgctttattggacagctcgcatctggcgattctcatgtgtgctaggcatagcccaagccagcgaaaggcgta

SEQ ID NO: 3640 - DNA, 2237 bp, Toxoplasma gondii
aagagttagacctgcctcctccttgtcgcagctgttgttgaattcatggggggccttccgcaagcaggactgaaacaaagtcttgcgggttgtttacactgcgtggcgacaccgagttttttgtctttcgagttcgtcgaaaattgtgatgcttctttgttacctgacgcgggcggtgtcaggacgagttcacatgcgcagacgagaataaatgtgatgcaaagaactttttcggtgtcatatcagatgcgttttgctgtctgtgttgtgtctccttcagatacgcgaaagccgctgtggcagccattgagaacgggagcctgcgtggcccgacaaccatttccccttactgcgtccatcgctgcattatttggctgtccaacgccgttcctcggaggatctgggaggccgcctacctgcctcggtgtctgtctattcgcaaacgcgcgctgaaaaagaaggaacagcaagtaagtcacgaggggagagaaaactgtcaaaacaatcactcaatcgaatatatcagcttcaaaaagtgttttgaccgagaaacacgaaagcacagagtaagaaagtggaacaaggaagccgaaggacggcacagacacagcgcaagatctgaacaagatgcggggaagtgaaagggaaaggacagacatcgcgtgcacactttgaatcggtgtttttcatgcaggcggaggctaagaaggacatgtaaaaggcggcggacaaccgacgaagttgtactatgttcgaccgtttatactttcgtccaacgtggcagtctggtagtctcacgtatgtatgtcgcgcagtggagcagagcttcgatcgggggacatgtctctgcggttcccctttttcgtgtgtaagaaaacgttgtacggtacaggactgggaagcggcgttttatcccctttcctcgtggtttgtatcttcgtttccgcagaagccaactgtgcgtgtgcagtcagttccggatttctctctggtgtgcacttgtcgtcactcgcgcacggcatgcacggatttgcacggagaagtccgcaaacgagaagtatcagcacaagtgataagttcaaaagctcttcggagttctgagctcgtgcttgtagcggaagagaacccttccttcacacgcacacttgttccgtttcgggaacgcgcaatcaacggccacatccttcactttgttacgttctcttgctcggcgcggaagacaacgtgactgtcgcagtgccttcgaaatgggtggataggaagtcagccgttactgcaagcacaaactaatcatcacaaaaagcacggcatcattggaaagtggtgcacaggaaacgtacactgggactcggcgaccggtagaaaacagaccctcgcgcgctcttgtctctactctcatggtggctgtaaaggcttcctagtaattgtcgcggaaggaatttaggaggggaggatggaaattagtgttttctgttgagaaggggaaaatggattccgtcgccgggacttgaacccgggtcgcgcgggtgagagccgcgtatcctaaccacctagactacgacggatgtgcgcccactcggcacacgagtactgattgaggtaggagaattccagaagagcagttcactagcagtgattgagtctgcagagcagctattgaagaagcggtgacaaaaagactgatggcgattcactgaaagaaaggtgtgtggcttagatcagccggagggagatctactgaaggcggctcttcggcgagggtgacaatcgcgagtgtgcacgtttcctgtacggtctaacatgcgaaagcggtgatttttcgtgttcccccagtttttggcctctgtcacaaatgacaaaggatatatgtccatcagttgctgcatgcgcgaccgagataactgaagtttgtcatgttcggagcagttgtctttatcagacgttccctaaatcgaaacgttgggaacaactggttgtttctaaccttccctgcctctacgtggttttccgtgtattcacgggtttcattacacgttaacggttccccggtcagtgacttgccgttcttttttgcctcgtcgctggaacagctcgagacgtcgatcgtaacttgttagacgagatctgtccagagtttgctcgtaacgcccaaagcggaaagttatgattctacctctcgttgtacatcagtcttgtactgcaaatgagaaaggaataggtcttctcggttttctgta

SEQ ID NO: 3641 - DNA, 1702 bp, Toxoplasma gondii
ctggaactgggtcatggaactcgtcaactctcgtcttgaggtctctcgcgatggcatgttcacctcgccagtatatgctgcgtctttgcgtccgtgacaggaagaaatggtaatttttatttcaagaaaagaacagggacgttctctgacactgccgtcatctccctcctttgtgccttttcattttattcattccggaaccttcctttgaacgcccctaaacgaggaaacgcgtcacgagtcaccattcggatacatgaccgcacatgcagtcaactgcatctctgcatacacgtccactttcatatattcatatatatatatatatatatgcaggtagacaaatcgatataaacatatagaggtgtaaaaatagatatagatagctagggatatcgacgcatagagagataggtagacagggagagatgcacctagatgcagatgtagaaagagacacaaactggtagaccgatgtcactgtagatacaaagaggcacagagatcgagagacaaagatatcagcagagagagatgcataggtagtccgagaggtaaagacaggtgtagacggttgctcagacagccagggagacatgtcatcaacagttgttgataggcagtagatgcagtcagacggatatcgacagcagcggaagtcgacacacggtcctttgcaggcgacagaaaatcgactggtgtacacgggtgcttctccagttctgcaacgcggatagtctgtgtagcgtctgagacatgaagaccaagacttctcgcgaacagtgcctggttcctcgttgtcctttcatcgtgtgtggtttttcgtttttcgcattcagcttctttgcggtctttcaatggcttctgcctcggcgcaggagctgaacgtctcgccaggaggcgcagagggacttggacgagagaaacatttcctcgaaaacgcaaacggaaaaagaggaaaaggctttgtagacgggacggcggaaaaggagaagcgacccaaaaaccacggtctggggaactcgactgcatgcacacaagaaaagtagaactttcgagtgccccccatccagtaccaccctctttgtcttttctcttccgcgctctgtgatttgttctcttttctccatctttttcgttctgcttgcaaccttccattctgatggtcttttttgctgctgatcgcataaatttgtgacacaacggcgcatgtcacctgtgaagtttctctcgtgtgacctcttgcgtcaagtcgcccaccgccgccgtctcctcttcctcgttttctgtctccgtctcctctgtgtttctcttctcgtcgtcttctcctgcgttcttcctttcgtctgtgtctttgcagcttcgtccttccgttggagctccgtcctgccctccttcaccctgctgccctctcctctcgacgctcttctgctggccgcttcggccgcgcctttcgcggaacagacgcccggcggagaggcagaagccggtggaggacgcagcggagaagcgaaggagagaagggatggcaacgaaggactggactagagagaagaaggaccggcaagttgaaacgagacgaagaatagacgcaggttgaagaggagacgagagggagaacaaggacaaggagaagagatagaagaggacatgaagcgcaactaggaaaactccgaaaagaaggagaaagaagagagaaaaa

SEQ ID NO: 3642 - DNA, 1977 bp, Toxoplasma gondii
gcgttttccggatctttgccagatctaaaactggactggtaaattccattgcacacagacagagtggtttcacaaggaagctcttttgtcttcactatacactaggtgaatgccctatttacgcaaccgtttacaggtgattcatccccttcctcgtccaagagtctaggtgtgcatccaaaaagaagacatcagagggtctctgactgtcttgaggacactggaacgctagacgtctcggtcgcgatagaaaacgaaaaacgtagccacgggcgaggaagccgcaggcgacgaaacccaactgaaacaacgacgacgcgattcgaacttgaacttgtctttccttctctatctcctcacctcgaacaacaatttgcacctcgcctgcatgcgacgcccgtcgagaaccataagaggcgaggcgacctgccgacggagtgtacgtacactcaagagaacgcgtggcggaggctcgaccgcgtcttttccgtccttcacatgaagaggaactagcaaagccccagtgaagcacagacgtccttgctccgcattgaaggagacagcggcggacgaggaggaaagagagatcacaggacctgtaaaaaaagagcagacacacgagacaggggacaaagaacgcgagatgacggacctgtgggaatgcatggggagaagatttgacagatccgacaaggacgagcagatgcggcatgaaatacaagcggtttctatagcggcaaatgcagcctcgaggtcaccaaaagcgtcgcccctcaacaagggagacagaactggatcttcgaatctgttgaggtcgcagaccttcacatcacttatgctagaattttatcggaagcagtttcctgcgtgaagtcttttccagctcgagttcttaccccacaacgccattttagaaaagtttttctccttgagcttcgagtgcttttgccgccactgagcagcgcgtctcctctgttgagaggaaagggtcttgggacttcaaaaggatttgtctaggaggatctgttccacgttccgttcaaatctaagggaagccgaagaagatagtcgcagctcctctcgttgtgccactctgactccgcctttcttatgacctctgtctccatcaacgagcctctttcgccctcgacacttgcctctgtctcctcagtccttcttcttcttcttcttcttcttctccttcttcttcttcttctatttccccgttcttctttgaaataggtttttatgaagtgaccagaatttctcgactgtgcagcgacaagccaatcggcgctctcgacgctctcgcgctgctgggtctccgtttctctctctttctctgtgactcggagcagcgacttggtcgagaaaagaccggaaatcacaaatgcaaggcgccgcactcctgcttcttgcgtccgcgaaacgcacaagacagttggaaaagtacgaaggaaagaggtttctccgaaaaactaagaaacgcgagaagaatcgacggcaagctgacgggcctgtggggctttcgcgcgaaaagtcgaaggctgctctgcaggccgaagagacaactcctttctccgcatcctctctggtctctgtaccccccgagttgtggatgacgcttgcttaaatttgcagaaaagactctgcaaaagaaagtgaagcggctcctccacacgcgggccgccggtgcagactgcagtctctcctttctgacgcttggcgtttccaagggaaagacccctctgttgcatgctagcgataaagcggatttcctagtctcgtcgtcgtgagactgcatcgtgacacgacaaacgacaacgaagagaactctttagggagagacaaacgcgcgtttgtctttttcttcggactctcatctccttccgcttccagtgtctcgtcgtttcccgcgactcgcgtctgtcttctccccgtgtgtctccccggatttctgccaagaagtcgccaaaa

SEQ ID NO: 3643 - DNA, 2280 bp, Toxoplasma gondii
taacctgctgctgagttttgatgacgtcaagcggctgcaggatgctggcacagacaatgccgctgacggcgccagcaattccagagttcattcgggcgctcttcgtctcctcctcagtgcgctccaaccggccattgccctccttcttctcagcagagcccgggagggaagaacatgctacgggagcagggggacgcagcaaaagccgatagggcgagctgagcaggcccgcggcaggtccggagggaggtgcgttgcgaggcgtgcgtccagccgaagcggcagccaggacaggcatcggacagactcggtgagacgaatggaagagagaaagagacgacagagaagagaggggagagggagaagagagggaagggggagaagagagggaagagggaggagagagagaagacagggtgggagacgggagaggggaataagtggaacaacggagagaaaaagtgaagtcgagaagagcctgtttttccgcagcaggaggctgcagcgtcgccttttcgcgacgggcacctgaagcactggagtccgccatatcgacaagttaggcaaagttgacacggagaaaaacaacgacatgcggcgacgctacacactgtacagcccctccatgtgtgaactggacagtgtgtcaatccagactgagaacgaggggctgcggcattattcggtgcagagtttcgccatcatctctggtcccactgggtgtacatgcactgagacatgggggaaccgagcagcgatggtctgggcgttgcttcgttcagcagtgcccgctgccttgttcgcggcgctctccagccttcttgttccccctacgttgtgcgtgtttgcatgcacatcgaacgggagaaaccgaaaagagatggcgacgaggcacacaaaacagggactttgaagctgagaaacgcgacaagcctctgacagactcagctcccggaggcagcgaaacccagacttacgaggcctcaggtggacagctgcgaagagcgggacggtgtatcgacgctctttgacttctgccacagtcttttttcgggttttctcgtttctctcttgttatgctcacaagaagaaagaacggaacacatgcgctttttcgcttcgtctctccacgcatgtgctaacggactcatccaatagcaaaggaagaagtgaaatgaggaaggtgagagacttcctcgcgatctaagtcaagttcctcggtcgttttccagccaggaactcactccgttcttgctgcgtcctcgctctcagtttgcccgctcgtggaactctctttccacagaagaagcgacagaacaagtattttcctcccaacaggagaacgccgtagtcctcaaaagggggaaggaaaacagcggaaagacacaccttgcgaaaaacgcaagcgcttgcttgccgtctgccgtgcaggcttgcctcgagccgcgtcgaagaccttttctgcggtgtacttacagctgggcgttgccaaggcgcgagaaaggcgggcggatgtctccgtatatacgccgagacatgggcgcaagcacagcaacaggcgtcgctctaccgggcgcagatgctacaggacacaggccggccctcttctctctcctctcttgttcctggggtctatgtgacccaaaaagacttcttctccagcgtttcctctctcgtttctcaggtcttctctcaggaactctctccttcgcttttcccccttctctccgcgagttgtcgcttgcgtcacgaactccgtcccacaatcgcgcgcactctgaacgctctccctcctttttcgctcttcgctgcagccgctgcccgcggaaaacgcttcttttcctgggaagactttctttctgtctctctgcactcttcggaggaaccagttaactgaccgcacgaacggttgtcctgcggtgtacatacaccccaaaagtcagcgactacttcccaggcggaggagagaggatttcttgttggcaacccgggtggttctcgcgtgtgctgcggcggatttcggtccttttctacacacagctccttcttctctcctttctcccctcttctttcctctcgcctcagctgaggagaatcagagagaaacctctgcacaccttggacgaagttcgccggtgacgtctgcgagcccgcttcgaactctccagcggattcgtccttcctctcactgccttctgctttgttgccgtcttcctctccgcttttcgcttctcctgccctttggcgttttccgcgtttttcgtctttcagtcttcacca

SEQ ID NO: 3644 - DNA, 2116 bp, Toxoplasma gondii
gatgtcaccgcagcaaaagacctcacgtcacgcgacgaagtcgaggacgcggaggggcgagcaccgcacccacctgctccgttttctgcatgaagatggtcggtctccagttctcgcgttggccgagctctcagcagcgctcctggcatgttgtcgcccgcggagtcgccgagagcttctgggaagcgagcgagagcgcgtgtgccgacggaccgatccgcgagaagtctgccgccttcgcgacgggaggggattccccgttggtgcctgctgccttcgaactttgcaaatccagccgacgccggggcgacaggaagctgcgcggccacccagtggaggaagagaagccatgacgtcatcgaggtcgaagacaactccagtctcccaaaggaggagggaacaccgaacggaaagaaggaacagacggaagagactggggaagagggtgaagaccctgcgggcgagcacgaagcagacgccccgctccttctgcgcttttgtctctcagcctccatttcgtcggcgaggcggactcacggtgctcgtctcgaatggacgtgagttcccgatccaagttctcggcgcgcatctgcgagtccagtcaggcccagatgcctccttcaaggcggcttgtctgaccatgaaactgacgcaagaatccagcctcgcggagaggggaaaagaacgcgagaggactcagagaacagagatcagccgcagaaacggggaaacgaagagagagaacgacggcggtggaagccagccgggagggaacctggaaggagagaccgaggacagagaagatcgctcaggagagtagaggaaacaaagccgagaaggcgaaagcggagcgaaaagcgtaaaagatcgaacaaggagagactgagaccgacgaagggcgtaaagcctcttcactctgcacggagggcagaattagccacaggttgcggccccgagatctggctgaatccggatcgaaattacctgttggtatattccattgcacgggacgcgtcgaaaagaaaggttttgcatacgcagagaaacgacgactgaagccaaggagaagagagtgaaaagcgaacataaaaaaagaaaaggacagcagatagccgctcgcttgctcttccgtttgacggcgagagcaagaagagacgcctccagcgggaacgaaggattgagagagacaacgataatgtggaccgggaagtgagttgaacagaaaagtttcgtttctaaaaatcgacttcgtttcacctctttcttcaggttggcgcccccaggaatggggaggtcactcgcctggcgcttcgccggccgaagacccccgaaaaagagaagtggatttccagggcaagacccaggcaaatggagaaggcagagagaaaagaggaagcatagacagggaagaaaagctccctgaaacgaaaaacagagaaagaagagtgcctttccggctcgcccgcccccgacattcagcgaacgagtaggagtttttcttccagccgggtttgtgtgtgtgtgagtgcgcatgcggagaatattcgcagatcgcatgcagctccttttccccgtctcgtgctgtgcagcgaatctgttcgtcttccgtatatctttcttctcttcagttatcttcttgcaccgtttccgagtttcatctgctttctctgtttctctgtaaaccagagtggggagaggacgcgacgctcttcggcgaccgtcaccgaatagccgaggagagggcgctctccgccgttacctccctttctcctttttcttgtctccttcgccgtcacccttccctccaggttcctcgtcccttctccaaaagttttcccgctcatcgtctgctccagattggcgagaggagaccgggtgaggaggggcggaggagaggaacggaggaagaggaatcgcggcagaggaagagagaagggaggaccgaaggaggaggcagagaggccacagagaggagaacaagagaatctatcagcaagagaaaaagaggagaaaggacagaagaaggacgaagttgagagggagggatcagaacggtggagggagatgacaaatgtcgcttagaaagaaaaaaggactggcctacttatcaccacca

SEQ ID NO: 3645 - DNA, 1121 bp, Toxoplasma gondii
aaacgcatgcaacggtgtgcttttgtctcgtctgcgtctctctgaacgaggtcagggagccgctctcgtccccctctctcctttcaccaagcccttctccttcacattagctctttggagacttcccatctcgcgccggaacgcccctcaggtttctccattgtcatctgcgcagctgctcgacgcagtcagagccttaatcaccgtcaagcgtagaccactgcacagacgcgcatgcagctcaacacagacgaagagagggaggagagacggagagaaacgaagagatagggaaagagagagatggagaaaagggcagagcctgagcaagagacggatcgagcagtgatgtttagacagaaaggttgacagaagcagagagagtcgttgactgatatcgacgagttcgtttgcttgcagaagatagcacctccacacgccactcaacgccttcaccaggtgtacagacgcacgatagcccggtctggtcttccccaggaggtttctgagagtttcatggatggaaaaaaagaaacatcgagtatcgttgtctctcctctcacttcctttttcagcgatgcacgtctcttcttcgcatggacggtcgatcctgcctcgcagtgcatgcaggagagacaaacgaccccagaataccacacggggaaacaggagaactcgttcgtaacaaacgaatgcatgacgaaaaaaatcaaaagaggaaacggtggagttcctactggaaagaaagaaacgtcttccggactccaacgtgactttgccgccgcgcatgtacgcgcgaatgcacaccgcgtaacgctctcctcaacgaaccgaaacattcaaaagctcttcaatcgaaaaagttttcctcggtaataagcagaaacgtgagactcgccgaaactcaaagaaaaaaagacactcaaagagagcaagagattctctgcaacaagcaggcaagagtttttgcggtccgcgagttgtgcaagagaatacgtggagcgcatgcgcggatatgcatgcagttgactgtatgtacacccgggagtaagcgatactacaggagagatttctgggggtgaagcaaagcagacaagagcagtttctctctcttgggtgta

SEQ ID NO: 3646 - DNA, 2524 bp, Toxoplasma gondii
ggttatacaagatagtcaccgtaagcttgccagaacgacgaagcaatcactgcaagacttccgtggagaagttgggttacgaggaaggccaacgcttcgtcgtgtgttcgtatgtcaacacgtcagcaacaatcttggtcccggatgctccaggcagaatggaaccgtggcgggtcccaaaccattgttggagtaacagtgtgctgacggaggaatgtacacagctgtgcacagtaggatcgtcgtgctcattgtgccaccgcagaccagctttcatttctggactgcgatagtcccgtatattctgcagaattctgccctcccgatgggcgctcccgaacctcagagtctcacttctttctaagtgtagcttcgaacagtgcaaggatgaccaccgcgcgctatctaaggagcgagcccggatggctctagcaacagaagttggaatatttgcagcgaagatcagtcgctgcattcacataagaaacgatagccctaataaaattagtttgtcttagtgtgtgactactatccccatgagaatgtggaggaacgactgaataaactgcgcctttcataatgctggaacttcagcatcatcacacaaaagccttggaaagcaaatataaggcaccattgtagtttcgaacaacgcagtagtaatattgagtggatacactgcagtggagagatgtatgctctaatggccctgcaggcgttgattccttgcttgacgccgcgctttaccgaggaaatagatgccacaaactgaacaaatttgctataagcgactttcgctgtggcatcgattccactgcactcagtcgcagtggcgcccgttaggccgccagtcgacatatgctccggggaatcggccagccacacgggaccacgtcccggcccatctccttccatccctcatttctcactcgtataacagtggactagaaacggagggaaatgtgtgcagggcgggaactcttattaaagtggaaatctgtttgtgcgtgtatcccccacaaattcacagcggccgagaagatacgtccacccagccccctgctgccgtccgcactgtgccgcccataagtacccagctgcaaacgggaaatcagagagacacggaactaaaaccggcacacagaacttacagttacgtagatctgtgcaagttaatgtggtcgaagtgtttactcaaccaagagaactgcgacgaactctcgctattctgggtagagaggctctgcactggacgggaggaaaagttttcgttggttgcatgcggcacgctggtagcggctgacaacactctttcttcagattcactctcgtttctcgatatgtgaggtcacttctttcgcccgtttaaggattattctacctcagtcgctccttctttcctctttttcgccttctgctggatccctcgatgtctctcgttacttcaccatttcgtggcgactcttcgcttttgacgccttttttgctgctgaggtcaatactctcgtttcccctgatctcatctgacttaggaatgacagaactatttctcgtccggaaatcttttgtttgcacctccggtccacttctcgttctccgctgttgatgagtcttgttcctccggctacgcgcgagcgctcacaggctcaacggtctctctgggtccactaacaggggactttttcgttcccgtgtcgggcctgcatgcgctttttttacgtcggagaatctcagcgttttcagggactttgtcattatctggcctccgctaagggcgacgctactccgtactcggtcgacaccggagacggtcgcagtcttttgccccgggtataggagtgatttggttttgagatgacgcaattttcagagttccggccgcagatgcttcgcctcttcttcggctcctttccgtttgcttgatgtgaggcgcagcgacatcgtgaggcaatgcctgtgagactcaattcaaattcgccccgtcggcagatgtgaggccgacctgctcaccttcactcatttctctcacggttcgacatgcgtctctcttttctctcaactgcaagcgcgactcattccatgcatctacctggactcttccgaaggtcgtcgctgttttcggccctgtcttttttgtgacctctcgtctgtcccttatctctctacgctttgcctcttgggtttcttgctgcgctcccttcagagcgcagtccagaaaacagagacctcctgcttttctttttctctttgtattcctcttcacgtcttggctcagttcttctctcctgtcgtcgtcaccggtctcgtcatcttctgtcgccctgaactctgtctttttcacctccgcgcctccttgccgccgtttctctgtcgctgcctctttctcctctgagtttcggttccctctccttcaccttctctgttcccacctcctctccccaatgttccagccatcgagtatctctcctctttctcgtctcttttccctgtaaaggtctcttcccctctcgttttttggggaaaa

SEQ ID NO: 3647 - DNA, 784 bp, Toxoplasma gondii
tctctcaccagtgtggcgttcgttgggtcggacgacttggaggagccgaggcggcattttcttcttcctccttgcgcccttgtctgccttcgaggccttcgccacctccgcactctccgcctggcgggcgccgagggcgacagccccgccagcgagtcccgcggctgaagcgagaggagacgcagaggccggaagaaggaagaaggaaggggattgtgacacagtgcctccgccttcaggagacgccgaagaggtcgacggagtaggagagaggagcgagcagacaaacgggaaggggaaacttgagtcggagtccaaaaaatgaaaggacgccggcaaagagaaagtgatgaggagcggaagcagcgccacaccgaagacaagacaaagccgagacggacatagagagaacggagagagtctagcgatccgcgagcccccagcggggcctgccggagaggcggtccgccgcgtggaggtgactctcgcgagaagcccctccatcttgtgagcgtgcacgcgttttctgattctcaacagaacagaccgagaatcaggaaaccacagatcacgcgaacgaaagccccacaggtcgccaggctgctgggcttagacgaagacacatccgtctagtagtttgctcaggctttttctctgctttctccgcgcgaggaagcaacgcagacgaccggcgaatcgaaacaacggcgacgaagagggggtcggagaactccgttgttttccgtttcgaatcagccactgaggcgaagatgttctctgagaa

SEQ ID NO: 3648 - DNA, 3713 bp, Toxoplasma gondii
tccaggagcgtagtgtacatcgggcacccgcgatttcgccatatccgagcaagtccgagaacttcttgcaggggaaggaggagaccttgaacgtagggaccctcttctccccccctccggctcctccacccctactgatacggcatacattttcaatatcgacgtcagtgttctacagcttagaagaaacacccgatttctccctcgaacagaacaaacacatgcgcagcatggatcgtccagcaaggcagaaaacagcgctcaggaaatcaccgggaagaaagggttcggtggataaagaatatgctgaagaaagggttcggtgaagaaggagtatgttgaaaaaaaagggagggatgtgcggaagcaaggcaacgttggagagaagccggagcagccccacgcagactaacgggggcactgtattagaagttaatatgcgtgtgcaatgaaggcatgaactacagaagacaataaacggttaaaagaccagaaattccgcgtcgtttgcttcttcaatccttcgttgtggtcgacaaatgcagttgtttccagcaattcgatgcgtaagggcaagccgaagaaacaaaccgaaagctggaacgcgcaacgaaatgccattaaagcatacctgcttgatgagaaccctccataacccttcgacggaggttttacccatctattttctccactctcgtggaacacagaagaacggtaaattcacagacgaggtgcaaaaccgggtcttcgtgtggtcagcgcggttccgcgacttagcgctgcagtaccaaagaagcagcagatcgtctcaagacccccgttgtcgcgtgagttcagaactgctgtagacgcaatccttcactgcaaaaatgtacgtcgtttcaggaagaatttgcagggaacggagaccaaacaactcgcatttgtcgttggatgccagcccgccagcatagggtacttcggcaacgcctgcgctcaagacgaagtgtcgccggaaacagctcaaatccccgaaaacgccgtgtaaagatccggtatctttgaaaaagaggcacagtctttcagcaatttgtccctttctgctccacgaatctccggagcactcaatagactcaagcgcccaagatcggtgcacatgtcctggtgggtggggatttatgtgaaaaggaacggaagaaatgcagcctgtttcattcagaaaaggcacctgcaacggtgacatcgagatacggtttctgaggagaatggtaagtcttgaaaacgcgatcgttttgcgtcaacagtcgccgtcgcaaccggaatgttggtggctcggaaaccaccggacaccgggactgcagcacagacgccgtcctattgaaggactgtctacgaaaccctgcagttgaggcacttcttaaagatatcctacggacaaaaatgctgagcaaagaaagaagcgagatacttttcccgtcgcgaagatgtcggggtgctacggaccgcggtaggactggcggtacgaagacggcagagacttccaggggtgtcgcagcatgcgagggaaatggttggacaaacagggattttcactccgaagcaggtaccagaatctggggaaaatggcagaaaaaggctgagtttcctacactgatgtcttccaaggctgattcgccgatctggactttccatgatctgtacagagacctccccttcattaagacttgctgaagcccatcgtcttgtagctgacactgtcgatggtctgtgaccgcatggcgaaagtgtctagtcagaaaaaggagttcccccgaaagtgtcttgtcaggaaaaggatttcgtcccgccagatcgaggtatccagatgcctcgagtagttgtttgccgaacaaggctgccgatgtgccaagcggctgaaggaacgcagatttaccatcgaacggccagacacacaaagtgaggattgaggcgtttgcctcgtcctcgcttattccctgatcttaggaataaactgattcggaatgcctcacagcatgcgtcgtgtaagacgtagacaagtgctacaactatgggacaacctccgcctccaggcctttgccggtaaatgggcaccaaagtagctttctgcattgccaagcgcgttcgtagtcatgtctgaaagcatggaccatgtcagaggacaactggaggttttcgtagaacagcagctgattttggcttgacagaaagtagtttctgtacccgagtgacggatacaagtcctggtttatcccatgaagtctacgtggtgggtggaacagttggcagaatggctgatgccaattgaagaaggcggcgtctgcatctgtattttctttttttctgctgtcatctgggcgataatattgacggaaacaagaagagttttgagaccacctacaaaagggttccagtaaacgagtgagagtgtctatactaatggcccggaacgtgcccgacgccggatgttactccttttttcccaaactactcaagcggtagggtttgtattcaataatgaaccaggatcaaacatgtacagcaagtataagctctgtgttcgagcgggagtacacagaaactggaatgcgagaagtaagctacgcatctttcttggttataaagtacagtcccgccagtgcctcttctcgtggtaaacacagtaggaaatagttcttctcactagcagatgttagaattgcggcttccacgtgatctactgcattgtaagcatcaatttcgttcttcaggtgtctgcttttgacgccttttcggcagactctttggtcctgtaaacttcagccacaatttccccctcgacgacaggacatctgcgtcttctctaccaattttccaaggtgaaatggtacttcctgaagtgatcacactggccaagtctcttgaagggtgcgaggaggaacggatgaaatgtctcgtcagacatcacatgactgacaacgtggtctgttggtcccagcgctgcaggaagaatccaaagatgcagcaaacttttcctcaattagtggactcgagcagcaacttcagggctggttaaacgccatggacatttgaaatggagaacggtcgtgactgattccactcctgtgctgtccactgctactcagtaacgcgcaggatcccgccacagtaaggaggcaacaaagcgcataaagatgtactttccactgattcaacaaaggttgaacgcttgctttactgccccaacttttctttagcaattacgctagggtgttaagttggcattttgagctaactttccaattacggggatatcggcttttcaatggcaatgagcttccgggcctatcgccgtgcataacggctactgcggacagcagttgttgtcttgtttttatttaccgagtctgcgggattttagattcttcaatttcgcttgtaaggtgagatcctctaccagtttcaaacagcaggcaacaggggatgttcaggagctcagaagcagctacttggaagctgtcggcgagtcgaaacttcgctgtctacagaaaaacgcaggaaaatgaaaggattcttaatgatagcaatcgtaagatgaacaacctcggtctgtacaggaaatcctgagacacagccaccacggcacacagtctctgtttcatacggctgccgcgtcattgttttctccgtggtaggagggtgacacaccacaaaaagacaggagttgctgaagaaca

SEQ ID NO: 3649 - DNA, 2497 bp, Toxoplasma gondii
gggtaacgtgcctttgttttcatacgggaaaggttctagtgaaggatagcgctgacacctaagtggacttgcagacaaatcctgctgcctacccactacaagttccacgtttcggtaaatgggctttgggtggttccagattcgtatcagaacacagcgagaaacaccacagaggaacgacagccggtgatccaccggtgtgtgtttcttttcccagtcagcaggaaactatcaccaatacccaccgatagctttgtgatctgcttcaccacgttacaactccgtaaagcggtgtcacatgactcggaaaccgatggtctcagcggtaactccgataagaggacgcgtacactgactcatcctctttgctggtatgtaaattaaagctttatagacttccctcgaagaagcgcatgacgagcttatgcagcggcgttatggaaatgacgagaagccaatggagtgcctctacagcgttctgcggtgcttaggtacacacctctcggagtacacacaaacgtaaaacgaagagagttcactaccagactccaagcaaactacgaaactgtacgtaatgcttacttcaaaacatgctggttcgagggaaactataaaacacatctatatggcgatgtagtgttatgtagaggagtattataccttgaatttgaaaacatcaactatgtcggacagacgcgaagatgcgtctccggagctctagaatgcagaacatcctttcacgataagcaacgtatatgcccttgagtgtcggtcagttccatgactctgtttcaccgacgcaaacgttcggagcgacctcgacaacgcttttttagttctctccgtattcgtacttgtgagctgaatttctgttacagtattgacacagtggcgtttttttccattgcggctgcacgtttttttttcactgcatctatacggaacgctctggtctcgtggggaaaaatgcttcaggggagttaactgtgttggtgatcagcttggaaacatagaaggacaacacgggcagaactgttgacttgggaggaaacgacggattcgggacgacttccatcatcgacccgatgacgtagttgacaagcctttcacaccctgcgtttctcttcagtctgacgagtttgccgtttttttcaaaacacactgggtgcttcttcggcgacattaacatatgactggagcgctttctcactttccgacttgcggtccgggagaaatcgaggctgccagttcaaaggtgcatgcatacgtaccacagacactcgtcgcggtggtcagctgagggaaacatgcacaggttggacgcagggaaacagagcatctaaacatttcagctgtctagaagttcagctgatctttgcatctcacgacgcgggctgattccgcgaagagtcgacgaggcggttgtacgaaagacctcctcagccgtcgacgaatttgcgtctgttctggggggtgggggattctcgagtgaactaaggaatcgagatctgtccaagtcgttttacgccaaccattacaccttttcgtagtcaattgcgtgggacattccaattaaaaagactcgcttcagcaagtaccggggaatcttgccgtttttctgctgcggacggactcgcgcaagctggccctcgccccgaaactttgcccctgagtggtgtatgtaaactcgaacggacgccgagagaaagacctgttcgctacgaagaccgaccgtgttgttgcttccggattttacttttggaacttctcccgcctattgccgccagactgcctccatacgcctgctctcttctcaccttgcccctgttggcttctttctcttcgacgctggataaccggcgagaaaaatcaaaccgtagagaagaagcgacttcttgtccggcgggctgcaggataggcgtcaggagggaagaatctttctgcaaagaacggcgcaaaggactcagggaatgtggggaagccgccaggccttggaagtgcgacgcactagttacagtggcgccagcagacatgaacgagttctgacgaacacggaattttgaaagtcgccgccggatccttttggatcgatgtttagcttttcgtctggagtcaacaatttcgagactttcttgtctttttcgaaggcctcttgccgtctctggattcaaagtactactcaacgtgatatagagaaatgcgggagagttagttccactgtctcagccggcttcgccactcaccttttttgtaccctgtctggatggattcggggagcgagcacttgtggaagagatttttttcagccgtttctttagagagagcgacatcgccctgctcgctgatcggcccccggcctcgtcctcatttcttccagcttgcgcgcagctgtctgtacggctggtgctactctgatgatcccgcgtcttgctggcgagtagaaaccggcggcgtttctgggttctcacttctttcgttcaaacttcaaaaaagaaaa

SEQ ID NO: 3650 - DNA, 1997 bp, Toxoplasma gondii
atgaaattgcagtgcagttggcagaggccatggactgcgttggtcgtcgtgtggtcttggaaccagaagaattctctcagcgccttcttgacgcaagtgcagagacagtgcaactccaacgtcttcataggcagccacagccgagtgacagtgtttagctctggagttgagatggtggaggtttttcgatcgtgaatggattagggatttggcgctgaaagcacagatatttcttgagaggtggttttcctgcgtttacgtcaactgcgttatacgaagccacggcaaaaaatccacaaaagtttgtgctggcactgtcactgcgcatgacggacgtaaacgctttaccagctctggctcgtttctctgctctcgtagcctgctttttttcgctaaaactaaaaactaaagtgattctgacccttatacgtattaccaagaagacaacgaaaccgttgaagtcacgtgaatgagaggtggagaactgcaacaaaatgaagcatgaatcgagaacaggcttgtcgcagaatgttctcgagtttgtgttgatgctgcgtgcggcctttttcgcatcaacaccgaggcgtctcagccaaacattgcttgcgatggtcgcgcacacttgaccgaagtgaaaccgatgacgcagaccgttttgaagaaaccttgttcgaacatctgcaggaccgaaggccgttgttccagcggaacaaagaaaggggtgaacaagaatttgtagtgctctcgtgtagtttacagctatcttgcatcctgtagagaaacacactcactacattttggaattcgaactatagacgggacacccgtttctggtacctgtattcttgaccagcccgaacgattggacagctcggaccgcattgctagacatgcaggcacacaccatgctcgtttccagagtgttataaacattttcatttgctatgaaggtgaaattgtaggcccagacaagcaaacggtagcgaaactgttagccgaagccgagacaaccaggtatagcaattttccgtctcctgaagcaactctgaggttggactaagtgctcggaggcgcttgtcgcaaatctgctgcttaaagaacgttgatgaaaacaagtgatgggaaaatttctcgttctgcttctacgaatagaagtctggagccattggaccaatggcggaggggcgtatagacctacaaaacacacggtaggatgctacaggagttgcgggttctcgtttgaggtctacggccgcggatttattagtcgttttgcccgcatttttctcaaaaaatgcatgaaaccggacttccggctatctcgtgaatttgacttccgctgaatgtctcagtgtttccaggctgcgcaacacagcggcgcacgctgctccacagaggaagacacgagaagccgatattgaagattttatcccctcttcctcgttgcgcgagatactccattaactccctcgttccctaccctttaccagaattcgattcttcaaatcagaacagcgaatcttgtggtcgcttgtctccatacgccatcgtaaagcagcaggtttccggcaagtgcttccgcacacttggtccactcccggaaacgcgtcttgtcggaacggagggtcccttcgttcttttctctcatcaacttcatatttgcttgaatttcttcagttccactctcacaagaacgtatattgggaggttaaagtttgtttgcggcatttttggggtgacgcatctcgccagttctccaacaactttacgcggcgctctggacctgtgacgtttgcagcatctcaacagtatgagatactaaacactttgttgaggcagagccttttctttctggcacctcgcaagcttcttacatttatccgttttctgtgaatcatgagggcggaactcgccgcgtcagccccaccttagctttaagacacaaccactacgcacacatgatccacgttatataacaagatgcggtaggttcacga

SEQ ID NO: 3651 - DNA, 4553 bp, Toxoplasma gondii
agccacagcatggcacgaaacatgtaagaaccttcaaacacgaaaccaattcctacaaatgcgcgaaccttccttgtgaggcacacgatacctgtacacagatctcccagcgtaaggatgcacatgagtcaagtagtatttccttatatgtacagtatacatagaaatagtctgtactggaaacagaacatgtgcgttgacgtatctaattggaacatttatgtgaatagcgaatccagaggaaatggtgattccggaagtccttccccgcatagtacaagtgtccgcttgcaatcaaatcgcagactcggtcagcgtcctcctgtgaaagtcgcttatcgcgcacttcagatatctttaaaacgctgcagattcgctgtgtctgctgtgcagaagtcagctggaaaactggggcttggaatatcaaacggatggagggaacaccgtgtccgtccacgcaacgggcggtcctgtggatttctcacgcaaatgaaccatatactttcctcttctctcgcaagtcttccgcaaccaccgaaacgagtcaagcccggaaaaaacatgagacctgtggataaatccccccatgaaatttagggattcttcgtgcagtgtatcgtgtacctgatagtccagggttgtccgaggcctcaggtgctttgcccgaaacgccgtagaaggctgcccattgctcgcagacgtcgaccgctgcctcgactcccccaggggcaccgctcgctttcaagagagaagcgaaaggatcaccagtagaagcggctaggcgggcgatgcaccgcgctgccgcataatccgacaacgcctcgccagcagcgatcgggctgggctgttccccctttttcgtttcgacggcaatgcggaagggggcggccggagtggacgacgtgtccggctgcactgagaaagtgaagtctcccgcggatttcagattctgttcaatgtaggcaagaacaacatcggtcaccgtcgagagaggcggcagcgaggcgagacgggtgatccgaaggacagcaccgggagatagagccattgcggatttcgcaagctaatggcctggacagagaacgggtcgcgacgtccaacggaacaattcggagcacgaaaagagtaaggattcaattgatgcacaacgactgagaaaatgtagagaaaaacgacggaagcgtcctgcggaacgctgaaacgcaccagacaaacaggttggaactgtgttagtgacctggcccgccacgtggcaacatgaacaggaaaagcatggggatgggagttcaaggcgaatactgcgactcttgaaacaaacagaagaaaacttcgtctcggtgggaaacagcacagccccgcgcgaagaacgacgaggtctccgcagcacgcgcccgcagtcgactgcgcttgtgaggagaccatcgcgctgcgtgtgaaaagaaacgccgggcgcgttgatggtgtgtcaaacggcgctctaaaagcacctatgtcagtgtggaggcctcaagtattctcctctctttaccacgtcttttctggcccccaccaatcttgtgtaatgcctttgtacgcagtgaaaacgagagttcctccatcacatatgcacccgcaagtcatttgcatccaatcagcgctcgcttgtttagagacgggcaaattgatgtgacattgcaaccaggtgcgcaagacccaaacatgcctttggatacaacgcgagttgccgacgttaactgttttacttgtcttcattgacgcaccgtcgggaaggaacgtcgatatttcgagattataggtattgaaagacacactgatgaatagttatgaacagcattacgacggacagtgccgtgccacggggcccagagaccggcacgtccacctttggacaattagctgtgttcgagaagttcgcacattacaggagatcaatttcactaccggagaatgccctgattgaacactgaggtgtgtcgagtgaggcctgacctgtaatacaggtaaggaagcgatgtagccatgtagcgcagctgacgcttcgaagcgaagccgatcacaatcctcacgcagataggacactaattggtaagaaagtcagcccataatgggaagccaaccttgggcaaatctcaagggttattgacaacgccgaggcagcatgaacgcatggttcatcaaagatctgccgccagaaacttcaccagcactggcctgcaaatttgccacgcgaagtaccgggggaaccatgctcgttttctcttgcacggtaagtttgttttctgcgctgcagcaccgtagagctcccaccacgggatgcatggacgtcgacactactgacagcaaactatggcttgcaacgtaatgcggttgacaaagatgagggcatggaaaacggagccccggaaaaacattaaagtatctggcaaaagcgcaccaccgttttaccaaactggataccggaactctgggccactcttcacgaacagtgtttccgatcccccttgcttgcagacactggacaaccaatgaagtaggcggccacgccgccagtaaccgtgccaaccggtaaaaccggggttcatagtgcgttagatgacgcctggtgtccttggaaagggaatacgcatgtgccaccgttctgccatattctggtcaatagcattaaatgtgatggcttcctttatactaatctgtgttacagttcttccacaacagcctttgcggaggcaacccacgtattgtcagtgaatcaaagcctacgatcattcaccacccacgcagcctcaaaagactagaaagatggtggcgatggcaaatgaggcaaatagtacgggaatggcctcacaacatgtcagaagggaaccacgccgtgcatgtgtttacctctggtatggagcgagccttttgtttctgttgtgaaccaccacgcgtccacatgggagttctacacttgctgatatctacctgacaggagtcattcagcactcgttatctaattttacagagttaaagccgtgaggttcccctgagtgtttgacacataacggtaaaacagcagaatcctgtcgaagcgctttccacccacagctacagcctacgagaaggcaaccagtagaatcggctctctagtcagcagacatacgttggcgaaaagaaacgcactgacgtacactgttgctaaagaacacaactagctgggccagcagggtaacacggatcagattgccaattgggaccgtggtgacccccctacgccacacaaccttgaggtatgagacggaactgcagaacacgtaacaagggtcaacagtgcaccagaaggattaaagggaagatatgcgaatgaagcaaaagtgcgcaaccgctgaatgtgaaggactagcctgtaacgcgagggatcagaagcagagccaacccaactcgacagcatgtccacagctggatagaccggcgagagtcctcaacgacattggtgggtggagctcttgtttcatcctacagacggtattcgagcgtcgatcctctatcacacaacactgattttgtaaaagcaccgttttcctttagtataactctgagtccccaggtcgatgctaccgagatccttgctagtctctgtgtgctgcatgcacgaagcatgcacctgcgtatgcgtgtcgattcacgagggtcattcgcatctttgggaattaccaaaattcttcgtccatgttcgtttctgaccccagtgttgatttactgttcatgaaattggagaaacggctttgtttcgacacgttcctttcggcaaaaaccgcggctcatgtgccctggttttcgtgcagttccgtaaatgagttgtgtggccgtacgagagacgttgagacgcagcattggtcgtttccttaaatcagaaggcaacatttcccgaattgctgtggcagttgcgattctgcgtagtgtaacttcaccaagtagtgtcgcatctcgcgtagtttggagcaacgtggttgcggaagacagtgtatttgaggcaagcaagctgccgatcgccgtcgcgtcaccgtggacttctgtcctgtctctcctgaacacacaagcagttccttgatgtataaaacctggtgggcatttggacgagatgccggtcttaagggcttcttgcagtgtgcgccaccgttgcgctaccagaggaaagtgttttgtgttcatttcctgatggcgtcttgtcattatttctatagtcgggcttctgtcggttgctgcaggcgaacttttgtgtcatcaaccacgctcgctgtccttcttccgaccactgtggctattcggtaccattctgaatgggtcttctcagcatcatcactcaaggacacggtagtttgttcttaatgacagttattcgtggaatgcgtttctgctggggttctgttaaaactgccacgcgttttgtgcctgtttttcactcctcgtacctacagtggatacaggggaagagggtgggaacgtgaaaggggtcgtgtctttggaggggttttctgcgaggtgtgataaggtatctcatccgtgtttcaaga

SEQ ID NO: 3652 - DNA, 2322 bp, Toxoplasma gondii
gccacatatccaacaagcatatgaacgacgtatatgaacgaaacacgaagcaatcgagtgagacgaccaaacgtgacatggaaacatcttgaagcgtccacgtgcttcctgggccctgagaccattttgattcgaacggggctggggaacttgccactgaaaccgtgccacgtctgcagcgagcgacccccgcaaactatgtttgccttcgctgacgtcggcgccatgtgcgaaacgggaaacgcagcgcaggaacagcatcacaatgcggcaaatcacggaactgccagagagaggcttcacgacgctgaggaggaaccgttccccgagtcaacccagacaattctggtactggcaactgtcaagcacatcggcatgcattcacacagaacgcgtcgttgatagacaccggcaatgttacacagtagagcggaagaaacctgagcagtggaaacaggcagcgtttcaacacgagtaggcgctgagcatgcaacctcgcaaccgctgtccacctgccgtctcccgaaacaggtcgccgcacacgccagaacctccgcgacaaaaaaacacaactgaacaacgggacaagagaaaatgctgcagtgtatgtacactctgtatcggcccgacgcagttgagggggtatgctaattgccgtcggccccgcatttctgacttcgtattgcccccagcagtcatccgctccagtcgcccgacaaaggtgcatcgccgaagtcctgggagagagatgcaccgcttacaggggccacagacacactcaataagctacagctccgaaagccatgcagttctacgcgacctgtcccgcctacgctgttgtgccgcaaccagaaaatgcagacgctgatgtcacgaaccgaaccaaggcaaattccaaccagaacacgcggtctcgatccaaaaaaacgggagcacccgacaactaaatccagttcagatccattggtagataaaaacaaaccagacggctgcgaatgctcgtgaattgccggagtctcttgtccccacaaaaaggggttctctgttgccgtcaattttgctgtcgaagccaccaaactgcgaaacaagtctgacgccactcacttgtaggctcccattttgtcgatccggaagagctcccgcaacaagagaagagaatctgccttcttttcactggattaaaaactcagggaagagagaagtaaccgcgagcctcgcggggcttctttccaaaacagtgggtcgtcctcccctcccagaaaaattggacacgctggcgcccgcggcaaccggaatataagccgattcgctttcctacttgcgcgcctttggaggtcccagctacgactacgcaaccgtgcatgcgttgtctcatccagacagattgcaacgaaccccacggttcttctttgcggcggcacggagagaaaaacgtgcgcagagcgtttcgccacagaaaggagggctgtctcgattgtcccagagacttccgttccttccaaacattgtttccagaggcgccttcagacttgccgaccatcgagagaccatcgccgctctcatattgtcaaaaagcccgactttcaaccagagattcgggagaaaggacagtgtctccggcctttctccgactgaagctgccttcttctctgatctgcccgcaggttgtgtgctgtttgcctgacgaccccaagaaaagcggagtgtctggggctggacagcttgctcttggcggtgttccaatgaaaggccgaagacggctttgcaggagtcactttgctgcgtttctaacgtgtttttctcaagacggaaagtctctgtaatttgaccctgatctccgcgtaacgtagtctcgtctcgtcggtaagggacataccctgccgtctccgagaaaagtcgacgcgagccatcgacagcgcggatgccctacgaggctgtcgctgtagtatccttcgaggcgtgggtatctctgcgcaggattccaccgttcttgcaattcgtttgcctctattgcttttctcttttccctttgtgaagcacgccgcggggtctactcccctggaccctgtctcgttgttccgctatctcgccgtgtccgctcgtctgggctcgacgacttcggggccctgccgggattgagtcccgtccgtctgccgccgaacagtggcctagactctccagtgcctctcaacttttcttcatctgctaggagcaataattgcctctccctttctaagacctgctcacctcggtgcccagagtcccccccccgtcttcgcgtcctctgcgtctccgccacgacagtcgctcactcacggaaga

SEQ ID NO: 3653 - DNA, 2450 bp, Toxoplasma gondii
gtgttacttggatcgcaagatgggatcggagctgcactgggcgtgaacagaagaacaaaattcagaaggtaactaacaaaggtagcccctgtagtcgtgattttgcaaatgtcaggcgtgtaagttacgtggtgccattctgcatactctcttccggcatgtccttccacgatgatcgaatctggtgataatacgggtcagagagtttgctccagctaagacagcgaaatgaagtgtcaattcgcggctaagtggagaaactcaaggagaaattcccacccactgttttaaccgcctttgagtagtggcagtcatgactttccccgtttgttaagcttcgacctctcgaatcaaaacgggcactcgtgttccactaccaaggatatttccgcagcgggggtatcagcttccagctgcagttcgcgttttcatgctgtacgctaccacaccaagacttctgcatctaatgaatactacacagtcacacggacgtaaattccgtataatgttatctgtgcatcccaagaggcatccgaactacgcacgaagaatacttaagatgccgaatattgcgactgccatgtcgcccgttctgcccgcagctcagcttcatccgcctattctgtagtccccgtttagtcttccgcaacagcgtcttccggctggactttagttcgccgggattcagcatttcagagttgcattcgtcagtcttagacttctcaggcaagcgtccaccaaatgctgtacagagttagaccgcgtatgcgcactacgaagccgacagcaccacacatctcgtgcgttaaaagtggcacctatgaaaccgcaggtttgtcatggaaaaaagcgttaaatctgttcagtccggccttgctctgtccacaacgccgattggtacggtaacttctcagatacaaccatccatagaacagacgccgtcctttcttacatgtttcagagaaccgttcgtgctatgatgtcttcggtagaaagatatgttgcgcggattcgtaagaagcacgtcaagttgttatcgagggaaaagtgcaattaaaccgctacgctactacgtcgggaatccagagtgcactgacagctgcataggacaataatgcgtttacccacataagtcaatcgcgaggatttgactgcacattctttttgtcaattgaaacgtacttgaagtacgactcgctctcctaaaagcagctggctgccacatgaagggaaccagacttgctaagcatctcccagacccgaaaagtgtaaagtaaagagctttgtcgcctgtcgttcatcacgatgaaaaactccaaggtggcggaaatcgaggccgcttactaaccgcccttaaacactcgcacgggcgcaattcagtgattgatgcacccacctggagaagctctgaggtgtccattgtcaacctgtgtggtccacgaatttgacgcaaaatctagttcgaagaaggaatgttttagagcagttctgtccgtgttactccagcatttgagatatctcccggagctgaggggctggctaggatccccagaaaagagcaaagtctctcgtgtgtcccggggtccgtagctcgctggtgtgctttccagctgggcacctctgacccgccacttagaagaatcgaggctggatctattaaaagacctgcatcgtttttatttgaacctaagaatcaagaattttattgtctggtcatcctttgccgttttggtgcgggtcttgccagcctgcatcggtgtgtcgaacacacgcgcgggcctacagctggcatattgagtcgcctcgacgtcaattgagcaattgagaagtcatcgccgtttttctctagactccccgtttgccaaaattgtggcttctgactcaaggggttctaccattgtgacgaagaccagaaacgaaaccggtccttcgtggtggccgacagagcatgcccggggcatttgagatgaacgagttttaaatctatcccagtacggcatgggaggcgaactgttgtttctggccataatttgcggcgttactctcgcattttcagagcaagaaactgctgagaattttcggtgatcctatagctgtgtagcgagtcggctcgttcccccgaagtttcgttttccctcgaaccgctattcaacctattattttcggttctcttttcacctccctttttcgccgccgcacgttacttgcctcgatcctctcctctttttcccatcagtcttgcacaaattctggcgagttctgtatctgaatcgtttggcttgctttcccccttcacacccgactcggtcacccagcccctgcttctcctgtatcttctatgtccctctctctgttctgcgtccccctcttcctctagctgttctgcatctcttcccgtcgtatccctttcccctgtctctccttatctccgcgatttcccgtatccacca

SEQ ID NO: 3654 - DNA, 1745 bp, Toxoplasma gondii
gctggactttgttgctgctgtggtgtactgacagccgtgtatgggcgtctctccagaaaatgtacgggaagaactattttctgatgtctctgtttcagtttaaaattcgtttgactagatgttgtaccgttgcgttggggcatacacggttacagacggtgagtctgtgtattcgcattggatgtagctcagatcgcacaagcgcagaggcactacgatacctagggtgcatcaccacctctctgaactgtctgagacaggtacatgtaatgaaacataatactcggcgaagctaacgtcattccacatcagttctgttctttgagcaacatactgattactgttaacacacgaatgaacagctacagaaaacaactattcagatgctagggcggcagtatcataccttcgggactgatagtcgctgagacagaattccgacgtggcgcgcatgctgcttgcacatcccatcagttttgtatagttgcaatcatgagaaaccggacttatacaaaatgcagtgcagataaccactttgatcactctgggttccacccagtgttcttctttctcagcacacccatactctcgaggccaccccgtaaccggggaatctgtcaacagcgccgttgactacactcaggttgtccgtgttcccccacatccgttttgggggttaatacgtttgtgcacgaaaggtaccgcctggtcactaaaggccagaaggctgcaaaaatgcaccgctcgtagcttagtcgtggcggagctgactgcgtctgttcttgtcacaagtgtgtgcggggtattctctaagagggaaatcccgcttcgccagcgacaggcagattggtgcattcggacgaaggactgccaacgagttgtccggcagaatgggccagtgttcttgactatttgtgggaaatctatcgtctccatgacgcattcgacgatgtagttaggccagggatacaagcgtatcgctttctgaagcagcaggaagattcccttgtcatttctcgcggccgctgcgctgtttttgccactgtcacgagcacccggcgaagccgtagacaacaatcacgcttgacaggagaccgagtgcatttgtgtctgcaaccagcgaaaggtgatctggaactttcacccaccgtcagcaagtctgtgcccgcggaactccctcacaacctcagaagagtgtgagatcttaaaaatcctagcccgatcttgatgtcaatcaaaaaactacattcactcaaacagttctcgtagtgaggtggcttacggtgacggtaagcatgcgagaaaaacgtgccgtcgtaggcgagactatcgcaacacctaccttctccattcggggtttccgtaagttcacctgcttcgtccactcactcttctaccgggcagttctgccgctaacaaaggaaaaggccacagaatgatggggttttggagcgctattcatgcgctgatggacactcgtgggatgattatcgacccgggcccattgtacatggcactgcctactgtcttggaatgggtaccatcaaaagaaaggccgtgtcaattgattaaatatgcggttcatcctgttggtgcagccctctggaccctcaccttcccacattcgcagcacatgtacgccacatttctttcatttgcaagcataaagtgtcacacgaagcaccttttgctctgccgtaattgcaattgagaattatgttgcccctttcgttgttgggcattga

SEQ ID NO: 3655 - DNA, 2988 bp, Toxoplasma gondii
atgtggttggaagcgagacaggttctaaagaagatgattcgaaaccggaagctaccagtggcacatgttgttgcatccttgcgacgacgtgtatttgccctccaattttcttttacccggtgccaaatcatagacgtaaagaacttcgcgaaggcaaggtgcaggtacgaagatgcgcggagccccttaatgtcgaaaaaacgtcgttcgcgaatggagaaaagttcgattaggctacacaaaattttgtctaatgagatcgtgacagcacagctcttatggtgtcatgctacccctcaggcagttggatggtcgtagatgagcaaacaacaccatgtgtctacctggaatattcaaaaatgattgtttgtgtggtgttctgcagaccgaacacttggagtcgtcgttttcgtacacagtccatcactggagacaaacgtggcaaggctcagttcgtcaggaaagtgagactgaatgctgacagtaacttttcaacttccctttgataccagtcgtcgaattaaaagatgcgatgcatccatcggtcttgattcaatcaacagttctttggcatagtacaagcttttctctctgtggggtgctgtaccggcggcagtaacgagacgcaacgtacaccgaagatgcgcaggattcatctaaattctctgatttcaccacaacagcagcaatactgatattctatggaccgtagggtcctcgttgcgtgcatcgaggtttttaggggaaaactaccagatgtctgtaagcaggagttatgtgggcagccacgattttccaagccaactagctggcaacacgttgtcgcggtacaagttgtcaacttctctataatattgtcgtacattcgcaagtcctgtcacaatataccttgctctgccgccttatatacaacatgttgcccataaagatttgggcgagcactaagacgcactgagttgcttgatccaggtgccgcaacggattaaggatagcctcacgctcgatgtattgtggcccacacaatgtaaatgaagcacgtgaaacggtggatatgtaaagaggtttaaggtcgccttcctactaaggcatgctggaagtggaggtgtcggtaagtcttgccgcgttatcgttcatgtcaatccctgagcctcttcgccaactgcgtggacgtgcatgcagccataatcgacggaaatcacatcccaatttaaatacctgcagacggcgtctgatgccgtcaacttttctttcggcgatggaacgcaagtattcctatagtgaaccgatcgagtgccagggatcactggcgtcgcacacctgcaacgtttcttacctttttttcgagttctatttctttttgttgcttcagctgattagcatcatgatggttcgtaacgattttccgtttatatcatgattcagacctcagcaagcagagctgacaaggtacaagtgcatcaatgccaccgagccacatatcaaatggacagtgattctcgtacttcctttgtcgtttgcttttgtgagagcgtttagcaagtctccctcgccatacactacagcgtggagacggtagatatgagcgaagaattagtgagcagaaagccaggaaagcgatgaccataccagggaccttgtagaagatatccacaggcatgggctcgcttgcctgccacgcgtcttgaaaatgtagtggatgaatgggtgagctgatggcagagacagagtttccatgcagttttatcgggatcctgtcttgacgcacttgcttggaaccagtgtagacagcacgtcgaacttctccatctgaccagagcctatccgttcagcaaagacagcatcgcctaacagctgtcgctcaggtcatgtttggctttgaaaatacgtacggtgtttcgcactcactgcaaggctccaggtgaagacaattcggacaacaggacacaagcttctcattttggatggcgttttagtttgtacgcaggatatcattaggcgatacttgctcgatagaggaaaaccatgcgaggagcgacaagagctgcgaaagacttggctgtacgtacgcgatgagctgcctattccttttaagctggcccatatgccggcaaaccccgctgaaatacgtcgactgtttttcacccgagcacaaggggaaattcacaatcaaaacctatggccataacagtttcttcgccctataacaagactttgtacacagtggattctcacaagtggatcgtgtgccactaacggtcgagaatcctggcttcgttttgtgacacactagattggccgatcatgtctgtgcgacatcagcaagaccacagcggcgaaggaaggatcgattcatgcagcaggaggcccaccaatgaaaaagtcaacactgttcagtcgtaaagttgatagcgactgggcacgatcctatcacccccagcaatgctgacaggcttcagaatctgcgcgccagagatagcactggccccgttaacatcacttcataattcgcgtttcatggaagttacccgtataacggcagtttctccacatcttcgttcagtcactgtgccagtctcctccctgcatcattcctacagtaaatgcggcggaatctgctacaaacaggctttatgtgaggcgcttaggcgacgaaagaagggcattttcaaaacacttcccaccaggaataattcagcaatttccaggatcgaagccagaaccagtgcgtgagtgtggtgggattgccccacatcaaacactagtaagatgcaagcagtctagccggagacacggcttgaggcagattagctatggagtattcgagctgggagacactcactggttgtgagatttctattcgtgctttgaagaagaagaagttggcggccataaaacaactctcccgcttgcactgcgtacatattgtacggtctagggacgatccgaagagccaaaacggctatactccaggaaaaacgttagcaaaga

SEQ ID NO: 3656 - DNA, 3913 bp, Toxoplasma gondii
ctgtgccaaccctatgcgtctacctgtatgtatgtatttatatgtacctgcaagtatattcatgaatatatatatatatatatatatatatgtatatatatctatgtatgcatatatctgtatatatttgtatgcatgtgtacatggaagtaacgaatgtgtgttgtggctggacatgcgttgtccatttctgtgcagaatgaagcagagcgttttttcgaggcgactccggcgtggaccgagaggtctctttttctttctcaagtttgctccggactcgttcgcctgcaagttcttcagcaccctgaggggtccaccgtctctcgacttctcgacttactcgggccggaggatctccaggaggcgaagaagtgccaggaaactggcaggccaaagtgcgtgtaaaccgtgacttcaaatccgttgttctctgaaacacagagagcctgaaaaaccaaatactcggaagtaaaatgttgtctcacggcttgcgacttttgcctttgacggcgcgtctcctcatgcggccccagaaggccgaacatcccccttttttggatatgttccaccatgaggagaggaggacaaatgagtttctgcggtcctacaggcattacacacctccttttcccagttccctatttcgtatctgggctcctgggaggacactacgtagatactgtcacatgcgaacgcttctttgtttttttaatcgtgcctatttgacgtcacagcaaagaggttctttgtgtttgatcttgcctctctgacgccacgttgaaaacttctgtagatcacgatttatcttgccttttatcggttgtgtggagtagctttctgtaccttccactgccgcgtgattggttgtagcacccctgcaggtattgaagccgcgaactccaccgtcggagatttccgtccgttgggaaaaagagagctgtcggggtggcttcagaaaagagaacgttttctttgttctctttctgcttcagtttacgagcaatgtttctcccggaaggcggaggcgccggcttctactgcagtagctgcgactgggcattccagcgagacatggaattcttctttccgtgtcgtaggcgaaagaaacgagaaacaacggttccgggaacaagggggtttctgtttgccaccgaagctgtggtcccaatcgtagcactctacacccttttttcttgctgttaggattggacattccttcttttcgtctcccctccgtggtgttcatggaaatcaaaggagagactccacgcgagccagcgcgcctgccgcgtcgttcaccataccgtcggccgaacctcacgcctgcgtacttcgcaccaagggactagagagcaagaaaaacttctacgatctctcgttgtgggttgtggtcgagcttgctttgttgccagtccagacgacgcagctgtagagggcggtgcatgtgcgtgtgcagatattcgaggtatcgacgcatgaaactgtttgacgccatcgttgttgtttgcgattctcacggggctcgatagacacctcaggcattcgcgctacacagcttgaagctgactcggcaagtccggaagaagccgcgtcagtctggtctgctggactcttctgttcactttcatatgcaagtcgtgccacaccaaaaaaccaaattgactggaaacgactctctcttttttccaagatgagatgcctgcgtgtgcacctaccacaccttccgaaagcgttcagtcacgaccttcgtatcccgatcctgaactcactctgaggatggatgcacctttctgtctctgagtgattgctcccgcggtagtctctccccttatgtgcgccgagcttcgaagatgctgctccatgcggtcctgcctcttcagttgtctcccttcgtttctcgagctctcttcccgttcctctctctatctgtatccacgtttgctgtccttctcttcgactccattctcctggtcgctccttcctctccgtttcccccgtcttctcggtttctccttcctctctgtttcctgtgttttttctgccttgtctctcgactcgattgagatggtggcaggaccccaacatgcaccggaaacgttcacgaaaaagatggaaaaggtgcactgttccgagtgcaagacagttgaggctgtagagcgacgcatatggttgtgtcaaacgcggctgtttcctcttcctgccttcttcagtcgacaaatgccctgtagagagaactttcgcgatgataaaacctgacgccgtgggcgctggagcctgtgagcagatccgagacgccatcctcgattctggacttgacatcattgggcagcgccacttgcgcctgtctgaaagcgccgtcgatgcagtgtacgaagaacataaagacaaagtaagcattaaacgaaacacatcaaaacaggcatgcgcggcctatgcgaacagaatgctccttcgcacctgccaatccatgcggttctaagctcagttccaagtgcacctgttgtcaatacaccacatacacaggcaggaacgtgtgtctatatatatatatatatatttgcagatgaatagatacttgtctatgtatgtgtatacgaataggtacttatacacacacatgcattatatatatatatatatgtatatatatgtatatatatatatataaatatctgaatagagacgcgtacacgtttgtgtatgtgtccacctatgtgcatgtgtaggggaatggcggtatacgtgcgagtcttctaagcatgtgaataggtagctgttgagcagcgacgtctgtctcaacagaggagacagctggaggcttttcgtctccggtatttctctgaaactctgtaggctccgagtgcagtgtgcctttcttcgcctttctacatttcttcgttctttctggctttctgtgacggtgaaaaccttcacaggtgttcgtccacagaggcgaacagaaaccttccggattcttgtcgtttctgggtttcgagtcttctgcagtgaaattctgttttctttctttcagcctttctacgacgatctccgcctgtttctcacaggctcggatggagtcggtacgacagcagctttcgttcctcgcgagaggccagcgaatcgctcggtagatttctacgaaactcgtttctctgttaacatcgtagaaccgccttctcggactttgcgttttgcatggcatttctttcagcaacgcgtccggtgctagcgacttccaatccagtacggtgtggcttgacgttgagcgttccttgagttcttcagttccctgggtgggagaggtccatcgagccacaaatggcagtctacgcctcccgtctcgtgtttatctccatctgtatgaatataaaggcttgcgagctcaccgaaacagtgtgaggtcgaagacggcttgttgcgtctccaggagttctcagtgaattatggtaacgagaggtcgcttctgcgtctccgccacaaaatgaaaacagtcgctcccctcgcttcggcagtgtatcgcggaaaaacagcaaacagagcacagaacctcaccacaggtgttgcaaagaacgacgcagatcagagacgctctccggagctcaccgggcgaccgtgtgctgaaaccgtttttacgatctctcgcgcttgagactaggtcgttgaaactaggtcgttgagactaggtcgttgaaactaggttgttgagactaggtcgttgaaactaggtcgttgagactaggtcgagatacgttccgcgtctctggggtacggaacaagcaagaagcaggggagaacctgcctagaaagcaactacgccgagggtgtcgcttgccgtttcttgcagtcgttttgattctcgaaggccaagcggcatgcagaagatggaagcttctctgtggaccccgagacagca

SEQ ID NO: 3657 - DNA, 2126 bp, Toxoplasma gondii
acttttccacgcgttttccctggcaaatcttgtctgcgaagctttttcctcggcgcaaggattccgtcggatttcaccaggcgacgaacgcctgtttcacattcccaggctgaacaaaatctcgttacaatgccactgctccaatggcggcgaacagcaggctgccgttgacgatgcgaggccctctgcgtcgcgcgcagctcatattttgtgaagttacttccgcagagttgtccgaaaaaaaccaacctctctcttgtgaggttcgtctttgaccagcttcccggttttacaatatcaatcggcactctctgcgagctctgtgccaaccagcacgcacaattctgcggatcagctgtttctggtgtttctacaccctccacgggatgttcgtgagacacgtcgatggaagaagatgcaaactcccatgtaaaggttaccgcgtctttcgaaacccactttctagcgaattttcagcgggcaaaagaggcgggcaacgacatgcttaatgacgcgtctggctgtgattcgaagctcttggagaatcacttgcaaggtcacaagcagcgttttaccccatgaaatttccgttatcttcctggtattccacctgtctaggagattttcgagttcccctcacataaatatgacattcaatcagtagttttcccccgtttttgcatacacgacccccaggaggctgctgaattggaacctgattccccgccgcttatttagacatcacatttgtagaggggcgcagctgtagagctgttctgtctaggcacagaaacgagctcgcctgtctgcgcaactgaatgaactgcataacaaacttcgaagcagcccactctaacccgaaccaccgacgcaatacgcggcatattgcggtggtggtgcgagagattgacgcattgctttggattagcaccttcgatatccaccagctactggcaaagggcaactcgaagaatcgttttcctcattagcggtaaaatcgtttctggggacttctaaccaagcgggccagtcctcctctagggacaactatcgtggtctggtgagcacgcgaacttcggtggaaaccggaaggtcgacagacgtatccctgggtgagtttttacctcggatctcaggaggctctgtccgtcacgctcttgtctttgtcgaacgctgcatttctgggagaaagggaacggcgttcgacgttatacggcgaccatttcttcctgtcgcacgctaatcgccgcagcaaagtgaacagtttgatttcttggggtgttcgtttgagagctcctcctgtcttccctggattgactcacgttattggttgtcgccagtgcgatgctgtctcgcgatcacatttttgccgcgttgcatgtgcgcatgcattcgcgagaaacctgcatctctgccgcaggggaaaggaatgtgcagccaacatcgaaaggagacatatgccgtttcttccttccatttttgtttggcaatacgcggggaggccgccctcttcgtggagccccctttcctctgcagacacaaaccggccggaacgcagaattgcctgtggtctctctgatagccgagggaaatcaggcgaatcgaggttctgaagttatactcttgactgagcggctggaagactagaatgctcatttcgacactcagcaggagaaaaacggcctttccatccctggcggttcttctcgactgcggtgtttgtacacctcagcacacggcgttcagccgtagtggtcaacttcagcaacggttgtttccccgagctgtttcactcttaatttctcgacccccttcgtcctgtccgaggtaactttcccacctgattctttgccgttgttgtttctctccgttttcactggcgtcgattcccgctgttacgtgctccaccgtccaaaaacacgactctcggcactgcccgtttgtcggccacaccgacccccgagagaaatctgtcacctcagctactgctgactatggtaggaactttgtttcggtagtttcacttctcaaggccaccgtgccgtcagcgacggtttctcaggtgaccgatcgggtcaccaggaacggccattttccagtaaactcgaaacggacgcggatcaaca

SEQ ID NO: 3658 - DNA, 3927 bp, Toxoplasma gondii
ctcagttctcttctgcttttcatgaccgccatgttgagtgcattgactattgtgatatccagcgtatacttgaaaagtcggctagagaccgatgcttgtgagtctgccttctgggatgctgagaagcaagtttcagagaaatctgggattttccttggcgccgcgtcgtgtcagatggtgctgatattcgttaagcagagcatgcgggcttgtttcactcaagtgtattgccaccagcgaaagaggttgctctatataagagaatgttctagagcgcatacgggcaaattgctagtcggccagaaacagctagatgattgagaagttgcccaagaccaccacactgccctggagcacagaaaccttaccgtgtcgtccgtgcaaagccaggaccgagaaccgcaaacgataacgaggtcatgtattgctactatcgcatatcaacgcaggtattgtctctgcgcaatttatcggcgtcgagaagagatatcactcaagcttcagcggttcgtctgcatccgagagcgaaaccggctgagagagagaaagggtacccggacagagcgataggcactcactactcatttcgtaccggctactctgcctctcgattgccccctctgggtctttagccttggagttatgtgtagcaaccacttccgtagtttcccatgtgttgataggatttatggacgcggggaaacgagagtcgaaaggttcggttgacttcgtcacagcttgtggatttcaggaaacaagtttggcattgcgtatttgcggtcaaatcacgagttgcaaaacttctgacgctacaagattctcactgcagatggtgaatgaggcactcctttcagtttccgtagtttgtactaggcatgcgggctcttgtccgaagtactgcgagtttgtcgttatagggcttacggtttaacaacgatcatgtcaactttttcgtggtcgccgattcgttgcgccgggccgacgtttctttggtgcaccctttggtttgccgtgatctcgttcacatatcgacatgtgaaggaaatgacaacgttttctgaagaacaccactcctcttttgcgaagataatgcggcatttctgtagcagttgctgctacgctctcagacacttcgaccgagttctctgtttcttgggcaacaggtcctgtcgggtggaaggtgccccacgtggcagttttagggaggcacggaagctggaatcagagagagaaagcaagagacgcagtacgctgggtaggggtggaaagccaccaggatcaaggtgtgggtgctaatggcagaaaaatcaagatagagtgcctcgtgcgcgtagacttcccgacctagtaaagagaactctgttgtgctgcatggtcgatgcacacagtgttgtagtgtattacatttttgtgtgtgtatcatgaatgaaagcgaagagtggagacaaggcggtttcgttttcgtgtgtgtggtgtcgtttgatggtgcatgcaacaccccaagagtctgcgttctttttagtgaaaattgacaaatacgttgggtccgcgtaccgttgcagagctctctctagagaataaactcgattttctaccggcgatacggcttgctcaaaggtcctctttcttgcttttatccacgtactttggagcaccaatcaaaacatccttttaaaggctcgccgtacacgaggttcctctcgtatctaccattgaaccgaacagagaaatagagggacaaaaactcgaggctcgcgtgtgtcaactttccccaaactttctttggtgcgctttttccgtgttcagaagcaccaacgttttccttggtcttgggtggcaacagccccggtcagcatcggcagagtgcttgaactgcagccgtctagtgaggaaacattgtcaagtactcttgccaaggactccgtaactttgaaaaatggtgacagaagtgcacaactcgaaggacgcttcccgttctttacgaaacggtaaagtttgcttcccacctcttgtcacatttaggcggaagcagtttgttggactcagcaaacacctggtagcgtaccaagttcgttttgcccacgaggaagctggaggaaggtcggttgctaaacttctggaaacatgctactgcttgcgaagcttgaaaaagtggaaagaatacgaaccgacagttatcacgggttacagtccactggctagtcaaggggaatcacagagtcacaaggagtccacaggctgctagcaatatacatcaaagtgacgaaaaagcaggtaatcataactgttactgcaaacgaatttctgtggcgaagcccgctcacataaactcggaaaactgcggctagtagcacaggaactcccatccgttaagtgcagtaataggattgtcgtatttagcgtatatttggagaaccagcatcgttatacaaaccgcgcaaatatcacactattcggctggatggagtccttcctaagcgctagagacaacgagatttagacgacttgtattcttccatgcaaatggacaccgttcgccgttttatcctctctctggacgggcagctaactatctagggttttccttataaaagaaatactaccggttgagtttataaagtaccagttacgtcgtatacttgaatctattcaagaattggtagtaaacgatagaggtggagtacaacgagttttgttacttgcaagtgaaatagaggcggctccttggagtctagaaaataagtccatctatttgaccggaatgccatcatgtcatgctcgtgacgaccgattccgcaacagagtgaaacagcaatgagcacatctctgtaaagttttccccggttctggttgtgccactgctgcttctcatctttcttcatagtccaaaggcgcaccagtgttcttggctggcggcaggcaagcctttcgccctctagtctgcagacgggactctctcaactgccaatgaagcgttcgcccagcctttcgtatcgcgagttcctttacgtttccaactagccgttcctttcgcgttttcctttatccccttctctccttgtcaggttccgcacacactgtagaccggtttcgaaacggaagcgtcgatttagccgacgaaacttctgagtcagataacgaaagtttgtcttcatgcgcgacgcctcggcctctgggcgatccgttgttttctgggtcagcaacacccagggctgcaccactccctgaacgaagttaccggttgagaggcgtaaacgaaggcgaagggatggcaaaagaacttgccagattctccacgtatgttggcaagtacgctccggcattcaggcaactccccgccctcttgaaaccgggtccgagacattttctgcccgcaattggagaggtggacgctctcctaaaaattgaccggccagacggtgaagacgacggagcaggtctggaacagccgagagaaaacacgagacgcacttgggcaggagctcaagtcttcgcattctgcgacagaaaggcggcagttgttttgattaacgtgaaactcagtgacgggttatccagtgcaggtttcacgtgacagtcaggattgtgtggcaaaggcagtgggggacgtggagaatccgggacgaccgcaactccaccccagcactttcgccctttgcacgatttgtaccaactagactcctgagtttaagttgaaaagttctttcttttcagcttgtgccggtatattcaggatcccaccgttatattcgatgatcctgtgtgttcacaaatgtaaaactcaaatcgattaaatagcgagaccactggtacccaggagaccgacgtatcggtgacaggcgagcacgtgtgtgtgcctagctgtacctgtggaagactcacccggaagtatcgagcaccaaagggcaacgaaatcgagattgctca

SEQ ID NO: 3659 - DNA, 4884 bp, Toxoplasma gondii
tgatatcgcgtctgattcataggcgtattctgagtctttcgatgcctcagtgtctgatgcagattctgagctgtctgatgttgctctgccaggtgctgatactgaaactgttggggttgtcctgtctgttgttgagtctgattctggtgcctaaactgctctgcctggtgttgcacccgatacgcgggaaaatagtgaatcttctggtgaggcaactgactgtgatgccgcatctgatccgcgggacgcatctcatacgacggaagataccgtagctgctggttttgcatatgataggagggaaggtactgatactgctggtgctgtcctgtctgaggccgcgcctgatagggatgtgggtactgaaactgctgatgcggttcttcccggtactgcacctcccggtcctgatactctggagtcccccgtggaatcgtaccatgccgtatgtgcgtaaccgacggaggagtactgctttgcgaagcgtacacttgacagggttgattcgcatccatcatcgccatgggttccttcaagtcgaagtggcggaaagagggcgaagcctcgcgctggatttgacttgtggtgcggggagcgtcttgccaagggctgaaagacagcacacgcagacatcgttggggaaggattacgagaaataggcacttcgaataaaactatttccggaggctctgagtgtgtcccttggctcacttttcgagacttgtgctcttccgtccttcaaaactttgagaaccgcctgctccggcaactgaccgcgcttgaacgcacggcgacgtcgtggtagctggcgcgggaagtggtgtcggtctacactcgtttgaaacagcaggtttggaatcagcgattggattattgtagtggttgggcaagcaataaccgtttgcccgttggccgtttggcatgccgcattgagacatccagggcacaccgatggccgtcgccggttggcggttcaggtgaaatgatgcgtggtcacccgagagaccagaatgttgcgggtaaaagggctgaaaactcccggctccgtttgtgcaaccatggaagggcagggaattctgggcctgcgtgtggtgttgctgagcccatacccgcggttcctggagaacggtcgcagctgccggtggtcccgcagcgcgttgctgctgcataaacaatcgcatctcttgggtgggaatgggcttctggacacccccagcgagcccgctgataaacgactgaacatccatcatcaagccaaacactaccagatcttcagataataacacaaaaggtgtggtttccgactatgttacacatcccaccgccagacaactctatgaagctccacggaaaacagcgatgacataagattgttcgttcagtgtctgaagaaaatcgaagtcatacagaagaaaaacacgggcaagtacatatatatatcgagtttggagaggcacgcctcagtgagcggaacttgacctgtgccagccctgccgaggcagtgcgggtgtcgttcggttgacggagacccagggcccaagaaagcgggtcaaacgccttgtcttgttgaaaacaaagaacgagataaaaatgcgcggcgttgtctttcaaatataacaccaggaggtgtgaaatgtaccagaaaggaaaagctctccgctgccttcagacactgcctcacggccagccactgcaccgcggtgcggctccaaatcatgagggatcgtgcgtaaaaagtgggaaagtgactcatttgcgaactaatgcttgtattttagacggcaaatttatcatttcgtaaataatgggaactttgtcgtcttgcgggtcagcggccaatcctccttaccagcatcccgcctccggctgtccgtgcacgctggcgggtgtcctgttggctttgtgtcctgcgagcacagtcgactcgaaaacatgctgtctcgcagacaccagtcacacggcaggtattatacttcttctagctcgaaacttttcacatattcgcagagcgaaggagataagcttcctcctgaagatatggagtcgagaagagtgcgcccctcttagacaaaccagtacgcaggcactgtctttccgctcctcgcgtaatggccacgcgtctggcaacgcgccaatccgtcagtcgttggacgcagaagttccatagcggtggacgttggcagcgttttgcggcgaacggactttcagaaaagttgttctagtgtgggagaataagtgtagcaaatggaaggtggcaagttctgtgtctgtgtggagatcgtcgattggagttaccaggggcgctcacagtacctaatattatatcgagtagcgtgactatctcgaatactggacagaaacgctcggtgcacgtgtcaggggaaatgacgtcaacatcgatgtcacgtctcacgtgtcgtccagccggcagagaacaatttggggcgaactccgccccggttgtgaaattgtcacagcaagcagaaaaagccctgcttagcctcgaagtatcaccctccgagcgttaggcttccatctagcgatggaaatcacgaccactacgggctcacagcgtactagagtaccgctctgtgcaaggataacttatggacccgtcctttaggggggtatacggggtttgtgtgcttgtcttttgatattttcgatacctctgcaggcctgactatgtatccatcgatggggtaggccgacacttctcttggcaaacgataccgtcgtcacttggctcctgtcgtgaggaaggctcatatgcatgctgttgcgtgtacgcgtacagtgccatgctagaggctgataagcaaaggccagtcatacgtaccgagttgctaggtgatttctgaaactctgtttggacggttcatcttctgtttctgtggtccactcgccggtgtgtccccttcacaagttggagagtctgtagggcttggtgaggtttgcacaaggcagcagtgggtaggcgacccacacaggcaccagacctatatgtaaacattctagtcgtaaacgaaggaagaaacgtgacgttataatggtgtgcagtgtgccatgctaatatgcctcgccgcggggggcagagctctgtccaacaatagttgcagagggagggcacccaggaaaaaacagggtacacgagaaagtcgaaaaactgcagaggttatcggaacggggcaccgaaatgaggggggaaagccgtcattcggatgagctccagtcttcaatttcccagttctcctcgatattacttgatcgatgtctacacatcctgcaggcacgtacaacggactatattacttttgtctcttactccctggaaccaactgggcccccatgctaaatttgttagatttgttgagtatctacggcagaattttcttcaccgctgactgtaacgctgaaggaagcgcgtcgagtcgatactggtatgggcggcaactgacggtggtccttccaaccttatgattttgttaactgaggcatgtacaaagactggaattacgtgatttttctatccccagaagcgttcttgaacttcgttccactgtggctcgagcgaacgacccagtttgatccgccgaacgaggttctgttatgagccttgcttttcgttgttacagtcggattgtggccacgcaggtggacaggccacagtgaacttttctgtgaaagtttgcagtagatcctgaagaactgtacccggtgacccttgtgctttcttttcagatgccagtgctacgtgtgatggggtatgatagatcatgaattcgaagaaacgttgttcctacggttactgcgagccagagactcgaagaaaagtccatattcacacgctagcaccggcccagcttgaattagctaatctttaacggatctaaccacgcgagagtacatggcgattcgatcttttctttagcactcgtccagcttccgttggttgatctaggttacggaactgacccgaatggagtactcggcgaggagactgtttgtcttcactgtacaaccttcgctgttcaagaagaagccaaaagactcgtggccccttgagggtaaaaatctgtccacatgagtctctggaagcaccagtcgtggcactcagttcggaatcgaataactttacgttcatgtctttataattgagtgacatacgacgggatgagcgcgtcaggttcccacaacatgcgaccgctgatgttcaaaaagtgacggaaaacgtcctaatttcgatagatcaacattaacgtgtgctgttcgcgaggcgcgacaaggatattcaggcggccgggcgggcccatagcggagcaaggataggcacgcacttttccgaaccgctcaggtcccgcatctctccgtcagccgttctacgggtgtggctcaggtgtcgtatcgcgaaaggttttcagcgaaccaagagactgcagtggcatagtatgtgaaacccattttctcgtctccaggaaaagcactctaaaacacattttttgccatgcaaaacggaaagcatccgtaataagggttgaacaggaatcatgtgtcatcgatgttaacttctgtgcgccctgccaagagttagcgttctctgctgccctgtttcatccagaagactttttgcaaggacaacagcctttgaaagggctacaggttgtcctacagccaggacagctccatcgttttatgcaggaaggtcatcttcattgcctttcaaacggaataccagtggtgaagctggccagtgaaagacgagtctcagcactgcacaggagtctacgctgttaaagtgacatcttcgtgggtcaacagcaacaaccaattcagttctttctttccttgaacgtctttgagtgtcagtgtgtcgccccaataaaa

SEQ ID NO: 3660 - DNA, 3229 bp, Toxoplasma gondii
taggtttactctctccagtcagtgtatctttgctttcccggcaaggggtcgcgagacgctttgtactagagcggctttctcggtcgttttccttgcgagccggcccccccccctccgcccccaggaggcgaccgcgtcgcttgacgtagctttccgtattttctgtatttgtctgcagctcgtgggtttccgccacttgttggaggcactttttcaggcagttgaagagatttccatggcgcttcagcgctcctcgccccaggactggaacgagtttctgcaggcgattattcggggtatcgagcgcgactcgccgcaccgcagagctgtgtgctgatagcgagcaagacagaaccactcgaggacgttccgcgaagcaatggttttgcgggcctcgaaagaactttgcccgacagacaacactcgtctcccggctgcggtgacacccgccagggacgatccttgtcgacacgccttctgtacagagaaactcgaaaatcctttttccggcaagggccgagcgatatgcattttcaggtatccatctgtatagcgttttgtcactttctgacgctgtagttcttggcgtaaccggcctcgcttttctcgaggtgcctcccgttgtcagtgtcgcgttcctctgcagttctagtgttgtggacctaaacttttctcgcagcgccgcccctcactccgcaggtttcggaggcgcagcgcttgttccgaccaccgacctccttttcccgggaagttgtttcgttttttcgttgctattccttgtttcgtctgcctcttgttcctaacgaaaatgtgcgaaaactgtcagcctcaacctactgccttgctcaacgcatacccatatgagaacggatcctgagacccgcagaaacgcaaggcgtttgcgggatttttgcgcgacaactactttgctgttgacacggacactttctaaacactcacgccagtgcatctgtttcgactctccatattatatttctctatcggacaaagtgcacgcgccaggggtatttgccacagccgtttgctcgcagatcagggtgataagttgctagaagccagtgcagaaacgaagacacgttaacagacgtttttcgcggacaggatggagtattcgtgtgacttcacgcgttggcctctgcaccagacgcaaaaatgaatttggttcagtgctgggcaagccgaacaatgccactgaacactgaactgtcgatgctcctcgccaaacagctttccatttcgtagccctccttgtaactgaagtcaccggggacccggcaatgtgatcaatgacaaaggcgaatttgtttaggttcttgaaaaaagaatcgctgccccaccggtgtcactataggacaagtgctatttctgacgcgtcgaaatccagcttctctgtgagattccggttccttcgaaggcttctctcggacacgaaacagtttctcaagacgtttctaatttacgcgtcattctgacgggacagttcgaaatacgtcttgaacagctcttcttttacgaaagaagccggtcagaaaaaccaaaaaaagggcgaaacatcctctacaagcaaactgctgatgtcactgtgcctaccatcgccctgcaacagaacccgccgcatgtcctagtgttttacattccttcaaacagattcgagattaccaggattgcctttgttgtatcaacacgcgccgcacggttggttctacttcacagcgattaccattttttttcttgggaggccacacagcttgttgacgacctgtttagttctttaatgcctttgttcgtcggatccaagttctgctgagcttttcgtggccaccgtggtgagtgtgaatttgaggaaccacataatcaaatcatcctcagttgagttgaaaaaatctcactgccacacgcattgtacgaagcaaggagtccaaaagagttgaattgagggctccacaccgagcctctgtcatacagacagcgaagaccaacagacagcggctgcgttattatgaaagctacactgtatcactagagataaactccggatatggattcatcttcagttgcggtaacaagtgtgttccagtagcagtcaaacctcctttttcctcacgcgctcagcgcctacactaccagacaccagctgaccgtcaccacatattgtaaatacagatttctaggtaacttgcgtgtaggttttttttcttagactcgcctccacttagcagcgcggtggttgggggtgggagggggggctctggtcacggcgttaaaacgattctcgcttgcctctgatttaattactctcgggaccttctatttttttgtccattgtgcctttcacaaggacgcttgtcccctgttgactcacaggactgcacagaagccgcagtgtgactgcacagaagccgcagtgtgactgcacagaagccacagtgtcaccagttccgagacaactatggtttttgccgggacccctgctgcgctgtttgtcgcgacgtcgttgtgcgctgcatgcaggccccgaattagtcgatgatgggcggttgtcgtacgcgttcttcgcagagacacagacttcctcaaaggacgcgaaaaaaatggctttgagcgtccaccgaggcttttcgctgcctcctttgcgcctctaggaggcactccagccttgatcaaaaggactcgactcttccgtagctgccgacatggtcggctgttacgcgcatgcgcccggtttaatccgtctgacagtggagtctctccttttccactctgatttaaacaccccacaggactgaactgcggaagcactcgttcgaggcggcggcagccgtctgtctttgctttggtcgtttttttttctcctctcctgcgctggcgagtttccacggcctcccgtgcgacccgcgcgactcgcgcgattccccagaacacactgcctctctgccttcaactgacatcgaggtcaacgactgcgggagctaaggacgcccaagtttgccgagaaaggatggaagtgatgaggcgacttgcggtcgcgaatggggaggttttcgtcaagccgagatcccatcttcaggtctcaccgctggtgcccggtccccagggcagggcactgtaagtcgcgcatctctcgtttcgacgaggaaaaaaagttcgagtcgcaaagactttcctcgccatttcaaaggcttcaccctccccccaaaagctctggaaa

SEQ ID NO: 3661 - DNA, 2043 bp, Toxoplasma gondii
aagagacccgtgtctttttcttggcatgtgtcgagaatagagaacaactgcattaaactgtgcgctgtaatacgtgagtcgttcaaagctccattgagtttgctacaagatagcaggagatagccaagtcttccagcgtgagacttgaaccgaacaaactgccagtcatatctgctggtcaatgcaaccccgcacactgagacacacacacttctatgcaagagcaactcgttatagggttaattttctagaggtatcgtcattccaagaaaaaggcaggaatagctgaggaagaaggaagttcaccgttcgactggacgaaagaactgagagggcaaggtctgagccaaacaacgaatttttggtgccacgccatggtggccccctcgcatttgctgcttcacgggtgcgtagttaaacagctcaacgaaacacgacgcgtttcgccatccagccacacgtggtagtccccgctacctgcaacagtttcggacagccgtttgccctggaagatgaggctgacggtcaggcagtatgtcaagcgcgacagtcggaagtgcgtggatgttctaaacgaatacgggaagttggcgtgacgttatctttctttgtcatcacactgtgttgccccaatcaacagatgaaggcgtttaacatagactctactgggcatacgtttgtactttcatgtttgcagcctcatagaaacaactgggaatactcgcataatggcatctcccgagaacatacacctacatgatgagccgccagctgaactctacgttttccggggccacaaatacttcaaagggacatctatggtgatccagccaaggcactgcagtaaggacatgactcccaaacagacttgctccaagcatcttcgagtgcttacgcgattccgttcttgagggtggatagggcacgctgtacccaagagccagctggcaaggcagaaacactgcagctggttggaaaacgatacctcaactaccgagtcgggatctcatgttcaagaccaacagtgttacagtgcacaagacaaaaaaagctcagcgacacttgggtagtattgagaagagtgaaggttcacacgattgcgattcatgctgtgtatgtaggatcgagcttcttccgtttacgattttagccgaaagaagtgtgttgttttgctctatagcgaaatctaattgtggcagctggtgctgagctagccaatcaagtttgagcgctttttttcgttttcttttcccggtgtgcatgcgcaaattgaaccgctgttgaattagcatgtggttgaaaaaaaggtgtgtttcgctggtttgcttccattgctctctcagttggcttccttctttcatttaaattctgtcatattgttcctggttatcttctcttcttcgaagtcttcaatctgctctttcgtcgcgcttgtctcgagcatcttcttgtcaggttcttcccactctgcgcaggagctttccccgctgttgtttatctgtcttcaccctccacttcttccctcctctcactttcgagttcttcgccgttcgaagagatcactccccactctcattggtgcattcgtttcgagcttcttatattccagccgcggaagcggctgtcaccattatggttcatcaagtgttcgtggtcgtggtgtcttgaagcaggtcttgtgtagtccccgatcacaatctcagatttgaggaaaagaaccgagcgcacggcattctagtgctttcgaacgggctgtctaaagttcctgttctctcaggcacaccttgcgtactggcatattagggtctttcgagttttccgcatcacggaaattgtgggcattacaaacgagcgctgttttcttttgtgtgccttcactggcgcttctgcaatccacactgtctgccttccctgctattcgccttctcggaaaactctttcgcttcacggaggttcgctggtcatgcactccgtgtcgggcgcagagctgcgcgcgcgtctccaccatctcccggtcttctcttggatgtttctacagaagca

SEQ ID NO: 3662 - DNA, 3394 bp, Toxoplasma gondii
aattctagaagtcgcactttacgggagcgcaaggaggctgcgtctgacactcagatacaccagaaggtcaccgttccttgaatgccatgatggaaatgtttcccttttaaggactgttccaccttgccgttcggtgggtaatcccttaaaaaggcggtcgctcggcaccacggaattatgcacggacttctatgtgcatacatttcatcaacgatcgtgtacttttttgtccgtggaaactagtcttgtatttttttcgtcgaaagcgtagttgaacatgcgatagggagcttttgaaacgttcttgttagcgcgacaaaagtggctgctgttctgcggtgaaaaagagacctagtattgcataataacatgtaatggggagtctagcgtcacttagtcatcttaatagtttaacacgccgtttgttcaagtgttctatgtttgctgcctagaccacgttcggtaaagatcacaagcacctggggctctcattctataatgttaaaaaaacttggtgtctagcttcagtagttatctgattggtactgcatgcctctgcgaattgatatccggtgcctagaaacagggtgtgaagataagcgactgaaatgcataactttctgaggagttttgaaattgcaggagcctgctcggtccgtctcgagcgacctcacagaagatgcgctacgtgtcatggaggaaaagaaacgcgctgccatagcgaaacgagaggcactattgcgggagaaacgacgcttggccgaaaaggaaaaggcgttggttttttgaagttcctcaagagacgcgatcgccagctaatggggtatctttttacggtgaaaacccttccccgaagcgtgtacatcaggttaagcgattctggaagcttttggtgtatgccagatttcgctaattaactgaagactctgcctctttcagtgataaaaacgttcactgttcgtctgcagcgtgtcgaacactctgtctatcacagtaactcgagatgtttgttgcgacacccctgacggaggacgaatccgagaactgattgcaaatttcgttggtcaattgggagcacttgtttttgacttgaagggaactcgacaagcgatgaggacgactttgaagctttcgcgactgacagcggttctcacgacgtccaacccaaaagaaactccctcgccatataactaaattcagttaggagcggtcatttgccgtcaggtgtagtatgtggcggggttgagaacatttgcagacaatttgttccccggctcttaagatcttctagcattgtgtgggtgatgtgttacttcgctaattaaggaacacacgcccagaattttcccctctttagggaaggccgacttattgatgtgcgccttcaagcgcgcagcgtggcttttgacgctggtggaaggtagtaacaagatattaacaaacgttacgcgagccatcgggctccgattagttgctgtgatcattttataagatacttgagattggatatcagttttcaaactgttctgaatatcggttcaaagagtaccgcatttatgtggagccgcggacagtgagagaatcggaaaaccccatgactttgtctgatacccgtatcatgagtactcccaatctcgaatttcctgaatatataacacacacactacctcctgaattgttatacaaccggcttgctttggagaaacacctgatcgccgccgacaacccagttgtctttcaaggatcccacctcagacgttttgtgcttttaaacgaggaagtcatggccactggctctttagattcttcatatctaacagatattctaaaacatctaaccgggtttttcgtcgaagttctctggtgacaaatctgaaagatgacacagaagaggttggatctggatttctgtcgtcatttccgctaatcgctgtgtagcggaaggaaatgcgacaagatgagaagctaggccttcgttcgtggaacgggtgtacatcccctcctccaactgttaaaaatgcagtaattgtggagcgattcctcagcggtttatttttacgcagctagacactgtttgccgccaaacagaagacatagtctttgccagctgttagtggagaggacggggtcgacggcgtggcattgagccggatgtttcttcgctggggagacgaagccactccgtacgaaagaaagcgctaatggatggactacgatgccacataagtttccattcccattttcccttgtgtgggaatcccactgctagtgttctggttctttctttctgcgacagggaccgtgttgctggtcttcagttgatgcggccagcgcctcaaacctaatcgagtgagctgcagaccagcgtgcacagacttcccagtgagtttttattctcctttttcctgtggtttggtaagttgtcttctctaaatgtttaccccgggcaattctgccactgaggtgccttttctttcaatgatgttgtctatctcttaggtggagctttcccgtacacctcagctccaggactgcagcggcccgacttccaactgagcgcttgcggctaaagtttctacccttggccaacccgcgttctgcgttacgaactctccgcggatgcacattcttcttgtgtatttctgctttgcctaaacgtatgttccaactcataccgaatgtcccatcgcgtccctgaagtttgatgcttgtagatacggaaaggtaggtgtgttcagcgaggccgctacacacatccgaaccggtgttcacatagtatgcatgcttaatcgtctgattgtttaagcaaacttcactttcactggtacttgtcaagctggtcgtagctgcgttcaggaactcctgctcactacaacttgctgcctgaggtttgcgctaaaaatatgacagagtccaagtctcatctctgtcttcaacgttagaaccactcgcatcgttcagacttaaccgcactctcggaatcttgaagagcgacagtctttttcttcccttttctggctgccgctgcttaccccagctaaaagacctgggtttcaatgttcgacggctgtcaggcatttcatctggggccgtgtcgcgagtctttacgtcttcgatgttcctcgacctgtggcaccgggattcgctgcgcatgtgaatatgcatgttcatgctttatctccacgtttttcttccacttgtgcgtccaaactttgttgcgcactccatcgtttgcagttctgccacagttccacattggctttgctccggacttgtcgtaccggttttttttcgggcgagttccggatcgcaacaagccctttatgactgcctaccaaagcattttggtcgtctttccaacctgtctgtacacgcgaagtttcagctgccacca

SEQ ID NO: 3663 - DNA, 1861 bp, Toxoplasma gondii
taggcgtctgtcgaggtacagcgaaccaaattcttcaaaggtttgcgaagtgtcaaggatccctccttcgcctttctttcgaatgactttgacgaccgaggacgaagaagcagagacggcagacatcggagaggcatcggcgggggagacggcgtacgcgcccgtgaggtcgctggactcttctgtgccagctgccggactctctcgagtttcctgggccttagtcgctccgctgctgttcgcctgcacagcttcttcactgtctgttgcggtagaggactcgtcgttttctctctgttcttcgccagatccacgctcctgtttcgcttctcccgcttctcctgtgccccttcgttttttcgccttcaccgccgcaggcccctcgccttccctcctcgccttctttctcttcccactgtctccagaagccgctgcatgcagagattcgcctttcgcctgactgctctgtgtctccacactctcggacatcgcgcgtaccgcctgggagacgctcttcgtccctgacttgcgcctccgttccttctcgacagctgaagaaggagaaagctcctctgtcgaagcagccggctgacgcgccatctcgggagcgaagagaggtagaacaaccaagtgggaggaaaggaacgaagaaaggaaaggaggaaagacctggtaggagggagaggagagagtcaagaaaaggacagaagatgtcagacagcggaagaagaaaagaagggaagaataaagcaactttttagatgtgccttgccgagagatgctcatacatctagacgaaaatccatgcgttatacgagcgaagtcacgctgcaggtacaagaaacaggcatcggaagcaaccttttccgacgtaaacagtgcagataacgaacgcagctacagaacacaacactgcacataaaaaaagagagaacagcgggcaattttttttctcgtcgacgaaagagagcccattgccgctctcttgtggggcgagagctgagagggcgtcgagcgccgacgggacaccgaggaagtcgaaagtctctatcgcatctatcttcgaagcttccagctaaagagaacttttcttggtcagcttcaaccttcttgaaaaataacgaaggaagtaagacccttttcgcgcctcgttcgtccacttttaccgccaattgactatctgtggccgttgcatgcactcggcgcgcctgcgcatgcagctgctaatgctgttacaaacggcaagtcgcgagagaaagacaaaacaagcctttctctctgctcagcctccgaaatctctgactgatgacgaacacagatttgcgcttcaattgtggccgtcgtcacatggcctcgagctccacatatccctgggaagcacccagcgacctttccctggctgaggtgtatgtacactcaaggcggcgcggacgaggccactcgagccgttgagtgttcgctgtgttcgaggaaatggaacgccgcgaaaaagatttcctcttttgtcagtgtggtttgtttctttgtctctgacggcttatgcttgtcgcctcctggtcatttttcttcgttcccctctgtcctcggaatgtgacgcgatccggccttccgggcctctctgttttccacgagtgtgaccctgcagcaggggtctgagatcctgttttcaatgcagctaaaaacggcagtctgtccattcttccttgcaaggaaaagtccccgagtcgatgtcgatttttaaggaacgccactttgcccgcgtcttccacctctgtcttccttcgcgggggttcccccgcatcgtcacctttcaccgagaggaacattctgatcttcgacgagcagttcagacacgcgacca

SEQ ID NO: 3664 - DNA, 2065 bp, Toxoplasma gondii
tagagcaggtcctctacgacatcgaacggctgctcagcgaggagctgcgggggaagcagggggacgacggcctcctcaatcaaagtccagtcgtagacctgaattgcagcgaagagagaagagagttctgcgggaagcagcgcgtctgccttcttcactcgatcgcggatgaagcgcctgagcgtggctgcgaggcgctgccgtctctgcgtgggcgacaggtgggcttcctgcaccgcacgcagatcgaacgttggctgtgcaaaggagacgaacgacgcgagcgcgccgacgtcaacctccttcagcagcgcgtacgcgtcgaaagacagacccgccgccgtcgcgcttccgcgctcgtacaaagagagcagacaccccggcgaatcgccaacatcgcaggcagactcactttgggacggagagaagaaaacgtcgccagacgtcgccagggtcgcggcggctgcggcgccctccaaactcgagcacccgggagaatcttggggaaacagcggcgagagagacaaccccctcgagaaccgcgagggcgggccggagtcggacctccgcggacagttttccaggggggcgacgaacagcagagccacgcagactcgcaggagaaacgcggtgtagggacgcgacaataaagactctccggttttcagcggccacatcgtacacaacacaccgcaagctggacagacgcgcgcggaggaagacaccggaaaagagaagaaacaagccgccagcagcaagagacgtggcgcgcgaggcgacacacgaggaaagggaagagagacaacgcagaaaggtgagctctgcaaagccctcgaggatgcaacagctacagatacccagaaaacacagaaaaaccgggcagctacaggtgcctaatcgctacactcgagcgtcacgtcctccccatgctgtggtgtgtgagaggccgaactcggccgccggcggcgctcggcgagtttcgagaaagcgaacagacacgcaatgtcgagacgcgagaaaaaagcgtcacccctcgcgaaataaaaactgttccgccgcgtctcctgaactccctactgtttcgtcgcggaccaaagccaagcgacggggagatacacagacagcccgacagcccgcgagaccgacagcacacaagacgagatcgagaaaggcgttcgaggcaacactctcgacacggacgcacacccctctctctctctttctgcgagtatatacatgtgtgccggactgcggccctggagagactctgaaaaggatgttgcgctcgctcgtgtctcgctgggttccgcagctacttcttctcccgggaaggcaggagtcgtgcagcgaaccgaggattcactcccaacgcggtttgcgacaggagaattcaaagcaagggaccgtttccccgccaggcgtcggctccagacactttgtttcctgaacacaactcgttgggaatgtgaggacattttcgcagcaagagccaagccgtctctgcaaaagtagtctgcgccgtccccccgtaccgcattcggagaccgactttccgcgtgcgtcgaaaaccggagacaaacgggcgggcttccctgcgaacctcggcgacagtgccttcttctctggctcggcgactggtggccaaagatacctcttttgaattttttcgcccgcgaaaaattcaacacacacggatctgcagggcagtttcccctggcgtacaacaggtgtcggggtcccactgtggcgccgctggcgtgctttacccgcggaaaagttgcgaagttgcgaagagtctgctcgctttggcgtgccggtttccatgctgttcttcgttcccggattcaacaccatctcacaagcttcagtacgcgttcgagcgtgtagaactggcaccacaaacctgaaggtctaggccgcaattcgcagcgggcgacggctggtccagttcgccgccctgaaaccccggattcctccgtttttcctccgtctcgaacacacgctttctctcctctctctcctgagcgaagagttctgcgttttccacccccaaacttcgcgaaaa

SEQ ID NO: 3665 - DNA, 2266 bp, Toxoplasma gondii
gtcgtccatgctcgagttgtctttctggaactcctccaacgagtaggaggcttccgccatcagcggtacgccttcgcctgtcgccggcctcagcgaggtgtacaccgtttcagccgtgagggccgccgagaggcgccgcgctgcgcctgggtcctggaatccagatgctccggaattcggcggcagatctcgccctgtctcacgcttctcactttcctccgcgcggctctgagcatcagcgaaggcctgagcggcggcctgctccacgtcgtctgtccgcttttctgtgctgcggtccgccttggctcgaacgcttttctccgcgcctccagcgtccgccggcgccgtcatttcgcagcacagacacttcttcggcggaacgtaagacaacagaggcggcgggggcatgctgctgcgatccaaagagccgctgcgcgaggaaatcgaaaggccgacgtaagaggaccgccccatcatcccgcgcgcgtcggtctccgggaggctcgcagggtcctgcggactccgagtgctcttcatgccctccatcaggatacacacaagccacggggtgctcgtacatctgaggaaggacgatatgcacaagtcaagaagtgtacgtacacctcgggaagaacgctggaaacaagtcacgaagtgtacatagacctgaggaagttatgtccgtgttttcattcaagcatttagcgctcgtatcgcgtaaagtcggttttccagagcggacactacacgggacgcatcgtagcaggggcagaggaaggccatgcagaaaaggaaaaacggcggtagcagaacacaggttaaccgggaattgagacaccaaacaaaacggtggccgagtgaaacagcgggcaaattcgcctgccgcgtagtgagtcaagcaacagggagaaggccactctttcatcacagcaggcattcctcaggttaagtgcgagacaaagaaacatacctaggaaagtcggtgacaaagcctaggcagatgcatcgtgtagtcagagccccaagcaaaggaacgtattcgtggttttcagcggaacacggcattaataagcaactgctttgctgttcccttcttttcgtgtataaatcgcgtcggccctccacaagttgtggcaagaaagggggggaagctagcggttgaaaaggcggctggacaacttttgtccgcgattttgagagagcgaaggcggaagttgaatgagctgaactgggggagagaggggatacaaaacgaagcatgtagattgacaaacaggcgccttgctggaacaccgacggcgcgccgtctctcactctgttcggttccgtttttcgtgacgggagacgggaagccgaagcggctgtggaggtctcatgcagaattacatctctgaagccgacgagcagcccgactaaacaaatggcggtacattagttgcagcctcttcgattgtccgctgcgcctctgaaccagcatggcaccgatgcggacagccacggagattcacgaagacggcaaaagcatggaacgttttcgggtctcgtcaatgaatgatgtacagtgcggcgacagctttgtcctccgtattcgctgccaaaactcagaacgctttccaaccaacatcgtcttgcgctgtgtctgcaaaggagttgtgtaccgttttgacacgcgagcctccggtgtactcgcacgagtcacgggagacggaccagttcggaaacgtcccctggagctgcggaaatctgagacaacatccgcatcagaatgacttcattcgcatcggcagtcacgagacaaagcgtcgttagcgttaactcttacgaaaaaagaaacggcgggacaatacgcagtaggggcagcgtcgattgagtgcatgcagcgaaaattcgagctggggtggcatcaggagacgcacgcaccgactcgttctcgtgtcggtgcaattttggagttcttcataagaggatgtatatctttctagttacatattaaccagtaaccagcaaactgtataactttgaggaagtgcagtgacactccgtctcgaaaccatatttagtgtgttcaacaatctccacatgtgtatatcaagaaaggtgtagctttggaaccatacacaaacccactgtccttcgtcgggccagtttctatgcgcagcgacatgtcatgactctaatggtagattagcgactaccacagacgtaactcctttgctggcttaactctgaaccaacatagttagtggctacatcttccaaacaagca

SEQ ID NO: 3666 - DNA, 1932 bp, Toxoplasma gondii
aaaaactggcgagatgtggagcagactctgcggagaaaagcctgcaggcgacaagaaggagatggtcgactctgtgtgaggagacgacagagcagagactctcgcacacggagagagaagcgagagaccggcgatgaagaaatccgaactgcgaaagagaggggaaacattcagaaaaaccgaactctcggaacggagcgcatgcagcctggaaatgcttgtttctctcccgtttgccgtaccgagacgaacaggctttccgccgcatttgtggaagttcgaagaaataattggctgaagaagaacagactccatcttcggtttctgaatgcctgcgttttcgagagcgggacgctgcaagggtgcatgcggacgaggcgtaacgaggcgtctccctcttccctggcaacggtgagagactgcaaacgctctggcttcgtcgcgaaaggctttttgcccagcgagacgagcagacgcagcatgcgacagggagagagagagtggaagggagagcgacgaagtgagatagaagaagagagtgagaatcaagcgcagcgaaaagggagagggaagactgaaacgagcaggaggtactttgcacaagagacaaacgaaacaaggactgagaggaaacaggagagaaaaaaacgaaaggaaatggggaccgggagagagacgaggagaacgagatcacagtggcggtgctggagacgagacaacggtcacacagagcgaggagacggggggagaggcggagagaaggaatcggacatcaaaaccagcagggaatgacgcgagacgacaaccggatgaaaggagaagtggaaacaggatatccttatacactccgagactgggaggaatcggctgtgaagactcgactcagaaattcgttcttcggagagctgaaggagactgggaaaaggtccgcagacctcttttcaagaaaggggtgagaacgagaagacccagacgcaagaaaaaaggattctgaaccgcgcgcgatgttccggctcagggcgcatggagaggcggtcgcgtctgcagtgaaagaaagagagagtgactcccgcagaggaaagaagcaatgtgtagaaaaagaaaaggaaatccagaagaaaaaaaacggagaagacacaggaaacaacgaaaaacgtagtgtgcaaccaccaggggggtgcatgcgcgagacaagcgcgcggtgtctctgtttttttctctcacgaaaacgaagagaacgaagagaatgctgttttctccttcgtgtctttctccttcttggccttgaaccgtcgcttcctcgacctttcacagaaaaacgaaagaaatactcttctccagcgactctcacgttccctcgaactcgctatgtctgcctcgcgacctttcgccagctttccaagctgctgtctttgagagagcgttccctccgtccttttggaacgaatttcttctctccaagaaatcgcctccgcgtccacaccccggacgcgtttcggcatacaaagacctgtgcgttacaaccgacgaggccgtccggcagagtcgaaaacaagaactttccctcaatccgcgagaccgtttctgcatgggcaacggaagtcgattttcagttgcactcgaaaggcttctcttcttgtctccgacccaggacgttccgctccccgcagaaaaatctgtttctcttcggcaatcaactgtggatattttggtgtgtaaccgagaaacgctgcgccctcaaaagaagctgtcctgaagctgtctttgaattcacctgagtaatgcagacgttttcgcgagcatgcggataacaaaaaaaaggagacgcatttctttcttctcctctaagaccagcgagaaaacgccggctgcttagggccgcctccaggaaaactggagaaactcgaggtctaccgagggcggcgaggaaga

SEQ ID NO: 3667 - DNA, 3806 bp, Toxoplasma gondii
tcttacaccttgaaagatgagtgtttctagttcatccgggtgtcttgctactttctctgtctctccttctccgtgctcctctgctgttcggcgttggccctcccagccagcctctgtctccgtctgtccctcactgggacccgaggcttttctccgcagctcgtggagcttctgctgacggcgcctctgttgctttacggcaacccgaagaaaatggagaagacggggcacacgcacaacgtcaggatagttagcaaacgcctcgacgagagacttgggaggtgggattgttgcagcgacccagaaggcgttttcgttctcttcgggtccctcgatctccgacatggacaacagctgtgctgccatctttaaaacagtagactacgaatgggaaacggctcgagtggagcgtctcttgtctatcaaaactgtatactattggtatcactttcgaggtacagtacataatccctgcccggtcagtaacacgcgaacggcggctgtattgtgggagcccagaggtaggaaaaagcgtctaaacaggtgaacacggtgacaactagggggacggagaggattcgataaaacatggagacaaaggggaaacagtggctggcgaacaggagacagacgacacaagacagaggagcacagagcggtgggaagagcacacgggaggaggggcttcgaagatcttgctgggggagtttgaaggaacgcaagacaaccgctggagctcctgagtacggcgcaccaaataagcagggcgagagtaagtaggcagccgaaaaagaataaagtggagggaccgaacaaagagtgaagagcagacagcggaagctgcctggaggggatcggcgggaattgccacgccaaaaaaaagcagacaaggcaagcggctgtcccacaagaaagactagacaaatcgatacgggaaaaatgttgatgagaggaaccgagaaaacgactcgatgaacaacaggggagatatttctgttcgtaaaagccaagctcgttctacggcaggtgatgcgggctttcctgggccgcgccagtggaggccctgacgattggatgatcagtttcaccaaaacagctggcaataaagggtaggcaaccaggcaagggcaaaaatcagcctcaggcggaagtgggttacagcagtgcaggaaaaaacatagaacgactaccacgataagggatcattcgctcgaattctcctatgtctaaagagaaaatacgtctcataggcggcgcccaggttgctatccgcaaatcgtgttaaaggagaatggaaaatagcggaaaagccacacctgggtaagttcacagcgatctcattttgtaaccgggaaatccggccatgtcgtgtgaccaggtataaagaacgactcagtagtctcatgtttcacatcgatgacggcatccaacacggaaactattcattccggttacgtcattttccactacagaacaacgggtcattttacctagcagagaatgggacgaaatatgttcctgagctgagaagaatctgcaacagtgtgaagcaaaacagactcagcagttcatttcctctgaagattcacgcattgacatcccagcaacttgggctaggtgtgtgtagctcgccaacaaacaatgcgaagttcccactccagacgggcaagtcgctgacgtctgtgacggtttccacagatcgagttaacagtaagcgaagaatgggaaaaggatgcagataacaagatccaccgcgacagaattggagaaaaaaagcgcttttttgttcgtggtcgtctgcgaaaacgggtgtgcagcgcttgcggtttttctgcatgccttgttgcgacaacgaatttattgtcccagacaccgacagtcacagatgccaaagctcggaaacataggctgaccgcctcagggatccactggctgaggaaacgacaggataagcttgaaaatcagtcctcttcaatctacaatatttttttcgcgcgtcattgtggcaaaccggttttatgggcccgtgggtgcctcgggacggtcgatcttgtgcgcagtctctgccacactagtccgttaggaatgaccagatgagcgtttgtgttccaatgaagcacgtgccaggtgtttgtggtgtaagattttcgttgcacatctgtttattcttgcgagacatactggaccgaattgcgaactcgattgtgctgactcacgactcgagatttaagcaaagaagtgatgcacttcccaagagataatcttgtgagcaatataagtagtacaagggaccaacttggagacgagacgggtcgtgattgtacgataccgtcagaaaaagtccgagacactggaatcattctcgagtgtcctgcgttgcccggatgtgtagcagccgtgcccacgtgcgttgaaacaacccgacggtttttgagctttccggatgacatgagaaagtctacgtcacgcaacactcatcagtagattggtgcttctctatcgaccgcgtctgcatcttcagcacccgcttggaacagaagacacacggcctgccatcactaggaggactagtaacagatattcaccggacaaggtaaaagacgatgaacaacgcaagtctttgaggagataggtttcacactggagacgaagaacgcagttctggtgccagcaacggagcctgtgtaacgcacgccgcttcgtgtgtcatgcgcatcataggatacgcggaactgtatatcgataatccccagctgtgaggtggagtagaaaaagtcgatctggccaagaaggagattgtggcatccaaatggtcacctatgctacggacaattcccccaaacatgtgtgtcctcgaaggggctctggatcacgacgcaagggtaaggctcttcgaacacgcaacactaccgcagcttgaaaaacaaagacacacttaatgtatacgatatagggcctcggcttttaggcgtgggatcttaaggataagctttgtctttctggtttcggtttagaatttctagcatcgaatttgtttgcggtgccgaagtttcacacataaatgccgaaaaccccccgttcttacgccaaatggcaggcagatgccgaaagcactcgttggctgtctcgtgagaaattgttgttacaaacataaatatgaaagactacgcggaagatgaggtgatgtccctgattcccattcaccatgacgatggctggatccggggccgcggagagcggaggaatgtctccaactttgtgcccggacgctctttcgactgcaccgtcttcgcaacgtttcccagcccccccaccccccacgacaaccaccactccgtccacacatacccgctgcgcgctgccctttacgcttcgatgctacccgaaactcaagctttgacagtttattgactttgatttggatacagtggccttgggtaggagtcatcctgcaccagtcttgcggagcttccccgttgatgctgtttcgatattagcctgccggaaaccccccccgaaagtcacatatcttgtgcgctaccgatagccaccgccgcccggagttggtcatgtcgacttgcactatcgggttagcgtgccgcttggtcttgccctttgtctgcttcgagcaggaccacttctactccaaccaacagtggacccagatagttcagactgtcaatttgaatactctctttttgtcgacaacacgccgtgaaacctttcagcagctcttccctgccggccgcagtgggtacatgcacataaactgcgttgttacgaaacgtagcactgtctgatcaaca

SEQ ID NO: 3668 - DNA, 4128 bp, Toxoplasma gondii
ggccaaggagttgccaggcgagagactttgattgtcgacacttcggcgcgtctcctgcaagtgggtgtgtcttcagaagcctcgctcgaggctgatcgtgcctgtcacggggggctcgtcgcgtggctgcgagccttgcctggatttgcgaaggcgcggaaagccgttggacaagtcgagagactttgtttccaaggagacgtagagagtccgcactactttgtgcttctcctcctgcttctcgtccacgtttttgccagctcgcttctgcacctgctcctcaaacacggagcaggccgcgccgcggcagtcgtcgccgcgctggcgctccttctaggggtgtctgtacagctcagactatccgtgctgatcttcagaaaacactttcccgcgggaactgcgccgccggcgccgacgcttcgcgaggttctctctgcggtttctgcaagtgtggcagcgctgtggagacatctgaagaaggtggggagagcggcaggtagggcggcatttgctgtcggtgaattggggaaaaacgcgctgcatagatcgggactctttgccgcggccccggcctctgtcgcgtttctcgagcacgactcggggcgcgattcgatcgaagttgcggaactcagtgtgcgcgggcggtttcgaaacgctggcgagaatccgttcctatgtgccgtcggggacattcaggaaattcgtttgtctgaagaaactggccaggaaaatctatctcatttgtctctcgatctgacgggggtaaggcagtctggcgacgaccaccgtgggcatttttcgaagaaaacctccggcgcaagaccgttcgacgacgcccggaaccgggactgtccctccggcgtggacgacgctgtccggctttcgtggacgtctctctgctttgaggggtacattgtttcgcccgttgctgcacttcccccgttgctgcttacgccttttatcggcttcttgactggtgtttttgcggggcttgtgggcataggcggcggcgtcgtcttctcgccgtttctcctgctcatggggaacgaccccgtgtccgctgtcgcgacagcatccgcgtgcgtcgttttcacttcttcgtccacctcgctccagtttctgctcataggccgactccccattctttacgcttcgctcttcggcctcgttgccgccgccgcggctgcatgtgccacctgtggaattcacagactgaggcgcgccgtcggcggcagaatgagcgtcattgctgggtgtgtagcctctgctgtcaccgtcgcttccgctctcaccgtgtggagatgcatagaagttggcatttatggcgagtgaagcggagcagaaacggtgaagtagcggtcgagtgtttgtgggatttctcccgcgataggtagtaggtacctcacaggaagacgaaacaaagagccgcttcaggttgatcacgactgttggttcactgactttccaagcacggggtagagacaaagtgtaaggcagaaaacgagttttgacgggaattagaatcttctatatcttcttggtggtaaagacggaggtttagtaaaattgaggggcgagccgctggcctcgaatggttcaggaaaacggccggggaaaatgccactctttctgctggagtccagtgagcggtgcagttgtgtagacggctgcggatgtgggaaaaaaatgactgcgggtaggttagtcgcgctgatcaagatcggggaacattttcgaggcaaatgcacaagagatcttgtggctgatctctttttcgaaagacggggaacaaagcaggcggtacacgcctgaacggatagaaacatatgtggaaagtctgctctcgcgacgcgcgtacgtatacatgtgctaggtagttcaactggatgtggcgtcggcggttcgcactcgtgtccctgcccgtgtaaagaaagaaacagcaaggcaggtgcgggaatcgcggaagtggagggatttgttttggctcatctcatggagacaccggcgtggctttttcccaggtgcggaagcatcaacaaaagatcactgagcgatctccagggtcaggttcgggggcgcggccgaacgctgtcgaagccgccttttcttatgaaacaaactctgtgattttcgtcagcgtaaaatacctctggcaagaggaactaaagggcacttgcccgggtgtaactttcttttcagtgaagagttaccaagatgacacggtgatcgctgtacagagacaacgagctgttaccgcaccgcgtacacatttctctgagaaaaaatccattccaacactggaaggctctaaccagtcacgaagtcaccgctgccgtcgcctctgacaggaaaatagaagggaaccgagagaacggaagaacggagaaatggcagtccgccggtaggcagggaggtgacaataatatagatgatcagggaccggggagcagactttgtgacgcttcttggctagtgcatcaaaaaagcgaatgtaaggtgcacaaaaagtgagagtatcttggctcacttaaagaacgatacgagatgcggtacactgaaatagtgaagaaagcggtttacgagcaatatgcttctgcatcccctcaacgtttacagccagtttactggtaagcatgtagcaacggagctatatatatcaacaaagagagatcacacaagatccgcagacagtgcgttagtttcgctgtattacacacacacagcagaatcagagttttcctgtgttacgtgggggcaaacaggatatctttcagatctaaagggtcaattcgctctgtttctttcttaccctacgtcaacactgccgtcacacccaaaacaggcagacaggtttttttcaaactgtgatcgcttgtcccagttaaaagaacgtctggcacaaggtcggttcaacaagggaacaacccgactcaactggtaatcaaccacaccaccagtattgtgaataatgtaacaacgaacacagagtgcgttccaccgatgagactcccgggtctcagctccgaggaactggtggtgcgcaatgtctccgtccgcctttgattcttaagaaatctaggtgaaggacagtgcgcaatgagtgtggctttttccagaatcactttcattctgttccgtacaacccgtcgaatgttgaagaccaatgcgcatgccactcggaaacttgcccgacgtgcgagtgatctgtttttttcctacgagatacaggttcccgtgaaaatgaagattctaaaagtgaccgcagggtaacccctcgaggtaacataccctgcaacactgaaaactcggcctttcttgtggcaagaaaggccgtttctcacccgctctggtaaaaccgcaagaatccctaaaccctacagcctagacgtcaataccaggaacgtgcgaggtctctaaacaaggaacaggaaggattcgcctgggggagggacggtttttccagagacctcgctggttccatctttgaaacaccggagacgagaaacaccctctcgcgatttgcagcgatccgcgtttcgtgctttgaagtgactgcagcgttttcgtgcacgttctcgtgacctccggggtaacttcgggcaagagtcggaagaccgcatggcccttgcgaggtgctgcagcgaagatggcgaaactagcaagttcgtctccctcctccgctggccgtaagaggagtggagcgtgtcgcaatcgaactagctgcgtggactgcaccggcgtttggttccgaaacttccgtttaatctcatctaggtgtttgcttgaatgacccccctcctctgtgtcattttatccttccgcattttcggtgtcgaccgaggaaaatcgagcagcgtgcacgagctgtgttccgcgcacggtgcgctgacgcgttccaagccccgaagtgaatcagaagaaactggattctgcgagtatattttggtaccttttggggccttagtttaacttggtaactctgatctgttctctcgggcgcgtggtgcaattagtaagcttcttttcgcgggaattcgcgatcccggatcttgcaacgcctggcagcttggcagtctgcgccttccttacggaagctgaccatccgacaggatggttcttcgaaactca

SEQ ID NO: 3669 - DNA, 1549 bp, Toxoplasma gondii
catgttcgtgtccaggagcaaatgtccttggtaccagtcgattatcaaactggtgttcctcagcacagagacgcagtatacatcgatatatatatatatatatatatatatatatatatatatatatatgcaggtatatctacatttacccatgtatgcatatacatatttatctatctatgtatatatataaatatatttatatgtgtatgtatacatgtatgcttctcacgcaggtaaatatgaatgtatgtgtacgtgtacatctatacatttatacgaagaaaagttcacgttgcgtgcgtgagaaatgtaacgatatgtgtttatcggagatgtaaaataagaggaacgccaagaaactccataactcaaataagagaaaagagacaacattgttctgtctcgtctggctttctcttatagagagaaccggaaaaggaagacagtttccgctctctcatcacatgttctttcgcctagctgaacgtccacatgaagacatcaagacgcgtcttctccccttctcttcactgctagtatggctcgtgcgtttcaacgtttcctgattaagtatacacatcatgttcctttccactctttctcccccttgttcgttctttctccctcgagttctctctgtctctccctcgagttcttccttccccgtttttttctctctcgcgcattttttctcttcttcacacgtttttttctcgatttctcgccctctcgatttctcgattttcgtgtatgtggtattcgcgtttggtccgctccatctgtgctctcgaacgaagactttttctgaatttccaaagacaacaatcgaagggcaacgacagaaacgaaaaactgggcctcgtcgatggaaggaccagtcaccgcagatgcgactttgcctgcatgcaaggccgaaaaggtctttccttttaaaaaaaacagtgtaacccagaagcgactgagaagtcttgcagatacttcttccttttctgatgaccgatatagaaagaagagaaggatgaagacacacaagcagatgcctttttcttcgtgtctctttctccgtcctcctggatctctcagggtcctttttcgcgtcccgcttctcgtttcttctttcctccgctcctgcgacttctccgtctctcgtttcttgccgtctctcagtctttagccttccattgtgtcttcctgtaccttcctcacctcggcgctctctcgtccttgtctttcttctccctcggttccgcccaactcctgtcgccatctcgggtgcatgcgcgctgcagcaccctcccgttttcgccgcctaccggcaaaaacagaggtgccaagctgctgcaaacgccagtgtcttcgtggatctccagacgcgcatgtggagacacgggcgtctccttcgtttcgctcctcgtcttctgtgttgccgcatgcagacggattttcgcgttcgctgcgaagtacaggctcagctttcccctccgaactctgttgcctgtcttcacgttgatgctccttgcttcgcgcgctcgtaacgcctgctgaa

SEQ ID NO: 3670 - DNA, 2333 bp, Toxoplasma gondii
tacgtgatcttgttcgatcttagtctgcccagttcggtgtataaacggaaggcatgtctccttatcacgcgttaattccaggttctcctcgagccgtcgatgccccgaacgccctcatggtacgggggctgtttctcgagggcctgacgcagacacaagagacaaagtggagatgacacagttctcttttcagcgtgtgccccactgcactgttttcgattttggatgcccggtaccagctgatttaaaagcgtccttttgtcgtctgcagagacggaagaatgttcgtcaagtccctgaggttcaccatctcgttgaaaaaggagcgcgacggacatttacgatgctgtacgtttcgctggcctctttcatttctttccacgctgtgcttcacctgactcgagcatagtggaaacgaataaggagttcttcgcctccagattggatgtctagttgaggtggacaatttccaggtcacggcaagagtttttactttctccggcggcctaggaaaaggaaacgccagttacacccccgacacagattgcttcccgacctctgcgacttgctcacgtcacgagcgcttgccctcaagaaaacggcttcgtctacaaataagcaaccacagagtttctagacaggcattctcgtcaactctacgtggtggggcagtaccgataaaagccactgtacggagaagaggtcggaactacagagagcgaacgccacaacccatacatgttacaacaaatgttcatatatttgtagaccagttcgaataccttgttgaacgtgtctgcaaagtgctcctgaatcgtgaatatatatacatatatatcatatatatatatatcatatatacatttatatattatgtacttgtatgcaaacatggatgtccccgcgtttctcttgttttcggagcttgtgaatgaaaaatgtagcggtcaggctgttgttatgtaaatggacgagaagacacaccttttgcggatcattaaatagggcaggcgtgcgaggaaaagagattttttggtgcaatttgaacgctgttcagcagacaacaggcggcccgtgactctctctctctctcttttggtgagtggtatcggcacccacaatatattcaggggaatcccgttcctccttgaaatgaatactattgtgtgtacacatgtcgtattttcctctgattttctctctatgcctctcttcgtggttcctcttgaacctttgtttttctcgctttccaacctccctctcctcgcgttttggttatcagcaggttgaagttccgacgagaagtgtgctgtctcttcttttcctttcgggaacccaggtgtcttctgacagtttctcccctttctcttgccgcgtttttttcgttttctctgtttttttgccctgagtttccggcgtcgctgcgcatgcacaagaaaccagctcttggcgcgagaccgccttgaaaaaacactcgcctgtcctctcgcgccccccaccctcccaccgctcgccgggaggctttttgtcttcctgtctctgcgtttccctctccctttttcctggctgagctttgcgacttttcgggcaactctggaccctgccaagaagccgcgaacggtctgctttcttctctgcgcgtcttcttcacgttctccccgtcttctctacgttctccgcgtcttctgacctcgtcgcatgcaccacccccctcaacagcggtttccccaggaggaggtcggctaaaccatctccctgggccaaccgggaagcgtttttcttcgttcctcgtttcttcctccacttctctctctcacgtgcaagaacgggtgcagattcgctctctttctctcttctctcgtctctctcaagggcacagtctcagcttgctgatacgcacctgctgctgctagctgcgcctcgtcttccaggccggtgtcctgcacagcttcgaggccgccctgagacgaaacgctttctctgcttcttttctgtttcaccctcggtctgcatgtcgctctttgcggtccatgcacacattcttcctgacggcttgtcaccagatgcagatgcgcattgaatttgaaagctgctcttcgcccctccgcagaaacgactgggaacactacggaatgacgcacagtttttcaagacacgcatacatacatatatatatgtatatatatgtatatatatgtgtgtgtatgtacataatccatatacatttacataaatatatgtatatatatgtatatgtatatatgtgtatatacacgttgtatccgatgagggaagcgggcagggggacaagttgcgcgtgagttgggggagaa

SEQ ID NO: 3671 - DNA, 4222 bp, Toxoplasma gondii
aaaacgttctgcaaaatggagagccttctcggaactcctagtcgctcccttcgccttcgagacgccgcccatggtgtcagtctcgccggtggcggaggagacgagcttgtgtacgcgaaacagctccacagttctcgctggaagagtcgcagtgatggaaggtcttgatccagaacttgtcctctctgttctcttcaagctggaggcagcgtcgagaaaggcggactctctgacgagaaagaaaaggcagagcgacaggaggcttcgagaggtgtcaggcgaacgcagagactgagtctcaccctttccggacagacgaagaacgctctgttgattcgagcaagaggcatgccgcgcgactgtcgtcggacacagcgcgcaacagggacgttttcacacgtacaaacaagtcgcctgagagggtgagagagagagggcaggtgcgcttcctcgattggattcgcagaaacagggaaacgcgcatgcatcgacgagtgtctcctctggcgacgagtgacgaagcgttcgcctcctgagtgcctacttcattccaccttgactggattctctaccagatccaaagacgcggctgtgacagaaacttcacttttccgccagcgcgacctttctcgcggtgaggaaaaggatttgacgtatgctttctctggatggccttcgagaggcgccagtcccttgaaacgcgccgcaaactggcaaaagaaacagcactatgtcgcttgcggacgcgcggcgcctatgaaaagcaagaggagcccagaacgtctacctggacagtcggaggattgtcgatgtgaagaggacatcgtcaaacgcgtgaagaaatgttttgcgagtccagccacgcacgagcacgtcgactgagaggcggccggcggcgagtcgttcgaaggagggtcacgacgatcggaacgacacaacatgcagcaaagctcgagaaacggaaacgcacgtcggtctgctgcgacgagagaaaagcagcgtgaggatgtgcaccgaagaaatccagaaaacgagagagcgcagagtttggtgttcgggacgcagcctgaggcagtccaaaaatgttcaacttctcggcgagaaggcgacttgtcgtttcaggcgacacccggcgcagaaaacggtctagcgaccgatcccgaatctgacagaaacgtttacggaagaagacacttttctattgcggaaaactggtggaaagcgccgcacgcgagctgctggcgggtgcatgctgctcggccgatttgacagcgaaaattcgcgtttctcacgcacagccactgctgttcccccgtgaaaagaagggtggtccgcgaaaacacgagaaaagtgcacatggaaacagaacttctagaaattcctggacgggaagagacgcggtacacaggaaatcgccacacacagaagtcgcgtgtccaagcaatacactcgaagaagtggatttctgcgtgggctgttaagtcccaacgcaatgctgtcgcctgttcagcagagtgacttcccgcctgttttgccctgcacagacgaaagtctttaatccagtgcgtcagaaacagagcccaatctggtctgcacacagctgtgccgtcagcgttgttaccgtgtctaccttatttgtgtgcaagctgtacaactaccattttcattgctggcgttgccttcctcatggaagtctgaacggatgtttataggtttagtttttggtgtcagcctggcacctggttgggaggtttgttccactgaagcaaccagtctaaaatcgtaatgtttctgctgtagaacgcacgtagggtttcgacatttgtctacaggtttcgttcacacctcatccgtctattcgtttctgacaaagggtcttttcgcagatacgctcgtagtgtgcgggtcgactagggggctggaaaaagctctttcctcgtagacaagcgtttctgtcacgaacagaggttcctcattctgcgacagaaacgcagcgttacagttttgatggatgaccaaagaacccgcttcttgttttttctctgagtggttcccgcgagctgcatgtgtagcattttgtagatcaaaatctgtgaaagctccaaaacacctacccggtcaatttgtgcctctgcggaaagcaacgctgtgaatcttccagtgcgtcatcctttgttccagatattatagtatctttgcaaaatataagactagtcattcgtttcaaaaaacgttgagcgagtttgcttcgcctgggtatgctgctgcctgataagctgagagtatagaaagcgctttatcaacttcaagagcgtcgacacactgctgattcaaatctcaatttgtgcggttgtcaaacgtttttttccctctgctgtggagaggcagagactacacctttttctccatggatagagggttttaagtgaactgggagatcacaaatgcaccattttttaccgttttggtgatacgacgacataaccctaacctaaaagcagaagacagatgcgttgcttttgtggactgagatgtctcatgtggtgtaccaaccacattcaagagaactctccactggtgaggtagttctttctcttgtttgtctggctcttggttggcggtgcgtaaatgcaggaatagcagttaaccagtgcgagcgtcactttctatcgtaccccccgtcgtgttgtctttttcaagagttgagaaacgtttttctgcttcgatagcccgaaagaggaaatgccccaatgcgattgccagttcttggtcacatatttgaattagaatcgatggtacggaacgcagatcaggtttcaaggatttgcattgtgcgtccgcagaaacaaactcctagggaggtgcagtcgcagtgaactctttctgtttgcaggcgttcgtctgctgctacgctgcgcatcccgttttctgcaaagaagcaccccaagcacacacttatgaagtctaactggtgcgtcccgttgcctcctgggtatgtgctttaagttaaaaagctttacatcagtaaagaacacctcagagtcttccccaaaggtcctgcggtctctgtcaagcacgggtgactccatttttactctgcctagcaaattgcccggacgtctagtcgacgtggagttatgtgcaaattggtgtgtgagcggtgggatcgtttgcagcactaagtgcgcgtttccgtctgcaggagcatttcctttctgtctgtgcatagacagccggaacatgtgacttgactaccgcaagtgcttgcgccatcagtgcggctgcgggtctctgacaggtagtttccagcagatagcctagaggctgagcaaagcgacgacgacttgttcagcgtgtttacacatgactttagaagtacgcaatgctgaacatggtggatttccacgtcatgggacattcaggttccttcaaatcggtgactccgattttactgccaggtgcatacaccagcgtttccgacctcatcaccattcacacacaccccgagtgtctgctgctgtgtgtttttctcggttttctctgaggaagtttcctttaaacgttccaacttcttttctcctcagaggcactagaccgccccttctgcaactgatatccaaatggcttctgacaaacgccgagaggtaccttttgcgccccatggccgagtctccccaaagttgctccatcacatcaatatgttacacgtaacgacgggcgatttcgatgaaaaaagttgcggggggtaagcgtctgagcttctttgtctttttctcgcaagcgccacttcgtcttttctacgagacgagaagccaccacgcgtggcggctgctagtcggctggcgaggcgggtgagcgtgggtgtgagacaaccttttcagtttttttctccccccctcctctcgtctgcctgttcgaacactgcacagcgttctttctgtctacttctcctttctctcgaactttttcggtgtctcttctatcctcaacttttgcctcaacaatttagctggttctgcaggaaaccggatctcggttgctgcccttctcaaccacacaaaaaagttcgagttttccgactctccaacgtggttgcttcggcggtgttcgttgtcttgccttttctcgtcctcttctcctcttcttctgatcttcttctcgtcgcgctctcgactgttccccccaatcaattctactttcgtcgcttatctcgagaaaacaa

SEQ ID NO: 3672 - DNA, 2709 bp, Toxoplasma gondii
tcttcgcacactgtctcttgaagtccagggaaactccgtcgcaagcgggggcagagggcgtcggcgtgcaggcccacagatgcgccggggggaactgcggaagccacgggggtatgtgcagaggcggctctgcgctccgggtcgaccccggcttcacgggacccaggtcgcccctcgcgggcgcgacgtctgcgtaccccggggcccctggaagagcccctgcgcctccagctgcgggccccaccgccggagaggccccacccgacaggtccacccggggagttcctccaggggcgcctccggggcctgcagctgaaggtgaagcgtcaggcggcgacgcagctgcccctggaaactgagggccagtcccagggccgaggggcccgctccgctgcgcgtcttcgcgccctaccggtgcgtcgtgcggggtgtcaagggtcgcgggccccgcggcgagaggcgcggatacgcctgagaccgcgttggactcctccgcgccgagggggtctgcgggctcccccacgaggcggcggtacacccaggagtcctccgtagtcaccacaagttctgcttcggtcccttcgagtggggggttggtgtccgcctctgcgccgcgggcgagggcggcctgacgcgcgcggcgtcctctgccgtctgcacccaagaggacctcctttggctgcgttccggccaccggctcgacccccgtggtgcggaagagagcggcgtaggaggcagggcagacgtcgaacaaagcttgcttcacgtcgaagtagttcgcgacgctggtgccgcggatgtttgcgtagatctttgcctggcgcccgatggccccgatccggaacgcaagccaagatgaaacgtactcgagacactgcggttccacgctctggacacccttgctgaacatcatccaggcggcactccgctgcagcaacgcatgcatgtaccgcctacgacttccacatacactggggacagtcacgagcgtccggccctgaggcgccccacccgggggccaagcgccggcccctctacccgatccagaccctggaggggcacgggtcccgctggagcctagagaggatccggagagggcagacccagctgcggcgctctcgagagtcaagggcgaggccgcagacgcggggtccagcaaaacggtctcggttctgggtcgaggcaaccctgggagcggccccgtcatgatgtaactagtggcggggcgagacgccggaccccccggggcctgggagtcgagcgcggaagattcggaagcacaccgaccatcttcctgatgttgaagagcagcggagggcgaggcagcaggcacagcctgtcctgagtcgtttccagcgtagggcgccgaaggagtaggtgaagagtggtgggaagaagctggccctgcggcactggagtccgaagacacgtgatcgtcagatgaaacaatggctgtggagtccgagcccccaacggcaccgctttggcaaggggaggcccctgaaaaagggggtgacggaggatacattgcaccacgtggaggggacgcgagacggagagagagggtggagggaaatgcaaaaggcaaacagagactcccgcggtgctcgggaaaaagtggggagaagccgaaacgctaatcttgttccccgcagtgcagaatgttgacccacttttccgaggggtgtgaagtactggggtccttcgggcggaggcagcgctcaggcgacgaagcgacccacgggagacacaccacgggcaggccttattgctgttaacatttcttgcctagaaatggtgaaccagcgaaaacaaacaagcattctacgggtctactccatccggaggtccaaacgaaaaatgccacactgacattgtccaacgatcacggacctagcctggggctcgggcgtacagacaccgccggaacgaattctgagatgagattctcgcggtcgtctgagagattcgtttcggtccgttactcgtcgaatttgaccttgaacggagattcccgcataagcgaattaaatgtagagctggcgggtacccgagcatgccttttggaataaatacggggctgcaggcacatcaacagagagtgtcccggtgtgccagtgtggcgttccgtcgtctctttcctcagcacccccccaagaagtgctgactgctgccttgaagagttcgctgaaacggccagtttgtcgctaaatgttagaccattcagtagaataggtgcattccggagaagagccgcggccgaaggaaaagcaacgaggtacggcaaaggatgtggtgcttgacgcgaggggtcagacggcagtttgtacacatctcaaacaaacattgactggaaaagtaatacacagcaagctggcggaaacagttgcttatgtttcttccagtggacaccgcgaggctcagattctccacaaacaaagcgaggagaaaagccacccgcggtctccagcggagtggcagcgagtacacaccgtgttaagtccagactcgggacagactccgagaggaaaaataggggctttgaaaaaaaagtactggacaagagattgccaacaccgggagaacaatcctgcatgcatgtgccaatgaaacttggacagggggggcaagcaggatggggaaaaactcgattccgtggcagctgcttccacagaatttggggggggcaccacaacagaggagtcccag

SEQ ID NO: 3673 - DNA, 3810 bp, Toxoplasma gondii
aaaactacaagatatacgcattgcacaaaatggaatttgagaggtggtcggcaagtgacagagtgacggttattagacacaagactgatcctcagcttggcatgtcgggcaggagactccaaatagatgaaagacgacacacgagaaaagaaacacgaaaaatactaaccgcagaacggaatttttcttaccggatgaaagtcgcttatggacaaacacagcctccggttgggcgcgaaacgcccgcttggtgtcatcatgtagatcgcagggggcgcaaaagggtacgacgaagggaaaaccttcagcaaaacagacacatcacacaaaactccactaatgcgtgttgactgaacaagcactacatgttaaagaaacgaaatacattgtaatcacgaattaacacccgaacggtttctttgctgctcagatatcagccttaccagtttcccgtggtataaaccacctcggtatggtgtatcatccggaaggtcgtgactggaaagaacacggaacgcaatcggtcgttttgatggtggttgtcaatacccaacaaaatgacatatggagaaaacatatacaaacaaactccgtcttgggactcagacgagcaggcaatcccctatacaaaatacgcgcacacgataacgccctttgagatgcactggcattggaggacacacaacgtaggtttccttgtagggataactgagctcatctggatgtgcggtcgagacggttaccacaaacttcggcaaggcctacgatccagtacattggatatacagatggaatggacactcacatacagtctatcatgacagtgtaccacctcgcaacaccattatcagtggggccatctattcacacttccagttgttcaccgtaaacctccacattaaagacatggtctatctccttcgtcattcgctgtacatcgtcattcgctgtacactacaacatcctaatgcaacacgggtaaattcaactttatgcgctggtatacttctttatgtccgcaaaacgtacaggacatagtgccatgtcaggatatcattgtcgtcgggtctgacaagaatatatgggatctgatcctgctgaatagcctggtactctctcatcagccttccgacagcaccaccagcaacgggcgacgctgaggcgaccgctacgcgtgcgctcattgtgtctgttgctcctgtagttttccgggtgatgctacatgacatagaaatccgtaagcgttcgacgttttctgtccattcctttttcctcgaacaatccagatctgcccctgtcttagtctgtcaagtacgtcatgtactcgaaacaagataaatatgacgaactctggttacactggtggcggctgacatgtgaccgcgatcgagagaagccgtttctgctgcaggataccctgcacgaacagcccacaatgaagggcttttgcccagttcctgcagctttgccgagctggagatgaaacacacggaagaagggaaaatcggcaacatgaattatagactcttgtgatttcagccggtgaaggggcacgcaatatgcgatgaatgcaggagataaagaaaccatgttaccactggaggaccaatggctgcctctcgttcctttttcccttgtctatcatctgaccatctttgttttaaggcatggtagcgacagcgaagaagcggacaatgccagaacacctggaatataccacagagataaacgaataaacaaacttgaaacgggagacctgacagcaaacaggtgggcgactgggattgacgtgaagaaaaccccgatgctaacaaggaaggaaagacacggcctccagagcgacggagacgcgcagtaataaatccgagcgtgtaagctcgtgaggcgagggcggaaagccgtgtctgtccggagaatgagggcaggatctcctctgactgaaacactctgccacacaattatttccaagacaaaacaataactgtcacataccatccagcgtcggattgtgcgtcgcacaaccgtggaaactggtgtgcgtctttttcaacccacggtgtagattgctactacttgggggaattttaaaggaaaagatagagcggtgcaacgcttcgaggcgatttaactcttagttttaaaagatcattctgcataaagcatgtatctttcaggatctagacgatggctagcggcaagtagacatcgtagtaataactcttgtctgcgtgggacatcaaaaagtagacaaacccagcaggcaagaggcgcacagcgcagggatggacatgactcgacttcctgtgtacccgttgtcatagactaggcacaattttttagcggcaaattttctgtaggtttatgcggaagaggtttcgtcacctttgcaaacacatttcgactgggtcagccatctcgatgctggaagccttgaggcgagatttaaaatgagcacgggtgacgtatctcgtgcatcgtgcgcgcaactgtttagctcttcgagggtcagtggaaaacccacttatttacggaatccatttatgtacaatgcgtagtgggcgtcggcacacgccgctgtacacggtcctcacccaaatctgcagttatcttgttctggagccacaggtccatccccacaaaaggcatgacgtctatccttagccagcgcctgcagacagacacctgacgttgtgccgcttctgcaaactccgaggcgaaatggaattcgtctttggctgtattctgtgcaatacctacactcacgcggtggcttgttggaacccaactatgctaaaaacgtgcaggcaccattcagtacatcatctagtcgtcatgcaacctgcagatccagttcaccgcgacttccctgtgatgggataggttagcacaacacacagtttggattccgataaagaattctagtggctttttccgaccgcggcttcatcgttttcgccagtaccgtgttacatgcagagggaagacggacaatccgtctgttcgcctcgctgtttactttctgcctttctttttgccgataatacccgtccagttacgttcttcaaagccgtggagttgcgatgcttgggtccctcgcctcaacgcagggaagacacttgttgctgaccagtctcgtctccaggcgtggcacgagtgcgccggcaaaacagcgggaggctctttcccttggtttcctgaagatggccggtgaattgttccacttcagcgtgaatatattagagaatccacagtgagtgcttctcatgggttccttgcgggcaagttggtagaaagggacaccagtcacggctctgtgtctgcattgtgaggttggaccgcgagaacaccgtccaccgcgcatgcgcgacagacgacccttcgagagagacaggattttctccgcgtccctagagacagtttttgtgtgtcaaacatctcaacctttccttggacgttttccgttgagtgagaagttccaggtgtgtggggcacctgcagcaaaaggagctgttacgggtgtcttcatgtatcccgaagcgcagacggtgtgctcgttaacgttgcccgtgtgtctctacactttcaaagctgcgaccgaggttgtcggactgtgtaccggaaacgtttgtgaggaaactccacacagttgagttgaatgcacccttgctgaaaaattgaactcggaagaggacgctgcactgctgtggacctcaattgaagtgcggacggccaatctccggacctctaggtcttcgagacagcgccgccgggaccctttttctgcggattgctgctcactcacttacacaa

SEQ ID NO: 3674 - DNA, 1587 bp, Toxoplasma gondii
gttagccacgtagcaaaaaggtatcacatttttagactgggtggtgctgaaatcaaaccaaatattccactaaaaaatcgaagttacacggtagatttgtcttagtggcaagacagagcgctgggcgtttttcgttctggcaggatccggtcgactaggaaaggcgctttacacattctctcttggggttgtgcatcgagaaacatggagagacagtgaagagacaggacagtttgcactgaacgtccaacggcgttttcactcgcatccagaccttgactgcttggtcttttcaccgcacgaagagtgattttcaagggtgcagaacaacttttctggcgcacatcgctggcggataaaccgtgcactccttaaccagctgttcctctggcgagcggacagtgatttcaacgaggtgtacctgcatttgtcgcggatttcttttccaatctgtttgcgaatggcgtcgttttccttcttctcgtagtgcgttgcctgcttggcctcgaaatactcgatgcggcggcgcgtactctggtgaatgtcgtcaggatgcagcacagtgcctgggatccacgaaccttctttggggcttggagaaggcggggctgacgaggagtccgcgcttgacttcacagcatccgagtgagggaagcgccccggctcttcacgagacgcaccattgaaggctggcatctcgagaccaggatacgaactctttttgacggagacgcgttaccgtggaaaaatgtttggatgagcgacaaaagagatgctttagagtttaccatgcgagacgggacagacgggagtaacttcgactactggagaaaaccatagcccctcatcagccgcaagggcaacttctgacacaacgcatgtttatacacaagcgtatacaaataggccgactcgaaagtccacaggtttacatacgcctgtagaaaagcatacatacgaacaaacagcgaccgcagatcgacggaaaggaactactggcaccgtagtggaagaaccgccagaattttcttttgttgcactgcgaagttctctgttgatcgttggccttcggccatggttaacaaaagtggccacagctgcgaaaaagcaactcctctagctgctttgtcgaatagatgcactgcaagcctttttgaaaactctcaccaagagatttgcatgcacgcccgccgacagcgcgaaaaacggaaatcggacgaggaatcgccaggcatcaatttctttgaaaacgcacgtcgggtttcgtctctgcagatcaccacatatcatcgcgcgctaaaaacatggggttttgcagtgttttgtgttgcggatggataaaacgtcaaattgcctcttctcgtctctgccgctgcgttgtttctgctttggcctcctagctgttgttttctcgtctgtctgcaactctggtcacattcgccttttcgaactctagaaaatcgtctccatatttgattgagtctcgcgctttccgcccgtctcgcaacccttaacatttcgtttcttcgggtgaatattcgggactggccagcaggaaaaagtgactcaagcaagctggttcgcgca

SEQ ID NO: 3675 - DNA, 2361 bp, Toxoplasma gondii
aaaagcttccagcaaaggagagaagtgatcggttgtcggagcggttccgctctgtgcgcagtgccagctccgggcgtcacacaaagttgccttttatcctcatatgttcctgacagatgctaaacgtttatcatatttacttggatttaagatccccgcgaacggcaccacacgagacaaacagagattcatgcggtgtcatcgggttgacgtcgtgtgtttacggaaggcacgtttcttttcggtacactgaatgctgggaaatcatcgaaatctccacgtcaaggagcccatgaagaagcctgtcagggtgcaagtttccaaggttcgggtatcaaagcttttttccgcgactgcctttgttttcctgtggggcgacaagtaatttaagcaggaacgagccgcctgaaaaccaggatttccatgactcgttgaccatacgaatgatgccgtgtatgtatagtgtcgcccacgccacggcgctgcccttctcactctagagcgaaaggtactttttcgaaaaagcgcttcccgtcaagaacagtgtctcatcctgaacgcttttttcgaggaagcgacctcgttaagaaggccctggcgccactccccggggtgcctgaagtacgcgtagcgtttatcgtctctggtggagcaaacaacggtgatggattccctcccacagttcgttccggagcgtctagccgcagattgtcactgttgtcgcacactcggcctgcacaaaatgtctgcatgattgtacctaccctgattcctggttttgtatggaagcagctttaacgcccgaccttgttggatggtaccccaatgactcccgccctagaactgattctgctgaatccagtctcaatcaactacagttctgccacccaaacctttgcagaatttattctcatgacccgtgctgcagcgccatggtcttctactttgaccatgctgcattaaactcacctcacactcgactacacaggtaacaactcctcgagaacggcgttagtccgtttatccagcgaaacaaacctcattgttttgcatgatcaccagttcaagtgccacagcgtttgcggtacttgcatgaagtcacgaagttgagttgtcaagcgatgcagtgacctaagtgaaatgcagacagcttcctctctagatttgaggattttcctgtagtctgcggttgggtcagtagttgggtgcagtgtgcatgatctctttgactcctgcgaatagtctagacagaattcactgcaatttccactcggatataactcacaatcgcttctaagaatcatccctatcatggtagtacgctcttctcaatgggaactaatcacttttccccccagttgtcttgccgccgctacctggcgaggccttgctttgcttctccacacaaagtaatgttgacgactgggaaatatagcactaagccagactgtccacatgcggcagttaagcttcaagaaatccctcttttcccctctcaaaactttgtaatacacggactatcgcgaggcagaaaatactgcgacagggttcttggccttttgccgcgtcaccccacgtcacgatttagccgactttcttccgcaaccgcctgagtctttccacgatattttgagttactggtacggaaatcgaattatactatgagagttgagcgaacaactgcgacagaagtttcgctagtttttatcctaaaaaggaaccgtgtcttgcctgccgctgctgtctcgcgcatgcatcggctcgggaaagttgcatgggggcgccagtcaagacgaaatgtggagttcttcgctacaaaaagagcaagatgcacatattttttgatagcaagagacaggtaaatgacaaggacgactattgccttgagagagaggcaagaccgggggacgaaacaagcaactgtcgtcgtgaaggcgaaaacaaagccccacgatgagtcgctgggctgctgcagccgccgctgttctgcattcgacttggtaaacatggagattcctaccccgtctgttgacgcttttctgtcgtgatgatatcacctgtatttttaaatgggttgtttcgaggatttttttcctagcgtccgttttgcccgttttctcccgttacgaaagatcgcagctctcaattgcaggtggctgatgaccatgtaacactcgaacggctgcgtttgccgtctacccccagaattttcggaagggttcccgtttccacttgtttttttaagccttctttatttcacccagttctccttgtcgcatctgtcacggtcttcttgcggacttccgcgacaacgcgcgaagcagccaccacctcgatgtcgagtatcttttgattgtacca

SEQ ID NO: 3676 - DNA, 4320 bp, Toxoplasma gondii
tcgagacgcatgcattcgaaacgctttgaaactcggaaaaccttactcgcttctggtcaacgaagaactgcggacccgcagggggccgaggaacaacgacatggtgtgttggcggcgggggaggaggagcagatggggacgcagctgccatcttttggaaatcgaaggagtcgacagagagcagagagctgcagagaggagacttctcttggcgacgtgagcgccttgttgacaccgctgcgtccggtgtatctcgcgtcttagaaatcaagaaaaacgcagaaactgcttctacaatatccagagaagcacacggagagcaagttcgaaagtggacagaaggcactgcgagagaggacgagagagaggcaaggaagggagacaggcagcaggaaacatggagagagaaaaagtggaaagccactgcggtgagagagacaacgggaactccagaagtttttttttcgcgaggtgcagacagagaggagaagaagacaaccgagagaagcacagaaagaagaggaaggagaggagggaggcctctttcagaggtcacgagcggccttcagttctgacttgaaaatacgacggcggcggaaacagtgaacgcaatcgagagagtcgaacattttccctgtgaacctgccttcctcaaatgaaaagacaaacgagcgccgtttctgcgtctttcgctcctcacaacgccacggcatctcccggaacgcggagaaaaaacgttccgggaagtgcgacagacctgcgtggactcggtggtggaaacacagcgagaaaaaactggcagcttcggtcaacgaggcgcgtagtcagcacaaaagcacggctgcatgcgctaaatacgactagacaagacagcgcggacggagttcgcacgttgctcctctgtcgaagaggagttgcgtcgcggaaatgtggagagaaaggagatcggcgaaaaagtgaagagggcgacaggaaagagcgccgggcaccggacagaaggaactcgagagcctgcgaaaaaagagctcagcagcgtcggcgtgaaggtcgaggcagcggcagagaaaacctaggaacgaccggagtaaaccggtgccttcataatgaggaaccgacccggaagtgaaggctttcgtggagacatacagccggagtctctgagagtgagaggtgctgcaaaaactcggagaaaatcgagaccatttagcaccgtccttggttctgtccatgcatgcagtgtggtggtcgaccccgagcagcagaccgcgagacacacacagacacctaaggcttgcagggcgagaaaagatactgaatgaggtaaaaacctttcgcagtcaggtataaacgtagcccagttctagaaatccaggaaaatcttcttttctggagtcttcaccgcagacacacagcgcccgccagctgtccgacagacacctcgtttccctggaaacttgcgcaagcgtcgcaggcctgaagagcggatggcgggcagcttttcgtcggcagaaaaggcaaaggaggcacgtttctccgagttcttcactcgtttctgtctacctaaacacggtgggattgtgatccacctatgcaacccaagacaaggcggcgcatgcgcacaggtcgaaaccaggtgacccgtttcacagcgtaggtacttcgtggcagacaagtcgtcgagatagaccaaaacgcattgtccaccgagtgcacactcctcccttcttgccgctacgatgtccgcaacgtgctagccgccatgttgtccatctactctatatcgggacgccaaaccacccctgcggcagatcgaagtgtgttggacgataatatagaggacctcaagtggcaaacgcggtagcacctggatcccgtaaacaacaagcttcaagaactgaccaggagtgtgcgagagtcgatctcacatacgactaagcggttccatcttcactggatgttctgcagcgaaacagcgtcttgacggctaccgtggagctgcagaagttcgacttcaagtctcgtgtcgaagtgtgcgcgaaagtagcagtgcgacgaagtcgaaacaaagtcgtggctagcaaacaactgttgaacaaacctttcaacgctgccgacgaatgtcccggtaaactacagttgtgctgaaaccggaatgtcaagtagggaaacatcgcacaaggattctctccaattgaccatgttgaaatccgacactttcagctatcacaagcggttctttatggcgtcaatgtatatagcgaaaagtgtagggagaatccgggaacgcgtcctgcagaggcttttgctgaaaagggaggccgtcgacagctctcgaggaacagaactcgctgaggcccgtagtgtgctcgcctccctgcttgaaggaagaggctttcgaaagcaacaattggcggtaaatcctcactgacgaccattgctacgtttgtcgtcgaagggaatgagcttgctaggtggcctgaggcgtcggagaaaagttccaaaacgcctcacccgtgtttgcggtgtaagttgacacaggtctgctcgtttgttcgtggctgtgacccactttctgtctctggaagttgagtcagttcgtttttcttgaccgaacgctttgacggtctggtgaaacgccggcccttaccattagagggttctgactcctggtgcagatgacggcgtcggcacgagacttccgacagcgagatggctcgacagtctagctgacaggaatgaaaacaagaaaggtctggctttcagccgtatctggagtagagttcattacgcttgagccaaagaaagtccgccacaagctccagcacgatccgcgctttctgactgctcttcgtggtctgaggcaaaccgtggttttctcggcgaatcttacctcgcaatttcaaagtcaaatactgacatgttgaagcaaatcagggggtacaggtcacgactgagttgcttctgttctctccgttgcaatcggagactagttcacaaatcccacgcaacacaagaggaattcggatcgtttgccgtagctgctgctagtacgcccttgaagtggaagcgcacacatcaggaaggctcctgcgtagtgttccttccgacagcggctgtcacggaaatgagaaagtcttcctgtcacatggagaagaacttctgagcggttctgttcctccccggtttacatgcgtctgtacatgcatcacgttgccggcggagtgaacgcaaaactgcactcttctgctaatttctgcacggtcgggttacgccagtttgccaatacacagctgcgacgaactatctcagctcggtctgcaagcgatctgctctacagtgcggtttcgaaagaatgggaaggtcgcagacaacatgtgcgtcgactgagaaacattaccgattgtcgaacggctgaaagaaggccgttgtcttgcacgacgcaaacgtcgtcgagtcgagctgtcattttcacatttagccaaagcaagcgttttcctgagtcgaattacgggtcgcctgtctttttcgcaagaattccttgtcaaacttggatgcttgttgtccgtttctccacaagggaaacgctgctttctgcgctgaagttcttctgggccccttgcgtgagcagcgcgaaaacgggtgtccgagtaacaagccgaccaccttggcggtcttgagtcacgggatgctccacgcggcaagacaagactccgttgttttgtctcagaacaaatcttttccattggagggtgtcgccgatttgaaaccctctgtctagcgttaattttgtgcgttcgaaagcacacacttttacgtggaacagcgggtgaagtctcccggtcagaagcttcccgcgactttttttgagagagtcttctggccgatctgagcacaggtagatgattgtgcggtagatctcaccttgaaactgtctcgaactttctttttttccgacgaaaagaagcgtttctctttgttcttttacgcaccgaacacagttcctctccacgttgcttccccatatccacaagacacgccgtgggtattcccgtggcgccaccaagccccgcgcgtttgtgtgagagagtcgctgctgcgaagaactccgttctcgcacctgcctttttgcagtgttctgcgggaaactgagaattttcctgaagccaccaagggaacccttcccttgctagcgtcgtttctgcgcagatatctcggctacacgtctaccacccaccgggcgtcttgcaaggtcaggaccgtacactgcctgcagttctcagagcctcgcagaactagctgtttccagaatcgtcctcacca

SEQ ID NO: 3677 - DNA, 3972 bp, Toxoplasma gondii
gaatgtgcgtgccagtgggatcaagggatccgtcgcatcgctgtctccacgtaggaggctgtagagatatcgccaagtgtgttcgtcttcgagcctcgctttggaatgtcttgcctctgtcagtgtaggcagacgcgtccggcgtcatctgcggttccgaagagcacttccggtggtgaaaataggaaaacaggagagcgtcttgtggagattgacgagacgataccggaagaggcctaggtcgccaggagggccacagggagagtaacggacttcgaagggagagcgtgcatcgttttctgtacggcaacagcgatgcattcgagtgattgtgttcgtttctatgcagacgattccggaacaactgtgtgatatctcacgcggtgtgcacctaaagttcgcgcaggctgctccttcggcctctacgagcggcagtgctagtcttgacggcggcctggcgcttcttcagttgcttctcttttggatttttccgtcgatgtctttgcggcctgccattgctgccctctctgtgcaccggggacggagcaacacggccgtttgcttttgccaccacaagcccgttgaggtctgctgcatctgctcctgctgtctcgcaagtaggctatcgaaaatcactggcgctgccacgccggtgtctagggtggcgacaaacaaggtctctaaaaccccagatattccgcgcgcgacgtttgctccagcctgtctgcgacttgctctgtcctccactcgtcggcggtgaggcgcctcaggaggcactctgagcaaaatattctgattctggagaacctggcaatgcggagagaagcggccatattggctccacgcgcggttgtggacaacaggcacgtccacccgggtttgggtcactccgtaaactggcgtgatttcgtcagtcgaaagtggaggcaaatgagtgaatttgtgttcatgctcgtacacatgtgtgtatcttctcccgcagtatactgctccgaaaaggacgcacagacgggcaaagagagaatctcctgcgacgtgtgcaagtgagttcggggtacagcaggtctcaatgaatcctagagctgttcggtctatggtgaaggctccccgcagactgttcgatatgtagcaaatgtcagtgcaggagtacgtgcttaggccactactagtattcgtgtctcaattcgtgctcgcgggggagcagtccttttgtggcgtctccgccgcccactccccccacttgcaattgtggaaggaaccaaacaatcaagggacttccagctattcatcttatctgtgtctctctgcgtgttactcgtgctgtaggtcacgcttttctcgaggacttttaaagaataaaatggcaggtggagtggatcttccaaactattaacagcgagaggcggataacgttcccggttactttgcgtgagaggacagtttcgacacatgagcggccgcctcgcacctgagcgtagaacgctcgctgtcgcgtctgtctccgcgagactggcatgggtgtaacactgttgctacacgaggccatgcagtcatttagctcgagatagcttgactgcggtccatgcccgaacggctatccggatgccgctgtgtttctgtgtggtggccagtcaattgccacacgccagcacctggatgtggggccgtgtcagggtggttgtctcatcttgagctgcgacaattccgtgtgttactctcggattcggaaatatcgaatccttgctgcacacggcatccattactagtagatggttatattggtttctttccacggaaaacacgactgtcgtccaatgaatgaagctgaacttacgggagaaaaagcggctgacaattgaggtgcactcatgaacgagttagacgacagatctccttgcagggctgagttagttacggctcacacactaaactcgttggccatttgtcgaagcggactttcactggtacgatttatcacgccctttttgaccctctgcctgtctctctgtaagcttcgatgttagatatccggcttctgacagcatcttaccgttgaatacgcactcaaaaccattactagagtttccttaggaggtaggtcgctctcttcacgtattggtagagccgtacgttcgcggtcgaagttcaggtcggattcgccgttcacgcttgacccgccgcgacttgctggcgagaatgcgtgaattcctggtttatgtaactgcaggaactctgcgcgatacggatgagcgagatcttcggaaacggaagtgacagaagaacctgtagtggagacacctattccgtattgtgtatcactttggcgtgtcagcgtggggggcggctgacgggctacagccgatgtttcccaacatgtactttcttttggcgccagtttcatgattcaaatgctttcagtattcatttagtcgcgcaggtagccctctgctgccctagtgcttcgaagtaggaagctagttatcggcggcccacagaagtctttccacagggacaagctcagcgagttgagccaagtccaggttttctgccagcttcgtagcgtcaggtgtgcagttagactatatacccgtccacaaaacggaggaagaaatgcaatggaagataatgggccttcagctatctacgtagtcgctgcgactgaccgaggtcagtcgccagcgttggcggtcgtgtcgcattgttacaacacagtgactgcttcatccgcgagggggggagtccaccttcaacacatgggagcaagttcttgatgaggcgtgtgatccccgcaagcacatctcttccaagtggcatagaaagaggggtactgatcttcacaattaagagagcttgcatgggaatgagtattctgtagagcccggagacttgttcccctgctccacggacgcaccagttgcccagtgatgcgcgggaatcacctgatgatggtaggcactgactggacgcaatgaacttcaaaaacgatgccgccttgaaggagaaactcaaaatgcgtgaagtttttctaagctcatgacgtgggaaaattgcagttgccgtgtgaactgaaacacccaagcgcagtgtcagcagcgaccggttcgaagtgacacataaagtagagcgcaggtgtgctttcggcccgttccgtcacaaacgcgtttccggcgccttggtccggatatcattacggtaatcgagtgccctaccagacctggcttattttgctgcccacgtcagaaggggcttgcccgcccgaagagattcaacacgataaaaagtggtcaaaatacgccatcatgagagtcatgtggacgccgcctgatgctcgagcacaagtgaggaacagaggcgagaagctcctgaccgagggtagcaggactcgagacgcgtagactgacgacgctcaccgttgtagacacatgttacgctggttttggtgtggcaggtgacatcgcgaacttgaatacacctcaggtagtttgtcaaggagcaagaagaagaagaccgttccacatgaatcgctttcctgaacgagaaatatgtgccgcttcactcggagcatgccttcgtgctgcgtcaaaaacggtgctccactcggtggtccatcggtcaacttcggtgatgcattggcttccattactcgacaagtgagccaaaggattttcgttattggtgttcgtcacaatcttgatcattctgcatccaagtgggagaatctcttaacagaccgtgcgatggcaaacgatttacggtcggccttccgatgtttcggcagcatcaggaagcgcgtctggccaacttatggggccagatcaacttttttactagtttcttgcggtttgtttaactagggatgcctattgttttttcggctcccgtggcccgcgtagagtgtttggttgggttcaagcacattctacgtatggtggttacgaacccgctggggcgtagcatggcatatccagacaa

SEQ ID NO: 3678 - DNA, 1827 bp, Toxoplasma gondii
gggaaggaactgagagaggcttcgaactccatcttcagacgaagaaggcgagaaacgtctctcggaaaacgagcacagacaagcaagcagctgccgttcagcttggagtatcgcttcgtctcttgttccctcgccttccagctctctgcgccgctgcccagttcacagacgcgccatgtctcccctccaccacaacttgctctttcacagagagaaacgaactcgaaaaagcgtcacatgagatacatacagacacagctacacatacgtatatatatatatatatatatatatatatataaagagagagggaggtaactgtcttggtgcagagatacaaagatcagtatagatcggtttctagagctaaagagcttggcagatatgtgcgtctgtttgcgagggcgagtgagcacccttctcgggtattcccttgaagacaggtgccgctcttccgacgttttggcggagaagttgccatggaaagctggagaggagacggcgaggagagtgaggacgaagccagcgctgctggtggaggctgtcaagcagaaaaccggcaggcgagcaggctcctggtctcccgcggcttcacctgacgcgcgaggtccaggcgtggacagcgggggagagaaggcggcgagctgcgactccgagccggcgaagaaaagaaggagccgacttaagtggaggatcctcccgagacgaagaaccctgcaagagagagaggaaggaagaaaagacgaagatcgcagagagcgaaagcgacaagggagaagaggagacaaggaaaaaccttgtctctttcctctgtgatacgagcatcaactcagccgctgaattcgcgaccgcgtgcatgcacgaaaaaaatgtgctcatgcaacagagagaggcatcgtgaaaagaagaagaaaccttcgtcgttctcggcctgtgattgggtttgattctcttcggcttttagttgctgcgtcttgggcgtttaacggactaaaaggcggaggtctgtcgacctgcatgcccgaggaaagctctcggcctctgcggcctctctccagttccgcaagtctaagctcgaaggactttttgtgacaaatgcgtcgctccctgttgatgctacggtagcacactgaatcctgaaattatcggaattgtgtataagcagtccgcgaatgctgcaaaaggcttatggaagtccccagcgacgccctttcccaaattcgtttctctcgattcgtgtctccttccccatcgtccttttctctctttctttctttttttcttcctttctttctttttgtctccatcgtcgtcgcttctccttcgcgctgtctctgtctctttgcagtttctgttctcttctacgtcgcttcgccttttccttcgtctcgctctctcggctgctgcgcgtcgttggctgtgtacagctcgtctactgggagtcggtcggaagcaggcagatgccgattcagaggtgcagactcgaaatgcgttgcccttgtcggcgacgtcccttgcctcgtctcgcgcgcgttgccgcgagcagcgagaacagaccggctgctgcatgcggagaaaagcgaagaaatctatactcgccgaaaaggggaaagccgcgcctgtcagtggacttcgtccattggtaagcaagcgcgcgtttttcggtctccaccacgacaacttctctgcgcgctttgcaagggagtttttcatcctcatcttccttctttttaaacgctggagacaggtggatcgtccttcctcccgcgtcttccttctcggaggctctctccggcctattttcttctgtctcctttctcaccacca

SEQ ID NO: 3679 - DNA, 4486 bp, Toxoplasma gondii
cttttgttctttgatatggtcgaaagggcaaccctctttttcacgctaccacaaccgtgcagttgaagcagctcccgagttacagccttggtgacgtgtgcccgttgttggttgacaccagtggaaaggccgtcagcaacacgaaatcaatcttctaacaggagctggtgctgaagctgccgccatcaggttcacaaccagcctacaaccgtcagcattatcgagagcaaatatattcagagcgtcggttctgcgccaaacgccccccccctccctgactcagtgcgtgctcgatactgcaagcatggttctagcttgcttgaaactacgaaaaacgaacctctgtggagacatgcgataattgcagaagtcaacctacatagacacgacgtcgggatatcactggaaagcgctgtatgagcacaatagcttcgcttcgcctgcaacctcgcgcagtacaggttacataagaaacgtcgtgtgccttcagtttccagttaccgatacctctcttattcgccagttgccctcgatcagccttcagagcaatcttctacagaaaaaggcgacactctcaattcccttgctgtgctaccccacacagaacgttgtcgcacgacgtcaccacgctaaagttctgcaacaatgatccattgatggcacgaaaaaaaatccagcacattgtctgtatttactggcttccatgcttctgttcgcagaaatccgaccacactgtacaaaagcatcaacgatacacggagcacggaagaacactcctacggcgttaaacgattcgcaagagttcgcacccacgccaacaaattcacccaagctggaacaaacatgggtgacaaattgtttgtgcccggcacaacgacactgtcaatgacttctcgtgacacccgaaatctccttcggaaaggcgttataggagttacaaaaatacaatgccagcatatcaaacagcccctctcccggaatttctgtacgaccccttcgaacccctgcctgtcatgcgggaaccccgcgaattttatctgattacaaaacaggtttcaccaaaatacagcaaaggagtcgcacaacaaaccatggaacactgaaaccggcgagcattgcgagaggacaatcgccagcgccttgcggacgactttttgtgccgaaactgaagcagggagacccattatcccattagagacgacagtagaacgcagtcacaacggcgatttggggaacggcctactatgcgaaacatgatacttgtattctaatcaggtataaaaacgtggaacaggcgcgtgaagttttattctagagtttcgaaggtatagctaagccctcagcgtaacaacgtttgctgacgctcacctgtgtaaagctgcgtcgcatctgcgtgcccatggggtaacacgcaactgctgctaccaggaaagtgtcgctactgtgaaatcgctgcttgtttacctgctttccccctgctgacatttgtttcagacaggagagagagagaggtgtccactgggatggacgcgcagcgttcaagtcgattccagcaggtcaaagcatcgatcattcaactcgtctattggtgcctactgaatgctaccatggtgcttccgatattttgtgtagttgtatgtatggtaatcgccaataatgtcgccggaatggacgcaggcgacaagatccggccttctggagaaggggccgggaataaagtcactcactcgcaaagcgaaccccattttggcgggccgcatgccattgaggcaccactacaggccgcgagaagagatgacagaaagacatcgaatgaggagatacacaaacaatcagcgagtgatgacacaacccatttggaacttgtccgccttcgaacagaaaagaagaagcaaccggggggcgtcacgccatggctaagacgacgctggatttatgccgccggtgttgctacggctgtgctactgggagcttacggattccgacaatttcgtgagcggcggcagcgacgcgaccaggaggccagaactcttgcaatggctgcaagatacttgcagggccgcgcggaagcatcgaggaggattgagagagaacttcagaagaaggaacgagatgctagttggtttcttccgaatgctaggaacgccgagatcgtctccaagggcacgccacgacacgagaaagagaaggcagacaagcaagcattagaacggattgtcgaaatgttagagacccagcgaatgagagttgctaaaagcgaagaggaattacgtgctgcacgcagtctcctcatcagggaaaatcctcaactagccacaatttctttgaccgaacaggaagaagcagacgccgccgaacgtggacgagtgactgaagcaagaggtttcttgaattattaccttccagagaccgagaagttggaagacgatttagtacctgaaatgcgtgagttcgcgggtgcagcgttgcaagcaccgaggggcacgtctgaacgacgcgagtttttaaagaaggcattgagtactgctaaggagaggacatctagaagggtgtggatttacgtttcgggagtagccaatgacctaccgacaactgtgggtgtacaggcctctcgtttagaagagcgccttgggacgagtcaggaacttcaaccggagtacgtcgctgtggccgaacggaaattagaccagctgagcgagccggaaatttcacactcagatactcaataagacagacgttgaagcctgttgtttgcggtcgttttcacatgtaccataaagagtcaacataaggcatgtgctatcccttgtcgtttttggtgccaatctttgaacgttggtgtatttcctcgaaatatctctttgagtcttcaaaggaagcagtcgctggtgaaagggcgtgggtaggggaattacaaaaaaccttcctcgtctcgtgggagaggtgtaatgcatattttccaaggcaaacagtgattcgcagtttcaaggattcacttaagagtatgcgaatgctactgctggcattcattcgtccctggaaggaaatctatggggtcgaccggatgtgacttgcctcttcagagcctacgacaacgtacgtcaacgtcttcagatgaaaaggctcgcttccagcatgacaactcttgtatattggaaattattctttgtagacactcgtaggtttcatgctgcacatcttgtccacgcgtagtaccgccatatgctactcagatgacgcagctctcctccttcagcctgtatctgttttgtgaataaggaacgctacttgcctatgataaatgtatcttgcaacacgctctgtgtctcgcataccaatttgggtttgtagaggtaactcattcagcagacgaaactctcttgatttatcctcgactgctaggtattcacactgaacgctcattcatctcgccgttcaatgccattgaaccgttgccttcgataagcacatcacaccaacaacagcatgtactggccgtgcaactcacgcactgactgacgggttcgaaggtcaaggtatgagtgaccctacgggcacaggaacgcagtggtcaatacgagtgttcatagctctaatgctttcccagtccgtctttgtctgttacttcgtgtctctatacacagcaaaggcctcgtcagtggacagtggcaggggtaccgccaccctttgtacgctgatggcaaacgttaaagtggcttcaccacaaaattggcaccagactggatttgtgtttcatagaaacgggccctcttcgtctcaacgctgattcagacgtttggcaacaactcatccgttaacgcggcttgcagttcgtcagctcgtttcgctcgaggcgtcctgacaaatcgcgtggttctctctggccttcccgacgacttcctccccatgaaagcaaaattcgtcaagttaaaaagagatttctgtacatactgaatgaagtagactttcttgtgagaacagggaacaagactgtgcgagataagaaatttcatcaaggcttcttattcagcgtgaacagaatcccggatcatgcatatggaaatgtcttctaacgcacagtccactgcatgtcgtactcgtcgaatcctagagttgtggcggtgtctcgcggccagctgcgggtcgcagctgctgctagccagcaacaacagaattggtgttttgttgatattgcgacaaaaggagcacagtattgggtggcttgagcaggggttttttattatggacttcccgcgtccttttgttggtttaaatctgaagatggacattgttttggagtagtcaatgcttgaggcggagtattgcctacggcggctgagttcgtgtccggagaagattaccatgtggcaggcggtcgcctcactcaggtgtaacccgcttttgagcttcgattacagatcgtcgatccacatattcgtttagcggttatgagcaccatctccctctcccaaggcaattgttaata

SEQ ID NO: 3680 - DNA, 1747 bp, Toxoplasma gondii
gtcgtcgccggacgtcaagctcctcattccatttgacgaagagcacgcagcgccggcctcgcgttgtttcggcgcggctacacacgaaacgaagcggccgcgagggcctcgagagtcgctcggctccacggaggactctcgggaagccgctctccagagatacggcggcgtcacacgcggtgcatgcatcgagggggcgtctgccgcacgggcagacgcagaggagacgaatcgagcgacgccgttcagaagcgaaggcggagcaggcacgcaggcaacggcgtcagagggagggagaagacagcgggcgtcgaaaagaagccgcagagacagcacaggacgccaggacgcagagactcggttcgcgccacgcagtcaaagatgcgacgggaggcgaagacgagcagaacgcgaccccacaacaagggaagacgcgacagaagaaacgtcactccaagttgacgcaagagagagcgtccccggcctcagcgtccccggcctcagcgaaggtggaaagaagatctgagtcgcgcagatgcttgccgcgaccaaccaacttgacacaggtacgctgagatgtcgcctaggaccgtagcgcagagacttgagttgacttgacagatgaggatgaaggacgacctgagagagagagagactggagctgtctcatccgcggctttgctgtctcgcacagaagcggtgagagcactgccttccccgtttctccactagaaaaacgcaaggcgtaggcgcgaccgcgactgcagggtatcgtcaggtcgagctggcatgcagtcgcaatttctacgggaagaggacgaattcgaaacatatacagggacgctggaaagagaaccacgcgcaaggagaacgccgcccaaggcctcaagagaacgggggcactgtccgtcgacaccgtcgccgtacgcaagtctttcctgcgcgggaaggagagagaagaaaaggggaggctgtcggcacagcagcggacccccacgtggagcgacaccgcaacgttctcggatgtttcagtcgcacagctgtactcacacacttgagcagtccactggggcggtggtgaaaggaaaggaagaacttcgtctttcgagtcctcttcagtttcctccgaagaagcgactcggctgagatccacaggtcgccgtggacgtcgactccgagaggatagtctgcaagggcagagggaacttctcggtcgattcgacctgcctcagatggaagaagaagactgcgagttcggtgaaaagagactctctcgagcgcggcgttgcgtgcatgagagcgaaggaaaagaaggtcatgcgaggggcggcctttggcggctttgcggcgggaaggaactgtctcgtctctggccaccaagacgaaggcgctcaggaggaccgcgagaggtccaggaagcagacgctgtcgcgaagaaatacgaaacggaaaactttaggtggagagacgcagcgactccggaagagagaattcgacacgggagaccgcgggtgaacgatatacccttcggcggagaagcgtcagaggaaggaaccgctacggagcatgaggcgaagaagactcgaggagcgggcagaagcgtcgggtccgcagacggtttcaaaaaggacgtctggcaaccgtggcaacttgtacgtctctcgattcttccgctgttctcgctgggtgtctaagaagcgttttctgggcgccgcccgtgctcgtccgcggcgccgaactgctgaga

SEQ ID NO: 3681 - DNA, 1657 bp, Toxoplasma gondii
aaaaaacatgtttccgtgggctgccttccgttctgtcggtcgcactgaggcttacctatgccaagttcttcctctgtgtagatccgtaagccatcggccgttcggttgatcgcgcgctggttgaggcccatgtcctcatcaaaggtcaatggtcgtcgcttcttcttctgcccagccttgctgtgcgctgtctcttttctcttttcccttttctgtccatcttgtttcttccccgcttgcatcacatctgcaaagaggtcgtcgatttcttttctagagtccttagatttcttcccttcttcagaaacgtctgccgtcttgtggtctgcaggcccttcagcagcctgtgtgtgaggagcggccaacttgtttttccgagatttctttgtcacggaggaagcagccagagaacgtggctgatccgaaggggagctggaagaggtaggagactgagggggctgtctcgcgtttgtgactccagggagacctccccgggtgtcggaccccaatttccgcttcttctttgaggcagaaggaagaaaaacagatgcgctacgagatacagtagacacagcagacgacgaatcctgtgcagaagctgtcccctgctcccgatacttccttttgactttctgtacgagactggttttctctgtgcgttccgctctaggacagagaattgcagctttcttatgtttctccttctgcgtcatcttcgtctattctttcaaacggttccccacttttctgtcgacgcccaaaccttctctggtgtgaagcaacgtaaaggacggcaaaacagtcagaaacgcgcttctgggggaaagaaatgtaacgcgtttttcggagggaacaggacggcgagtcaggtgaggcgaaacgcgactgaccaaccaaagaaggagacagagaggaacgagagacgcatgggtaaacccccaactggagacaagtcgtcgatcagaagaagctcctacgcgcgaacaggaagaaaaaacggcgatagaaacaggagaaaaggcgagcaggtggcgaagcgagaatcatgggcacttcggagggaagggagagagaggaaaggaagaggagaaagacgagaaagacaacagttgagcgtacgggtcgcgggctcaagagcgagatgctcggctggctggggacggggcctgcagcggttcgctggagcaaaggaatgacacggatttttgcggatcggcagagaatatgcggaaacataatactgcctcgctttttcagtgacggggacttgctttcctttctcttccgtcaatgaagctacaaacaacgagcccgcttcttccgccttttcgcgtacttctggagacccgagcgcacgcatgcgatggggatcgacatctcgtcgctctcttcttcccccccacctcaagtcctttctttctttgtttctcttttgcctcgagtttgcaagacaaagatagccaagacgaacgaggacgcatcagtcagctctgctcttccctccggagtctgtattcagtccttttcgtctgccacctcttaggccgtccaactctcacagtggcgcgacagcggcagtctccagttccgtctgaacagagaaaagagacctgaaactcacttttcaattgtttttcctcgccttgtcctcccctga

SEQ ID NO: 3682 - DNA, 1400 bp, Toxoplasma gondii
gtcttaacatcacatctagatctgcagatgtccggctgtggagctgaatcaactgcgttgtccggcgtagaaaactgactggtcagacagcgactgagtcacagcagcatcaccagttgagatgtggagtgtattcgacgctccgatgccacaggtgcagcttctcaacgacacagcggggggaaaggtggaacggaaagaagtccagcttcgcattttcggccgcctcttctgcgtcgtcgtgcctccaccccaggcaagcgaggagaaagaacagatgtggagacgaaaagttcagttgctccccagaaaaaaaaaagcgaattcaaaggaggagctccgctcgcagatcggtccacgacgcgaccgcccgcctcctcgaatcgcgacgaccgaaagacgagtgtgtgcgtctcctcatttccgctccagtcgaaccagccgcaactgcctagaccgagtctctcgtcttctagggacaaccgagaggctcgctgaaaaactacaggaaagaccaagtacgaaaaaagcgacaaggtacgcataagcacaagaggatctaagcgaatgcaatggcgtgtgccatgacagattgaaatgctcctatgcacatttaaatacctggctcagttctcctgcatattttcatggaagggatgctcaagaggaatgtggtggaagaagacagcactgggagatcaggcaatctgcagctgcagcggctctcggagggggcgaacgcatgcagcaaaggaaatggagacgtccaaggaaaccgtgggcgtcttcgattcagtggaacaggtgggaacgagatcgagacagaaagatccgagtggagagaagaaatcgtcgcggtacgggcgcgtttctgcgacgaagtcgatctaagaaagcgagaaacatagctgcacaccgcagaaagaaacgacttggaagaaaggaataaaacgggcaaacgttatggatgaaaaatggaagacacagccgagaggagcgagagttgacaggaaaaatcttgaagacaagatgctttggcagagcagtcgcatgcatgcaagctgacgagactccagtggtgagagggagatacttcttggggtattgtctcttctcagaagaaagaggatgtagaaacaaaggcggggaaagattggttcttgaggcagaggaaacctatcaacgagatgatggggaaaacgcaggtgaatcaaagcatgcatgtggcgacgacggccaggcacagagaccacgctgaaaatccaaggtgacatcgaaagacccacgctggagaaaaagacgcaagatttgcctatctggcaaaaaagaggacgaaaaagccggcgtatacgcttcaaagagcagtggaaatgtttctgtatcgaaggagatctccgata

SEQ ID NO: 3683 - DNA, 1509 bp, Toxoplasma gondii
ttcgctgttccctacaggacgtctcataaaccaggaacttcgctacgttgtctgcatccgtttcgcttcacgagtcgtctgatagggactgtggcgcgacgagctggacgcctggcttagttttcgaaggtctttgctcagcgcatcctaattttagtttgttcgagcatcgatacggcgacgatccctgtcgacctagaacgcattccacactgtgcatagtgtaaccacgagggccggggcgatctaagttccttctcggcacagctgtgaatcctgttaggtgtaaggcaagaaggcgaacgctgtgatagccgagaatccagcgaagcgaacacttgagtatgaggtgacgagcgcgttggtgctgtgtgtgtggagatagacagtcgacgaagcctagggagcccaactgacaagaagcgaactggctttttcgttttgcttacatagaaagaccgcctcatggaggaacagatgagaaggagactctgaatccttggggaagccgagaaaaaacgcaagacttccacactgtctcagggggctcgcacaacgcgttttatgagagacgactgagaaaacagcgacagaccttttcctggaggagacgacagacgcaagttcgtcatggtgaaagacaatacgaagccgagaagtcaaaaggactctcggttccctgcagtcacgcatctaaacttttcaagttcgtccccatctgtcttcagccactgtccatgctttttttttctttttgctgttgttgtgtcttctcttttgcacatcaaatgctgcgagagaaattgcgctgaccagtctccttcagctccttcatccagagatttacaaagatatttcacctacacaccgccatacccagtgagatctggaaaacaggcaaaacagtcaaaaaaaacgcgacatgccctgcagacttctttaaagaacagagagagacatcacgatttcaattcgtttggagcaacatgtcgaacgatttctctgaagcgcataccaaggttgtttatactttttgacagacgtccgtatttgtaaataaacatccatttttatgtgtctgtaaatgaacatacttttttatttgtcaatgcggcagaaagtcctgttgtgcatgcgaccgactgcatgcggcaactgaacttttttttcgagtttcttgcttcacttttctgcgttctgtggagcctcttaccctaacctacctgccagtcttaggctttgtctttctttcgtggaggctttccttttcgtcgcgtttcctccctggaagtcgaagagacccccgcgtatccgccgtcatctcaacgagctgaaaggaacacacgggcagcagccgacgacctcatttcttcttcgatttctgccctcttctccgacatttttatgcgtatcttcttgccctctgttgctctgctttccaggggggctggcgcgctctttttctcatcgacaagccgtctttgttcgtcactattttagatttcaaga

SEQ ID NO: 3684 - DNA, 1450 bp, Toxoplasma gondii
gcaaaggagcttcgctgcagcaatgtcggtgaaaacctcctctgaaccgctttccgtcttctgcacgctgagcaaagagtcctgaagactgttgtcggggacgcatgccgcgaggcctctctccagaagagccgagacgcacagcgtgacgagaggaggatgttggggagagtaacgcacgcgcaacatcgtggctcctcaagacatgcgagaaaacgaagaaagaaaacgaagaaagaaaatgcgcgcgcgccgtcgaaagttacctgaaaacaaaagataaaagagtcttatgcatagaagatacacaaggctgcacatgcatctctgcacatatgtataaataaatatatatgtatatgtataaacgtatacatatatagatagatacataatagtaaatgcatatgtgtatctacgtacgtagaagttttctatatatacaaatagtatatgttgtagtgatgtaggagaagatggctgtcctaggcatacgtacttaaacgcatatgtaaatatatatttgaataaatgagctgattttcaggcatgtataggaggatgtatggctgtagagacatgtgtgtgtggagactttgccgacaggttcgggaagaagttgaggaaggaacgaggaactggggcgcctcttcttgcaacgcgggggagagatcgacaattgaggactttgactcgaggctaaagagaggagagaccgtctccaaagcgaagactttgaaaagcgaacatggcgcgtttgttctcttactgcagtgtctcgacacctagtgagagactcgactctccgtttccttgcggggcgaagtgtgctcgtaggcgacgcgacaagaagcggatttctgaggagctcctgctctggccagacagaaacccccaactcgaacgtcaacagagagttcagagaaaagttgtggcgagacacggcagcataaagccggttttctgcgttggcgacgcctcggtgtcggcgcccgcgtcttttttgtcccggggttccccgactgtgcatacaccgcagtgcgcatgcattttgacatgcggaaaaatcgttgaggacaaaggccttttctgtgtcgacctcgaagctaaaacttgtttctttcaccttcttgttcttgagcgtttcttcttctcaggcgtctgaggttgcgctcgaaccgcgtccggtttttctcacaacgcgtcggcgtctgacgaggcgttcggcggttccggaggttcacaatatctgcatcgaaaaaaagcgcctctctccactttcttcctcctcctctgaacatctttgctgacggtcgagggggcggagacgcgccgcctgaagggagcgtggaggcggacccgttttaggagtttgcataggtttcagaaggagtctcggcttggctggtgcggtgcgaaatttgcgtttgccacaggcgaaccgcaacga

SEQ ID NO: 3685 - DNA, 2154 bp, Toxoplasma gondii
gaacaagaagtgtggaagtgttgtgatttcaaagccgttgtttgcctctgtgtctgatgttggtttcgtggcgcaggcctcacaaatcgaactctgtttcgctggttcttctcccagaaaaaggctgtttttatcaaaagtgttacgatccagactgccaaggatttcggtcgcctcccgttgcctttccgccgcaccttcatggcttgcatgaggcggtggaagacttggcgtctgtcgtcgtccttgaagacaaagacgaatctgaagtcagtgacgcttttcttcgaaactgggattcgtctcgcatcgaaaaggacgaccgttttggactcgcggatacctcttctctacacgaagaagtcgaaggtgttggaatagacagcggaacgcgacaaacacatcgaactgtgagcgaccaggaaacagccagagcgccagaaggggggacagcacacgcgagacaaaccagcgagacgaggggattcttacaagacgggaaacacgcgttgggatgtacggaacggaaagacggcgatttagacttagacgacattttggccgcggtaccagtgtgaagagaggatggtgagaacgcgtgcaagaagacgatccggtaaacaatgaccgtgatggtgtaactcaggactccaactcgtcgcactcactcccgaaacatggggtctaaaatcgagtttcttgattgaaaacgttccacttttccccaccgcggaagcagacttcttagctatgcagaagcgcccgcaaaaaaacagccgttctttttcactcgatctcgatatttgacccaaataatttagggaagactggtttttagtttttaaaatatgatttaccagatttcagaatctgttcgttccttttctgctgttagactgccagagtgtttcgggaaccacaacgcacaactacgccgcgaccagacacatccaccacggtgaaaaaaatcgctcagtaccgctattgagtgctttgactcgtgagcctgctcttgtgaggccgtgcgcagtcaggctggcttctttggtctaccgtgaagctggtgaggaggcactgtaaatgtattcattcgaatccttgtcgcgagtagaacggacgacagaaaactactactcagaagcaagaccacggatacgcgccattgtaaaagtattcattagaatccttgtagcgagtagaaaggacgacagaaaactactactcagaagcaagaccacggatacgcaccattgttctaagcgtcattatatggcgtctacaaatagaagcttcgacataagtcccgtcttctgcgtgagctttgccgcgggtgagctgaacgaatgtccaagaagatatcgacaaggctgacacaggggaacttggaagcggaaaaaaaagagactgcagatgcccaacagttgttcgattccgtgtgacacccataaacgcgttgagacagctgcttttccgatacacgaatcgtcacattggcatgaatagagcagtccgctttccaaatgctcttgaattttcctatttcggcgggtgtctaaacaccgggccgcagctcccgaaaccgactcgcaccgttcaggcgtctgacgagaggacattacaagtgatcttctgcagcaaggctgaggggcatcggagcacaattttcgtcttactcgcagtgatcgcgtgttccattcttttttatagccacgaagcagcaaagttcagcgttctatcctcgaaaattcgtctttctcgcgtggaccccctcacctcgagacgttatggccaccttcctaccgttttgacttctgactttcaccttgaatttcaggtttctgctctcgggctcgacgcttcttgcagccccgcgagtctcaggtttctcgaatccagcatgtcaggcccaaccgccatccaacgatcagctgggaaactctacctcgcattcagacgcaaagactttcaacagtcccgctggtaatccttcaagaacgttcaacgacggctggttggggtggtccgcatttcctgtcggtattcattggtgcttgaaagctgcagtcgtggatcagtagaagcgtcgatatagtccggtagtaaggtttaagatcgtacagactctactgtagaaggtatgtgttgcttgtgaaa

SEQ ID NO: 3686 - DNA, 3164 bp, Toxoplasma gondii
gacgtctcttgcgaacctctactcggttggacctcatcctttgtcagttgccgtcgcagtcagcatgcaacgcgcgctgagaattccgacagagaacgaggtgattctcaaagaatgcggaaaattctcttcgggtggtttttcagaccagacggaaaaaacgttcgacgtcgatatggagtccgacacgggtatgttggatgagggtgtgagcgacggggtgccgagcataattcctatgaaagctgaaccaagtcttgggtgaaacagaattggtctggaaacgaaagtcagtggaagaagaggggcgtcaggcttgagaagcagacacggtctacaggcctcaaggggaagccgcaggaaaccggtttaacctctggtgacaaagggcccttactatgtctagggttgttttccggtttctcttttgttgcgtgctctaaaacgaacgagcggttttttttcgctgccactatctttagtcgtcagacagtggaagtggacgtagaaagcgccgcccaattcaaattgccgcgtactatactttccatgaacaaaggagattcgtgatgtcatggaattcctcggtaaatgtgcgcctctgccaaaggagcggccgacgagagctgcagtcacgttccgggcttctgctgccgtgcagtggattcaggtccctagcttccgcggcgtccactgtgtcttctatgtctttaacagcagagggaattaggcaggacagagaggaacaagtttagtctgagaacactggtgccgtttctcgtcacatgtccactctggactaaagagcgttcgctttttgatgtccctatgaggagttcgcgcacagtgtgaagcagcctttccttcagatgcgcgaccgtcctcagatcctactctgaaaacaatcgccagcatactgggctcgtacaatgcgtctacgcagtcgccgcccgctagggctttaactgattcgttcagcgtattgaatgccaggatttcgtgattctagaaacgtctgagactatcgcatgtcaccggtttgctgcgtgagaacggtcagacaaaaaattcgggtctctccaacatactctgacacaaacgtaccccatccagttgctgcagtcaatgcacacaggaagttgcaggtgatttccggagaatgtttcgttcgatgaaatgaatatgcgacgcaagatgccaagaaaaaaatcccgtattatttttaggtgaaactctggaacagcgacttgtaccttggaagtttgcatacggaaaagctgctagacaccgctttgcgaaacaatgctcagaaactgcttaactgaaaaaaaacgtcgacggaggtttgcataggtccgatgttcaatttcagcgaactgatacatggacatatgttgcatccactcaccagccaagattcggaacctcaagggcagcacagcactgattctcctaactatagtgctccaaatacgcaaattatggaaaggaagatactaaaggcatgtactgatttgtttttcttttccccccggtcagcaaaaaacgatatacacccttacccaacggcatgtattagtttgtttccatcttcccttatgtcttctcaacaccagacggcctttcgtttggcgttccgccagctcccagggaaaataagtcacaagcatttatttgtacacccaaggctgtccgccttgacaggccatgggtctatcagaaaatctctgagtatatacaagggtacatcctgtaactcggaccatttgcaatctaatatccactgtgcgttgaaacgatgccacccatcctgagagatacagactgacagaggaaggcatatgctgttgaaatctacaatttacctgatattaaaacctcggacaacgacagacaccttcgaccccctcattctcttagccgaaagttgcgggcagcggcgccgttgctgtgacgcgtggcaaagatcgccaacttggtcccgggccagagacagttcgggagaaggaaggctaggtgcgagaattggagaacattctgtactgagaaatcgcttttctgtgtgcatgcaccgaagttggactctaaagaaagtacgggcacacacactctattcccgagctgtctgtgcagctgctgcatgcgatgcagcagccgccgacagctgtgttacctgtgtttccagagtttctttgtcacaattgtctgtgttttcgcataaatttagattctttatgggccaccagagtgtcattttgctggcttctcctcggttctttttccatgttttccccccgttccttaattcacgtcgcggacgggctcacagtatgcttgaagaaggcatctagctcgggagataccgtttctgcgtggttcgttgctcggaccttcatagcacgcgctcggttgtgtgtgcgcgcgactttctggagcaggaaagtaccgaagagtcctcgtctgcgagtgttgtgtctcaaaattatcgaaacggttgctggcggctgaaccgtccatttgcttcttcagtttcacgtgcgactctgcgccgagcccggatcgcgggggcaccgtcctgcttggtggacagcttgcttcgacgcgttgtcttgctaataacttctaccgtattccccctctgtgtggctacaatcgtcgtatgccaatctgtcttgcaaaaaccttccgtagtcctctctgtctagataaacaccacggcactccactcttgctaacgaatataccatactctcctctgcctgcctaaagtcatcgtatgccagtctgcgttgctccattctatcgtattcccgtctgtctcactaactccaccgtattcctttctgttttgctagactatgttcgcttctactctgaagctcccctctggcgaacgtcgtctgtattccactttgccagttggagttttttatccagatcgacactgaggcacgaccgtgtggctggagagcaaccttgtttctggtcttttccggcgtttatatgagacgggtgggttcccgccctcgactcgctccgggcggcagaccgtcgttcgtcaacgttttcggggcctgtttcggaggtgtgactcgatgactgcctgactgaagctatcgttctttgcgtctcgctaggacgtctcgtttgctcttcgctcaaaa

SEQ ID NO: 3687 - DNA, 2001 bp, Toxoplasma gondii
cagcgggtggttgttatgtagaatcgagtagaatgttggcattctctgaagaggcgaattaagagagaaaacgtctgctttgtctaggagaaggggcatgaagtgcccagacagcgtccccatattattggcagaagacttcgaagcgtcgcgctgcacgcacagagcctgtctctgagtctttcaacttcaagacgggagcatctttttgactcgcgtacgcgttcttttgtgaggccaaagcgtcgagacacagagctggactttgtgctcaactcccgcggtacacgcagtcagcgagcagcgtcgcgggcgatacactcacacacagtagttcacgttcgtctgcaggcacagcagttgatgaagcaggaaaattcttttctcagcgtccagtccatgcagtggcaaacagcccgtggaggctcgattcctgttgcacatcgtggagtgcgactcctcggtttctgcccagttttctttctggggtgtgcactccgagtgaacgctcctctggggagattctgaaggccttcgttcgccatctccaagttccacgtcgcactagcagagcatggataatgcgaaggttcgtgcagaaagacgccactcgaaaagctgcgtgcactcgtagagcagaggaaaccatactcatttttgactgtcacctgaggcccaggatttgctgcgcaaacgcgtcgcccgaccaagttcctcatttgtgtacaactgtcttcgtggaaccaatacgaatcgttgacctccgcaaaaagagggagaaacagacttgcacaccgcgtgcgattcctcctttgcagcgacgagagctctcgttggacgcgaattcgacgtactgtgcgctgggttcgtttcggtctacagtgatgtgtgtcgccctgaactaccccccctgtagatttttcatacgcctttagacgtatcttcacgtatcttctgttcgaggaaatctgtgaacaagtacagccaacggacggctaacaggtgcgctgatctcaaatgttgattgtctcgggaaaacctcccgggcgtcccgagtgaatccgcaggttctgccaggtaggaacgaaggcagttctcggctgcagagcctcagccgcttcactggataaaaaccctttgcaaacggagaactgaactcagtgcggctcttctgatcgggtgtctggggaactttttcgcgttgcgtttcgagaacttcgcctgcatgcagttggactttccagcgtccgcattttgggtccccacgacgcatgcagcaatcgccggcgtttttttcttcaattctttccgacagcttcctgctacgtcttcgcagaaggttttcctgtccgcggcagagcacttgaaaacataaggaaaggggagtcttctcacgaacctcgttccttgtctctcctcaactcacaggctcacaaccccatcactggtgagctcgtggcgaacactctgctagcgtcgtctgcatttctctccggtttctatccgcgcgcgccttccgtcaaccacccgtcaaccactgtctgcgagcttccttgtctctgtccggttttactttgccgccccgcttctgtcttcgtctaaagtctgctttccacctttgtcttttgctcttctctcctctcggccttcacagcctgctgcatcctcaaccaaaatcgtgtcgaaagaagtcctttttctaagggatctgcagcccatttctccttcatttccctcagcattaccttcttcctctcagcgtcttcgtgcctgcaccggacacccagctgcgccgctgctgcttcaccttcacacgctttctctcagccgacattcccttcctactctctcctctcatctcctccttgttctacgttctacgttttctcgctgacaccgtcgcttctcttttcgtcttcttcctcgcctccctcgccgtcgcttcacgacttctcgggtgtctctgcgcccgcccctggggtgtacgtacacctgacacca

SEQ ID NO: 3688 - DNA, 3042 bp, Toxoplasma gondii
tgcgccgacgatcattgcagcatttggtcggatcagttggtcttcacgaagacgtgtggcgcttacgtgacgtgctatttcctgaatttgctcggcgacaaagtcgctttgctgaagatcggaacagagcacagcataaacgatagggaccatcggtcactgcccacttgttgttgttcagagaagcgaaactttattaactgatttcggttgcgcgtgccaatgggctttaaggggatcagtgcccttgtacaaaacttatattagctaatctcaggaacagctcttccaacctgagaagatcagtactgcccagagacgggaaggcaacacaacgaggcccattttcacaaaaccgctgctgacgtaggaatgtgactggacgacatggccactacttagcgcttcgcagaaagggataatccagtatcctatgatgaaaaggatatgaaccgcgttcgtggcttcggcaaagggaaatgcagtggtggatttggcactgtatcgcgtatttctttatgctgaagactagggcttctgttaagcacaggagagacgaatatgtaagctgcaataatagcttgggactcaaatccgaagcatgccgccatttctcacatgctccaacgtcagctgttgtatcattttcagccactacttccaggcaacctcacgggtccattgcggtgaggaatcaatcaatgcaggttaattctacttcatcggcaaggctgccggaaaattctgacgatagtttggaggctacatggtgacacgtcgtctcagaagtcagaaaacagagcagagcaccttctggtaggcgagcggaccagacgcagtagagtactatgatcgtcaggcaatcggcgattccctgttcgctttttaagagcgcagccgggttcggtctccgtacctcgtcatcttcgtgtgacatcatgaaccccgttattcagataatagcgacctagcaatagatcgcctctacgaatagtacgggtcttcagagaaaaactgcggcgctgagagagagagatctagttgacagaaacccagctgcttctcgattccagcaattgagcgtgctgccttgttttctatgttttgtacgcagtggcagatgctgcgtcacgagcgtagagattccgaacagctacagtgccttcggcacctactgaattgcatttattcaaggaaattaaggaggttgtgcacggtcgttaaaaatgacacctgcgattttctcacagggacaacccgaatatataattacgagtcagattgcatgcgcttgcgaatagcatgcaatcttcagaatattagtacctctcccctacgggtaagcctcatcgatatcatcaaggtgattagtgcaccagtcgctcggagtcgcgtgatgtggtttgtctgggtgcagtaacgcttcagcgggggcagtcgaattggcagacagaagcatggaatcaatgagaatacggatttcgattgtttttgcctgaaggagccgacacccttcgtttatctgagtaagttttgccagggccactatcaagattttagcagccattccacgagtaaattttctccgggggcccgaagtcctgagaacgtcctaaatttgggtgatgcacttcactaggcgcatccattatgtcaaatcacacgactcgcgcggcgtcagagcacaaacccagactacgacgtatgcaccaaggcactgcggagaagcgatagcgtcgcagctcaggccgaactaggatatgttgccacacacccttcttgaaagtgaatggcccggttcttcccgaacaattttttcccttagttcctggatgccgtgggtgacaacgtggcgtctctggatgtgctgtgttttccgagagactaggaaaaagtggtattcattgcacaaaagaaggttcggggagttcgtcgctgtgaatccgaagtggacgtaaatgcacatctacaagggctgacgctcctgcagtggtctgccagatttgctacagagctgagtatgcttctactccaggatgtaagactagggaacccaaaggggtaccagcttttgcagcctgccaactgaggaaggatcacctgtgatggtagttgttgccgtcagttgctggctcattaactcgatttgccagtacgctgttgacagtggcgttttgtggttgttgacttgtgacatcgtctaatcttcaaagagttgtgagagtcttcgctggtctacgtcttctttctgtctgaggcgcggtctgcagtcaaacgaacgcgaaatgacctgcaccccttcagtctatgctccgctaccggaactgactaggttgccatgtaactatcgacccgttcgcctgaaaatgcaaatgcaacatgagaaaccgaaatggaacttcatactccgcagccacttccgtaggagctcgcttagtcacttctttgaacagcgaaggcggtggaaccgtacatcgcaaaagcctcgaacggcttctcacgtcaagccacttcccacccgttacatagaactgcaggaatctcaaaagttcacctcaaacaggtgcaagaacgagtcgtttttgtttgggttatttgcaagcgcgaattgtccaagatcacaccattaagagaggccaccaacatctaaaagcactcgctgcgagacggcttatattcggtcccgtcaagcataatctagtcaggttgctggtgcgtgtgggggatgcattcgaggaggtgcgagaaaaattcgcggggccctttgagaggtcctagtagggaggagaaaagtttcatggatatcggagttgagtcaaaaacgctcgtgggtgcagcagtgtcaccgagcagcatctccggcgcacgctccgtttctgtcaagaaaactcgcttgcggggggacagcagagactgtctccgaacagtgtctatgcactggcacgaaaacggcatgtccttgtagttcacatctattctgtgccccttggcctcctttcttctctgctcttttttttgtcacccgctccatcctggacaaaa

SEQ ID NO: 3689 - DNA, 3870 bp, Toxoplasma gondii
gattcacgttctggctcactgcagcagcgtgtgttgttgcggctgtccgaaactcgcgacctctgtttcggctgacgataccaagtctttcgcgggccttcgcggctcggcacctgagcgagaggggccgcacgcaaggaatttgtgttgtcgggtttgctcaggtgtctctgaaaaggtttcaccggaagcggatgcagaacaacttcagatgtgcgtgcgaccggcactacgcattgttggtcaagtggcaacgggcagcgttcgccagacgcaggttcttttggactgctgtgtcactgatcaaaagggtctgtacggaaactcggacgcttcccacgcttcctcagctcccaacacaggcgtgagtggccagccttccatcttgctgttgcacattttgcggattttgctccaccacgagcggaaaacagttagaaaggactgtggctggtgcatcagcaacatcgccgttgggtcgcttcaccagctgcagcaacttttaggcctgggcgttctggaggcagtgctgatgcagctctcccctcgcggagaggaagaagaggaagtccgccgcgaacttctctgggtggtcgtaaacgcatgcaccacagccgaccgagcggtcttgagtcgtctcctcgagctcggtgccattcgccccgtatgtgaaatgctgcgcgtcgcggctcgcactgctgatccgaaggccgcggccgctgcagctgatgccgtcatgtccattcttgagaagtctgcgcctgtggcggagccgcgcacgctcgacagagattgctcagagcgctctgaggctggctggctggcaaaaggcgccggcttccagaagttcacgggaaacctcgtttgctgggatggaaagggcgggaaaactttagattctaccggcctcaccaccgccagctgcggctgctgcagtggagagaacagcggcattagacacgtgtgtgtgtgcacgtgccaccaccttttgctcctgtctagtgcactgcttctcgaagaggactgtcctctgctgctgcagctgctggtccagcaactccagcagcagccggcggatttgtgtccagacttggttgctcgcatcgggcgaactggcgaggcgcttgttgaggtcgcctccgtcgtctctcgacaccaggtaattgttcggcagttgatccaacactaccagcagagccatgaacaggctgctatgaactacttggttaggaaaagcctggcgaaggaaagtcgctgcggatctcgtctgatcccgcgagaaaacggacttgacggggacctgccatggcaagggggcgccgcatttccgcctcagtctttgcctgccactcttgagtgctcgatggaaagtcaccattccgtgcaggtgtcgactgaagaaaaacggcttttcagacggtagccaccagcagtttctttctccatgtgaatctgcctcaacccccttagaatttgtgtatcatcttggcaagtggagagtgttttccgctgacccgagggaagtgtcaaacccaggtgctttcttgtctttccgctcttcgatatcttgggacaaaacgttcagcggagcaacacagtgaacggcacctcgactgacaagccacgtggacacgataacaggcggaaaacggctgcgttgcattttagccaaagatcgggaaccacttcaggagtcaacgtctatatatggattcagaaaagacgttttataccaaaacaaaatggtcgtataagtgtttatatgcagcttttatagctgcggtctgtccgtgcaccacgagggaacaggaggaacaggagcgcaaggagccgatctcagtatgttcctgcctccactctggagtgcgtccttgcttcatttctgtgaaatggtaacaaagaagtcagagtgcccttgtaaatgagagaaatctcacttttttgccactactgggacgcaattccccctgagacggcacatccacctgacgtgtgcgggcgacatcaggctgtgctctatggatatgagataacatgcgggagcgacagatgacctaggatacaggattgtttccagaagtggagcaacataaaaaatcttccttgcagtttgcacaacctccccctcactgcagacctgccatttaaggaaagcatcgcagctgcccgctctatttagacccacaatatgcagcacctccagataagctgccgccatccacagtttcaaaaacgaaaaatggataaaaaggggaccatcttattcaaactgacacttttcagtcttcgtcgcagcccaggagacgtcagaaaaaatcgtggcccaaggaaccagctttcctgcacgatgctgaaaagaagctgtgaagacgagttgccgcacctaaaacgtcgatacaatcacgcctctcaacttttctgaatgtgttttgactccgaggaggctcatggatcgaggcaaaaagagagcgaagaaagtgtaaaaaacacggtatctctgggagattggggattcgtcaaatgccagtttgtgggttgtctattcatcccacggggtcccgccatagttttggtgccattacatccggaaacaatattgttaggctcaaatttcgttaggcagtgcctatggaattatttctcggaaaaaaatatgagaaccaaaaacaaacctgtctccaataccattttttgtatcttagctacttacagggtacttcgtacaaggcttgaatatgtctctgcgtccatctagtctggtgctcggttacacatatgttagaagcgaactctccgcctcaatttttcttttctttggacttcggtggtcggcactgacgctttgctagccctcgcctttggcgacattcagcacccttgtctggaccaagccctttccccacgagcacagccgactggcaccagacgagtgtatggtatctctacgaaacacagcacgccgttactcctcgaggaaagagacacttttaaagaacagagaaaacgtctcgagaagattctgcgggcggcttcaccgctgctgcctttctgcgccatttagaacaaggtgttcgccacctcgtttatggcttatccggccttctgcttcaaaaggaaaggcgacccctgctagcgaccagtcttgtttctttgccaagaggcacctgcacgtcaaaacccaaacatcatttgctcggggtaaaatctgtcgcggactgtctacagcaaatacgctgctttctctgaaacaccagcgaccttgacaagccacacgcgggtcgccctagaccggctgtctgcgagtctgcaaacggcagttagccgaagcgaaaaaccaatcaggcacagcgctggactcggggcaccggtttcggtcagggccccgaaagaacccgtttcgtggcctgtgtcttttctctgctcgaagacgctagctgtgcttgtgtcttgcgctacctgcggcccctctaaatgtctgcccgcaactgctagctgctggtctcgttgaccgttgccgacaagatccacgagagcggcgacaacgagcataccagacccgaaggcaggagcggaatccgagcaaagacacctgtcaaaaaataatccttttttatcttggactcggccggatctgtgtgtcttgcaaccactgcttcgcatagcgctgtcccgacatcccgcagcgccaaccgtaccacagtgttacttctgccagctagttattgcgcagtctcggccaggagccgcaaacagcgcgctggcggattcgcatttctatttccgggaattccaagtcaagacgcatgtcaagtgaccaaggcgtcgacgcgtcgaactctgtgaaagccttccacttgtaaccggtcaaca

SEQ ID NO: 3690 - DNA, 3980 bp, Toxoplasma gondii
ctctgaactgtttttgctcggcagcagctgaaaagaacacagacgtataagcccagagaacggtcaatgcagacggacggggagtgacaggacgatgtctctcgtgtcgcttcgaaaacaaaggaaagcgaaagtgaatggaaaaatgaaaaaactcaagacatccgtccagtcctgctgcgcgttccggaacggctgaacgcaaacgctgcttttaagcaaaacgtcagactcccttctcgcgtttctcttcgtcactcttcacacgagtgcctctccgcaaatgcaaaggtgaagagaccttcggagacgcctggcgcctcctgagagttgcttgaccgtccccgccttccacgttgcgagtgttcaacgaagaaaaaagtccttttagcttgagaagctcgaaatcccctactcgattcgtcgccatcgaaagaagctgcttcttgcgacttttctgtctcacgcgtctctccttttgcccctcgtcgctggcgcaactcagaagcgccagcggaggcaatacagcctgcagagccttcgtccgcgaggacttctacttcaggacttgcgcccagcatgttgactcgagtcaaaagagaaggaaacggaggtggagagagggacggaactaggaggaaataaaaaaggaaagagaagagggaaggagaaatgagtcgggagacgaaggtgtatagaatatctcggaagaagtgaaagaggaagcggcacaccggagacagctagcaggagggagagcagaaggagatgagaaaaaatgggtatacatgtttgtaaatatcgatggactgaggcagggaacggaagacaagagaaagaagaaggaaggaaatgcaagaaaagagcaaaccggcgcaaaacagcgagaaaaaacagttcggaaagttgtccgactcaacgatgaagaggggggggcagctctcagaggctgtgaaggcgcccgcgagaaaaacggagatcttcccaaaaagaaaagacacataaaacagatatagaaaaagagaaaataaaggactttcgacctttcttgttcggctcatgctccgcgtgttgtgtcttctgtcacagcgagaaggtcgtctttgcgatgtgcagcacgttcgacggtggacttgagcacacactccagagagcattttactgtctgttcttatgtttcatctctgaagatggatagctgtggattgctttctttcatcgctttcactctggagaggcatgcaggtcttctgcgtgtttttcgtcttcttcagtaatctcatacactctgcagcgcatagtgaacctgtaactaacgccacgtactgtttacgacaaagatactcaggatgagattctccagtcaccacttgacatccgtggaggtcttcctctaattcgttttacttcaggaaagaaacgcctgtgctcgtaaatgcaacgtatgctcagagaactgagaaaacgtggagactggccgtgacacacttttccttcctctctgttttgcctctgcgagaccactctgaaatcccgtgatcctcacagaactaaacccgatttaatttgccagtttaggaacaggttcgttgctttcattctgtgtaccgcccctggtaagatcgtgattttttctctcaatacaagtctcgcgttgcttgtcaagctccttgtgtctactgagattggcacagattagtctggcattgtttatcccagttgagtggaatattagcattgacgtttccattctgtgtaccccccttgtgagatcgtgatgttttctgtcaatatgagtctcgcgttgcttgtatctactgagactcgcacagattagtctggcattgtttatcccagttaagtggaatattagcattgacgtttccattctgtgtagagcccatgtaaaatcgtgatgtcttctctcaatatgagtctagcgttgcttgtctcgccccattcgcacgcgtccatgttgctaggtagtcactttaagagctgaacagtggaacttctattaagatgcacgcagttgagtttgaggctgaactggcagaatgaacggaaaatgaaagccgcctccttgttgagtcggttcctgtttttctttcagatgatttctttgacggaacaaaacgcagctgaatcagaagcccagacatccggcggcactcctgcaagtgattgaagacttatgagatgaaaatgtgttaacacttgtggtcgcctcccttgtgcatcgaacacgttccttgggaatgtatattggtggagagaaatctcattttctctaagtttgcgcaacgagcgcattaaaaaagtcgcactgacagaaggcgtgagcgaactccttccagcttcactgcacactagacgaggagaagagaaagaaaggaggcagctagagcagacaacaatctgaattaccttagttatgagtggatttttacttgccttcgatgcctaggttccccatatctgagatgtggctttaacgcatgcatattgcccgttggaacacgtggaggagagcgatcgtggcagcgccactctcggcgagaaggcaaagaatggagacggtagaagtacaaggaaaagagcctcgagaaaacaggcgtgaactgtaaagtacgaggaggaaagacatagaagacaggtgggactagaatgaaaaggaagaaatgcagaattccttcaactcccagctgagagacttgctaggcgacctagagattttcgtgaacagatggccgcaaaaggcatcgagggaggagcattgcggcacaccaagaaaagaaaaaaccgagaggaaagtgcctcgcgttcggtttcttccccggtgtctcatatgagggtcgctccctcgagtaggcgtgaaacaagctacaagacagatagagatggagccttcttcggcaacttgtgactgtgcatcaatctcctttttcttcggggtttttctcttatccaaccctagaatattctcccctttcttcttccttcctgtttctctttcgactactcagacttccccgcccctcgcaatgtctcattgtcaccacgaggcctccctccccccccccccaccaccaccgaccgtcaagcaatcttttcgctagcttttcccgacctacgttttatgctgcgtcgcggagcaccggttgtcttccactttttcctgcaagatgcaagacaaccatgaggttcctgtttgaacagctggaacacggccgaagtgtatctgggcggaatccagtccactctgaaacgtgcgcttttttttccgaaaaaagaacggcacagtgaagtcggtctgctgtacccgaagagatttgccagcggcaagttgcaagggaaccgcttcatcatcccgttcacccgaagcgaagcccggttctttctgtgaacccgagtccccaaaatccaggacacccgacgacgcggcggcggactctctttgcttcctaatccctcccgtgtctgctgtgtggagcttccggaaagccgtgcgtcccgcaaagatcgcgtgaaacggcggatgcaacttcttgaaggcttcgctttctgtggtggttctctccgccgcgtgttctggcgcgtagccgattgtacatacaccccagaagaccggagaagactcctactggccccggctcgtcgctttcctcggtttacctccctctctgcccaacgtgtttccattccaaaattgtcctccgtccaaggttccaacctcttcgatcgagagtcgaagcagcgtctgcctctgcgtctcttcacaggtgtcgttgtttccgtgaaagtcttccgaacgcagaacccaccggaagcgagcgtccgactgcaccctcggtcggcacttgcagagagaccttcccctccggtctttttttccctcgtctgaagaaggcatcgcaggcgtgtctggtggcgaagaagagccgcttttctccgaacttttttttgagcagcaggggaca

SEQ ID NO: 3691 - DNA, 2963 bp, Toxoplasma gondii
tatccgtcataaaggtgcgatgatctttacacaggaaggtttcgtttcagacagcaaacccatcaaagactgcagcagactctggtgtcaaatggtttgcttcggagcctcaaggctctcgcgctttgggtgccttgtgcccccacatgttgacgtagaatgcgtaatgttgaaagcctactttttctctgaagcctttctcaagtttagcgtcatcaattcattttcaaagatgcacagacttcatcctaggactatccatttcgaaatagaacaaacgcgctacctgaaacgcctcacgttccaaaaacgtgagtttgaaggaagttgaaggtttccgagtaggcgccgaataccagtttactcagtgcacttagcgtgacgatcgcgaacagtgcagtggaacacggatacaaaaaaaagaccctcgagagtaccgcgactagcagctctacagcacccagtttacatcttgcatgcggccttcacagctgcattcttctgtctacttcatgcggtaggtactcagacaagagagcgtgggctcttaaggcagccaaaagtgagcttatttcagattgaggtttctcaactgcagtggtgtgtgcccataggaaggtccacttataaggcgcttctgacaagggtgctggcgcgctgacgagatcttgtgcaggggaaccccattttggagtgcgcgacagggccgcgaagaaactgtaaatggttttcataacagtaaactccaaattgtcaatacgttttcgtgacccgaagacattcaactaaagcttttatttatgtgcatggagggtaatacaccgcaaaccttttcgtcttttcacgtgaagatttgaacttacatatgctctgcgttgcttccacagaacttagaggcaagttgggcttccacgtgtcttgtttctctggagaaccggaagagaaatgaacaaagaatctccaaagatgccagagtgccatgcgtcgctcgcgtaagaagaaagtacgcaggaatcacacattttttgtgcacgtaaagcactacggccgtcaagggcgccagcgaattctcgcgagataaagcccttcaagattggaacgagtagtcgaacttacggtcactttcgatatgctcgagagagaaaaggagtttgccagaaccgaggaactccaatggagagtgcctaacagggtgtcgaccaaggctctgcacctacgtctgtgtgtgtcatcgttcacaagcagacagcaactgcggcgcgtgcgaccccgcgtaaagttttgtagtaactgtcgtacaagcatttcaactagaagagagacacgagcttgaaagcatacacaacttggtgatctcactgttttgctgtagccgcatagcgctatttccgtcctacaacagactctcacctgcctttgacgttgcctcccattacatgtgtgttacaaaatacacacgcatacatattatatgtatatatttatacatggatgcatggacatctgtctgaagaagaaccttccagtcaacaaagccgacccgattgccccgtttcttcctcagagttgtccctttcttccggaattcaatgcgtctgttccagttcgtttcctcggcctggcagcaactctcgatcgagcgactcgaggtgtgggcgtttcgtggtcagctgacctttctgtgagttcgtcgttctgtccttctcgaagaaaatgagagatttgcaccttggcttctcgaattctccggccattcctctccagggaggaaaacagtctaggtttcgccgggacaacaggggaaacatgccccccctgttctctgttcgtaggatacgctggaagccgacggtcgaggctcgcggctggtatatttgtccgcgctcattcacgaagttgtcgcgcgtacacacacgcagttctgttcttgtcagaggtgttttcgttctttgcgtctggacagcagaagccaagacggaatcgctgaagtgctgaataagcgtcgttttaatcaaacatcagatacggagactccacgtaccacggctggcttttccccagtcgccaacaaacgcgacgaaggcgctgtttccgctgctttcgacgaggggcgaatttcgacttttccatggtccctctgtgcaataaaaagcttggtagttctaccacaagtccatacgatgtcagcaggtggtgagcaatacaaacccagcagcagcagcggctaaatcgcagtgtttttacccgccaatgttcatttatgtccgcaagtgaaggcgtttccattcaccgactccttgtgtgtgtaaacaggtgacttttgagttgggtacgagtcctattcagaggcagtgcttgccctccttgtctgaatgtcctttctcgaatgaaatacaagtcgtccacaggaacggttgcttttcgggagtcaaacagaaagtcgtcgtctgcatctcatcactggaccgccgtttccaaatccttgactagactgtgtcgtctgccggtgaagtttgtgagacagtgccgtcactttgagttggggaagcggctctgtttctcgcgttcaaatagggtgtgcttcaaaagaaagaccttcccgactagagaggatttctcgatctgtcgaagtccttttcgcagcacaccccgtggcgccaaaaaaatcattttaaccattttttttcactttttctcctgcttgcacatgtacgcatctgcagtctctcctcttgggatgcaagcagtcatttcgcgaaaagagtggagtgttcggcattcgtgtttagcgagttctcagcggcgtgtttcttcctccgttcctgcccgctcgattttcgttttgcgtctctctccccctccatttttctctcctctcctcctcttccgcctttctgcgccttcccttctctgtgtccactaaagcaaacgggtggtttctcagacgagtctgacgagcacaa

SEQ ID NO: 3692 - DNA, 1684 bp, Toxoplasma gondii
agtatttcgccgacggctgagctgtgttcattaacggaaagatatcgatacctgcagcaatggtggaccaacactattactcaaaaaaccgtcacaacaatgtcacacttgagacccgatgtgcgcatgctccctggagccgggagagccaggagctgatacgatgcggaaagaaaaagatcttaccggtggaggggtcgtatttgattcccaaatcgatgtgctcctgaataccgaacccgaagttgccggagtccgagaagttcttcttcttcaactcgtactccttgaccttaagacccttctccaggatatcttcggccttcttgccacggacggtgacatagcacgcaatcttttcattacggcggataccgaaagaacggatggtaaagcgggccttggagaactgaggtcgctgtcctgtcaactgttccaacacacgcgcagcgcgagtcagtctgtcgccggactgcaaatcaagcaaatagaaaacggaaggcgttcattcaggcacaagggtagcatgcgtattcctgtacggcctctctgaaacgcagctgcatcacatggagcccatcagaatggtagaaaaaggccgacatcaccgctttccggcgaggagtttccatccggagccccctccgtcgtcagccctgaagagcacagcgacacacccccttcggccttgctatctgcaccgcagaaacagaggtaatcgttgcaacatccttcataagtaagacaggggaagtagactgcgtttacccgttcttccctaccagaaccccacaggttttctgccagggagcttgggtaacccttagagggaatcgcaatgtcactggcactttcccctcccccccccgcctcctggcacaaataccgttttcctcgttacgcccggaaaaactggagtcgacgccgacacagaaggaggcaccaccccgagcgaagaaaaagagctcacttctccgacacagatgttgagggtcagcttttcaatgcggatcttccgcatgggattctcttctcccttcttcaccatcttgattgtggtagtctaccgggcgaaccaaagagacagatccacgtgcaggatttcgcccctacaccgttcagtacaaatgacaatgaaaaaggtgacaggcgggcagcgctggactttttcaccgggggtcgactttttcgtcttcgcttgcaacgtccccgcttttcgcctctcgagcactgtcaaccacgacgaaatcctgtcgcgttgccccgcaggagggccagcaggcgaagccccttttattagccgaatcccaggaaagacagtcttctgctgcgcctggaaaaaaaacgctttccaacgcagcgcatgcaaccgtaatagaggggaccgaaaagcgcttattacatgcgccaggcttttgtgggggacccggaagaatgtgctcgtggggctttgacagcagagagctcgcatgcgctcttgacgatcgatacgaaatttcttccaggataacctggccgtgagggggagtcgcacttcctagcattttcttcagtggttaaagtgattgagcaggccttgcgcactgtcagtctccacgccatttcttgctgcggaagctctcctgtcgtctcctgacttacccggaatattccagtttcgcgcgtcccgtttccacggacaaaa

SEQ ID NO: 3693 - DNA, 4852 bp, Toxoplasma gondii
aattggtcatcagttcaaatgctcgcggtttcgcctggttaagtgcattatatatacatatatatatatatatacatatgtatatatgtatatatatatgtatatatgtaggtatgcatgcgaggttgaagggaggaggtctctggaggatttatcgtattttggggaaggttcgattgcctcacctctccctttttgaaggaccggcgcgcaagcagtcctcggcctacaaggtggttgacgaaggcaatttccactgaggaaaacggcgtttcgaccttctcttcctcacactctgttcgatctctctgctgcccttgagagtccctgatgcagttctccggttcagaaacggactcgcaaggcaagtttcctcgccttctgtcaccctcgccagcgggtgccgacgcggaaggcgacggttcttcgttcctcatgtcatcgatcgaatccaagaaaagcggaaggagaaggacgccaggacggcggaaagaaacatgatgggtggagggcagagctaagcgcttacaggagcattgcaccagataggagaaatgaactgtttttaaccttcgtcgcttcccaaggcatgggagagaaacgcggggagtttctcccgtcggtgtattttaacggagggaaagtaaggacccggcagccgttcgctaggggctcgtgacctcgaggtctttgccttgtgtttaccttgatgaaaagtggagtgcgtttttagtgaagaaagccgtcgcaggaacgaacatacgcacacacttgccgggggacaggacgccgctggaagagagatgcccgcgatcatcgatggaaatcagcgggtgagttcgatgtccccttttgagacaaacagacggcgtagaggacaaaagacactccggaaaagcgaacgcgaagaaacatgtctcgaagaaggcggcgagaggtcttgtgtcagaaacaagacatccgcggtgagtggattgagctcgtgaagcgcatgcaccgcagcggcttgttggcagtgttggctgctctcaacagtcggatttgtcgtaaaggtctcggcttttatccagttcttgacaagggattcggatcgccactcagttcgaaagaagaggaaacggggtagaaggcctgcgactccaagaaacggaacggacggttttcaggagtgtgcagttcctacactttgcgaaaagcgactctcgacatcaccgcagtcatgcccagaatggaaatcctcaccattcgtttcctttacttagttcgacattcttgtgcgctttgaggcgaattattatcgatgcagggtcaaacggttgatgttccagagtacaacttaattgaacaatccgcgtacggtctgtgtttctacttttgacgcctcagtgcaaaagaactgtcagagtcctctgtgcttgtactcttaccttcagaagcagaccgttactattgttgatgagctgacgtgctcacattggtatgcctgacctgaggtatcgaatatgacacagacaacaagagatgcacaagttcttcctgactgcgagcttgggagcggcggagtggaaggaggaatccaccgcacaagagggaaaggaaaagcgggagaaactgagggacttgtcctggatggcttcgttgtgacttttaagcagcattctcagaaaggcggtatttcactgaaaaagccacggtgtctttgcgcgagacatgttttctagtttcttccattcggtagactcagcctcgctgctagggaaacagatcacgcgtttcaacatgggagaaatcgcgtgccgatcgctttcttccgtcttcttaccggactaaaagtctttccgttcgaaggagaagttcatcagaattctcctgtgcaccagaactacagataactgagaaaactccgcgcattcgccttctgctcatcttgaacggggcggcgctgcctcggtcagtagcctccattcgtgtgaaagacgacctgtagacacatgatctgtgccgaacgttgttcgtgtttaagcctacgtgaagtcacgcatatacatatatatatatatatatatgcaactgcaaagggaaaaattgttggtggttcccaaaaggggggtttgtatctgggtcagtcgtttcctagaaagcgtaggacggcaagtctgtgctcatcacaatcgcatcaagatatatacaaatgcatataccacaatgaagtcgtgaatatgtgtacacaatttaaaaaagtgcttttccccaggttgagcgtcgacccttcacttgtgtctgcatctgcttcgctgagcgagcaaacaaatgactctgttgtcattcagcctctagaggtgccaccgcattcaaaaacgcagcgtcgcttcctgctccgtaataagggtctagcgttgaggattttgagattgatgttaagtatgcggtctctacgcttttctagtgaccggcaacagtttccagggtacggcggccaagactacctactctgtgcagtgctgtgtcgcccggggagccttcgagtgttgctgcatccctaccggtttgtttctcgtaggaattcgacatcagagtaaataggcacacagcaagctggcacacgtgtattattctcttgtcatcgcccttgagattcgaaaaagagtggactacgcgccagcaacgcccgtctgcgacatgcttgacagggtggaaacccacgcggtgaaagcagcgaggtacggcggactggaggcgatcccctggcatgcgctttcttgtctcgtccacatttgaagaaacgtactttcttctgtagcgagcgggtctccaaggaaatttcactcagggcgacaaggatatgcaaacgacactgttagttattcgagacaagcgactcgtccactctacccggcatctccgtttctgcgaggaggcatttttcctttgaagtcgagatgctagtccacacagacgctctggcgcagtgactccatcatacgctcgacgtataaatcagctaggtctgaaagtgtcggtcaagtcctacggtagagtcgaaaactctccgctgtccggtgggtttgctcctcttcaaaatacatgttcgttgctgctaaaagtcctcccttttctgacttgttggtaaattcacatacgatacggcctctactgacacttttattatggcaagattctctgtcttctcttgcaagagttgtcacagcattcttccgttctctccagaaactccacactttgcgaaagggcgacgacacctcctaagcaagatcttccgaggattaaagcttgaaagaagttatcttgaacttgattgtttacgttttgaacgtatttgtagaccttttcttttcggaaagtgcagaagtggaaccagtatgataagaaattcatcttcagagagtgtctgtaaaagtgcagagcgaaagggaagagagcccacttctagccgtgtggtgttgaacggcacaagggtacaaaacgcctctgtcacgaaagctcgagatgcacggcacttcagtcgatggcttttttttacatgtatgtggtgtcgatgagtctatttacgaatggcagcgagtctctgtttaccacgaatgtgcaagatttcttcatcggacatgctgtctctttcagtttctttggcagcctagctgctccccatccaaaactgcttgctgcctcgctttttcctatgaaagagtgggcctaacccccggagcagaacccccgttgtaagaagctcacgtttggtatgctcgtgttgctttacagtgagatcgaggggatggcgaggcgggcgggatcgatattgaggtggaaaccggagagtctcgggctgttcgaacctgagaaggaaatggatgtgatttttgtctcttctgcagatctctactgttcctttccaccctggcggtggtttttgcggcttcctttttcacttgcccagcgtctacccgatcctcaactcagcccagaagacacggggactcggggggtcgcgcgtagctggacagcgagcaagcagtctcgggccgggacggttccgccgtgtttccttgtcaaaaacgaagaatctaaagctttttacaccgcttactctgttatttctctgccctactctctaaaagacacatcttccgcgaagaccgtgagacccgtcgcgacctcgcactcgctgcctcggactatgtggctacacctccgctccctggcttcgaaactgtaaaccgtcgaaagttgtcatcgacgttctggaagtcgcgcactccgtcaagtcttctcttgctatttcaaagttcaaattgaatgtcggatttttccagaaaacaagacggcttgggctctggcgccgctcttccccccccccccattccccaattcgcgtctgaaacactagcattgtcttgacgctgtcgtctgtctgcttcccgggctgttccggacaccctttcgaagtcatatcaaccttgaaactcaggaatttgtgcgtgtattctgtttactagttcaaatcggtcagaaaagaccctttctcgtccatccactcgccacttcatctcgtccgccctgttacaaagacctcaccctggacgttttagatcgtgcttgcgattcgccgctctcgcgtccgctgcctcggaggtccttcctttccttcttcttgcgaagttcttccttctcccttcttccacaccagttggcctctgccacattcgcgcgacagcgcaaatctgtccgatatcgcgtctaagaaagagtcatcagcttccagagcggtatgttccagccgactatgcggcgttgagttccgcagtcgcgtcttcttcgttcttttgcctcctcaaga

SEQ ID NO: 3694 - DNA, 2801 bp, Toxoplasma gondii
cttcgagtgacatgtatgacccgaggttgttcaccacctcggacgacgccgaaactgcgcttgcgctgtcggtgctgaagaagtcaccgagacctgacagatagcgggaaaatccatggttgatcagtggcggtggatctttggagttttcatcttgggtgggtgcttccacagatgcttgtgcgggcaccgcttctttggggggctcgctgagtccagtctccgtattcgggacctgttctgagacgcaaaaggtaaacacaagacgccatcacagtatgtctcaacagtgggcgcatctcgatccgaaagacctcgcccaccggcaccatgtaagggttgtacatgacctgtgtcgcacaccatgaatgcgtgggaaagcaaggatgctgaatatccgcatatgcacatgccgacaagctgggtaaagcttcctgctcacgcctcttcagtctcatttgacactagggttgcctaccaggtctttgaccctccgcttccgagctttgttcgttccccatggtaccaagcgggacacttgccaggcactgcctctgctattggtagctctgagcgaatatgcggcaggtattcgccacttccgctcgaccgcctaaggcacaacaagcctgccagtcgcaacgatgacgcatcttaaagaaagggcgcactcaccaggctcaaatgcagtttcaagtcaccttcatcgcgcttggttaagtccacagcagcagcataacatttttgttctttaaaggcaggactccgatacaagcaatcaagttttagagctcgaattgccgcccctttataaacaacagcgagttctatcggcttggcagcgtggcgttccccacgcactcatagcaaatacagacatggatgcttatacaaacggtatggcgaatcacattggggacgtcgaagatgtacgtgtaccagctgccagtacctccccgcgttggcaccacttgtatgaagaccttgttccattctgaacaaggcccacattatatcaaaaaagaacatgtgttgtgcggggaaatcatcaatggagcatacactgcgcaatcatgcgtttcatttgtatgatggtggatatcatctgcgttcgttgactgcctatctctgccgaacacgccggccccgtcctcctcctcctagcgttgtctaactaggcgcgtccccgtgttgtttatttgatagtttttcaatcaatacttgttctaggctcagaaaattactcgcctacctggaagcaaccgagaagcgaccacgaaacgttggtcaagaagcacgtgagacggaaggtaaatcaatctctaccaatagcccagcgacaccgcctttgcagggctggtttccacttcagggtaccttgaaaaagcgtgcagaaaatcttgaaatatactgtgttttgcgaagctgatgtttccttcgcatagagaccactttgccggaaagcgtttgaaacgataacagtactaacaacatgcgctcgctgacgccaggcagctgcgcactgctcgcgacccctgcggctgtgccttcgcttagggccgtctaatgcttcacgagtcacaactaagaccccaacaaaagtgttcacagtgcacaaaaactggacaaaaatgtaaccatatacaagcgttgttccacaggtgggcaggtttcttttacaagcgatccaaaacggcaccgcgcgctaacgacacactgatagcatctagggggaggctgtccagcactgtgcgctgagggaggttctgcaccgtttttttttgcggttgagtcacgcagatggctcttctgaggaggctgacaaccctgagcaagggaaaaagattctgacctagacgtgcatacctgtattacatgacgagataagagctatacacacgaacttgcatgtagtacaaggacgtgcaatgacacatcgttatgatgctttggctttggctacttcagcagcgctgctggcctgcatggggggtagatgcggggggtcgtagagatcaaatgttgctgtcatgcactgaactagatttcgcggctaactggacgaatcgacgatgccacagcgaaccaggtcaccacgtggaatcgatgtgaagtgtccgtcaactgctggccacttgaaaggatttttcgaagctcttcttcaccataatcggcattttaccgttcgttttttcttccgttggaatctgacacaggatccccttttcctccttttccgtagattttgtccattagttcggtagactagcattgaacccgaagcgactaagccaattttggtcgtgtaggcgagtttgccggtgcagggcatgcgcttccctgttgcgtaaaagccagttgtctacctctcttcacatttagaccttgcggttcctgtgtcgtctgaccgtttgatgggctttcttgtcgttgtccggttggcctccagcaagtctggcgctacaggaccttttcgcgaaaggaagggatgagctggacctagtcagctcgacacgttttcttaccagtgcgcgactcatgatgtgttaaatggcgacagaacattgtacagaagcgggaacagagctgcatattttcagtccaatttgcctccatgtcactctcgccggccgatgccgtggaccccatgagtaggggtggtacaccgggggactcttcatgtattctttaggtttgatgaaccagcgtcgatgagcctgactcatttgcatcgaattcacttcctttcgagcttctttagaagagacgtatttctctcagtgctgtgttgttgaagatca

SEQ ID NO: 3695 - DNA, 3267 bp, Toxoplasma gondii
ttactgttcattcgtattgatagcgacagaaaactacaggtagctgtgatgttaaggagcataggaactgctacacaccttggattgcaatgcacttgacataattatcggataagcactcagctagttattgagagacactcagcagacccttcgtaatctcaatagtttgcgatagaaggcccgcagggtggtggtgtacagcaagcgtaaagaacttgattgtttgtgcctcactgctggagtcttcttcagcaccataggtactattcttcctccgaatgtcggttgcgggaattctacgcgtgtgcctcgatgcccggcccatccccgatgctgccgaggagacattgatcaaaccgttttcagccactgatgacgtacgcaaccactgctgtataaaaccgcaaacgtcatccatcttttgagtgggacattctggagacaagaacatcgcaatgatgttgctatatattctccggttgtttcccctctgaacattccatgtgtcacgattacgaatcgctaaccgatgtgtaacgtcgcgggaggataggcgaagggtggacttcagaactcaggtgtcgtaagagagatgacacaatatagaattgctgcgatcttcgatcgcttttccacagtttggtcgcttccagtcgggcatgcggtttcactatgtcagagcgataagcggaaaaggggtctgtcacagcggtcgcttgcttttggttgcgttcgcacagcagtatggctgccaacgtgggatgagcgttacacgtcacatgaaggccccacggtgaggcattgctttccaacattcgcgatacgtcaaaaattggaagttttctttgcccctcagtatagagccacaactcaaggtggtaaaaaccggtgtcgcccgaacgaacatgatgtaggggtccccaaagaacctgtccgcaggagtgctgtttaagcctagtcaggtttgcgacgaacgaagaccgcagccaaggataacttcgctatctgcacatccgcatactgcagttatccaccccccgctccctcctagcgcagacggctagaggcgttgctcctacagaatatgcatgagcaacacaccaggttgctaggggaactgtaacccacggggcctcgatgacttggctgaacaccctgcagcaaccatcgacaggcgtggtttcttctcggtctcgcgcctttgttttgaggagagcctgcatttccagtagtaacggacacatacataaccccgaccagtacgtggtcgtgtcctttgaatcgaccccctctcagcaatgttccacaggaactagatatcttcgagagccccgagttggctgactcatggtttcgaatcgctccttctttgtccattatgagaaaattagatggtacttatagttttggtatgaatatggctccagtttcgaaatacagacagcaagtaatgtcttgccagtctccagaactgactcggcccgcttggcctaaactcgctccagcaatgaatctgttggaagcttgtcacacttgttgacgcatctctcatttcgttccagatcagttatacgtgttcttcgaaacctggcgtgtagtgaagaagcattccgaatgtagtgctataaagcagcccttctttgttgtgatcccctcgagcgttgcgctcccggtgcctctccgggaaacagcctcgcccgcaaagtgaatggacggtgccgtctctttcgtcccgccaggaccttttgtttgtaggttgggcgactcgtggctcgacgccgatgcatatctatgagcgaaggtcgtgttttctcccactatccttgcagatttcccccctgaagcagatggctgctgtcacttgcctccgaatcggtaacactccgcacaacaggcgagagagtggcagcccaatccccctgccattcaggtggttcacgaaactccagtgtttgcgtcgcgcatgcatctgtatatggtaggattttccacttgagtatgcttaattccagttggaaagaccgccagggtagcgattcacacgttcttttcgggtttctttcatggctactgggactgacggtcctgcccgtcccccagtcgacaaggaatcgacgaagggagagcagaaccctgggggggagctgcgcgacagacgcgaggttgagggggcgacggctccgtgcatcccgatcgacgaccgtcgaaaactcgcccgaacgtcgaacgcggagactgggaaattaagaggacgcaggttgtggagagggtcacgggtgcgtggtgtttccgggggacagctggagcggtctgtttctccgtaactctgtttcgattccgcagtttttcttggatgcagtcatgggcgaagagaattggtggagaacgcaccccgaacaaacggcatcttcacccgtctccgtggcgaaggctatagatcgtcattccgtgcagtgtggagactctactttttctttgccattcttttgcacgagccacgtgcattccgagtagagctactaagttactacctcccccaaacattaaaaatgcgttttcaagggttctggcgctgtgcactgattcgcaaagcatcctcgcccgaactctgaactctatctatgattcgaaggaccccgtggccggcccccatgaaaacgacagttcgcgtctgccatcaccaacgtgaaaaagcacccgctctacagtggactttctgcttttcgaactcttcgtttactgttccgcggtaggaagggttgcagggggaaaacccatctttcgaatctcgcttcgtctcccgctgagcgggcccccgcaggataccctccggtcaccgattgccggccgtttgtctctctttggatgcttgtcgcacatgcgactctcgcgtccttcttttttgtgacggggcggagcctgcaagcgaagatgtccaactaaatttcggtgtacatgtctgaggacattctacagtattgaggacgtgttttcccggatgtctctgtatgcctttggggccactccttgtttgagacttgacattctctcgatcctccgctccacgctgccccgcaaactcgtgcaaacatctcgcgacttcaggcggaactgtgatccagtgtggtacacccttgtgaggattcgggccacctcttcctcttcgagggggtccgtaggtccagcacctcgctgcctcgcttcgcttacttcagttgcgtaaacgcgttccgctcaaagtttcttgacaagttgtcagcacaa

SEQ ID NO: 3696 - DNA, 4556 bp, Toxoplasma gondii
agaactccacggcgaataagatgagaatggaatagacaggacagaaggggtctaacaaaaaaggaatcagcatgaaaaatatgctgatgagcgagcggggtatcgctaccaaggcatgctccgtgacgcaacagccacctttactacgcgtcaggtacaatggccacggtccatcgttcctctcttttcatcgatgtcagagaaaaacttcatgcgatgaatctcgctatgctgatactgtaggacaccatatacccaccaccctgaaaaagcctacaccacaagaaaaaaggtgactcctttcctgggctctctgtgctgagacactttttcctgcgcgtcgccctgcatcccattgttggcgttccgctcccgaagaagacagcaaagacaacgcgtcgaaccgaaggcgcctatcccacacgtcaacgcggctcttgccgcgtcatcgcttagcatagggaacggtccatgattcagaaatcaaaacgcgacaatagtgagaccgacgtcagtgcacgattctcgcactcacaagcgacaaaactactcacgggtttcctagcgactgaagatccgcagcgatgaaccccaaacaggaagacatacaaaagtgcagttgtccgctttacagccgagacacgaaatccagcaagagtgataccagagcacacactacagttccggatgttctagacagcgaaaagctgcagtctcactcggacgaagcacctgaactgtcttcctagctttggtcggattggcgggccgttgcctacgaccctagcagcaaaacacggttgaagcccacaaaaaactgtatgcaagacgtcaatggctacacacagatgaaactgtattggaaatggggaaggtttcacggtcgaaggaaagagtttgcgatgcgcatgcactcgtgactagaactggtagtgaggacgaggtgagataactggcttataaccctgggccgcaaaagagaaaacgggaagaaaggagcaaaaaagcaaaaggagacgacaacagtaggttgttaaaggatacatttcgttgttgagagactttcgatgcctcgtgttggtccacggaatgattcacgcatgcaatgcaacaagcccgctggatagcagagaaaaagcgagtggcttgtgcagctgcttcacaaggcggccagcaacgagaacgatgtgcaaatggcaggcgccaaaatacgtttttctcatgcagtaattagtgaacatacgtataaagctgaatgatcgagcgccatccttcttgttgcagaagaatcactcatctgacgggagatgcttggcaaccgcgcaatagcagtacaattgccggtggttggcggtgacatgttcggcgtcatcgaagaaccagacactcgtatccgtgtgaagttagtaaacacaaggagctacgtatagaggctgaaattagggggacaaaggggaagactcagtctttatctgtgcattcgaactcggcgccgtctgtgcaataccccttctacattggacaacctaggtaaccgccgaactcacaacgtccactgataaaaacagcatagagtcttccaagtgtccattgcgtcaaatatgccattggagaaagaaagcaaagcccacggtgaaccagctgggtgctgtgggtttggaacttcgtaataaccttgctgtattccgtctaacgacataaaactcgtgagatgcccacgagcaagttcttaccgacttctgtacacatccacaaggtcagcgcaatacacacggatgcaggcgatctttttagtttatgggcgatatgtgcaacgtgaaactcatgcgccgcttggtgacacgttctttaaaaaggcaccacggtcgtaggctagcgtggcgtaacactaccattgactgcagttattgttctcgcattcagtttcttgggtcaactctcatcgctgctaactaaatactttaagcgttcccttatagctgcaggatgatgcttgagaaattcgttgcgaacagtttgtacgtctctgaaacagccgcatcagcttgcttacgaaaataacagccaccacacatgtctcaagagggtccttctccttaagaacacgttcgtgccatcccacacggaccctgtttagtgaattcatcactcgctcgccattccactgtctgctgttttaggcaggatatgccacatgcaatgtcgaggaagatactggttcggtggcagcgcggttacttgccgcaacatatagctcaggggcccaattatatatggactcaagctttacgggatttgccgttcttttagagaacgacagacgcgaggtgccttccccgcgtcaattcaacggggtactctactgttcttacacagcgcaccggactgaaaagctcaccgaaacactaaaaccatgccacacttgcttgacgtctactctgcatctatgcagtgtttcatgcacagccaatgacgagtgctgaaagtgaagtggcattcgcaaagcggcgacttacgtgcctacagcgtcaagccaggtgacggatcgtatcgtacgtgactaacggtaaaagcattatgcgaaacagaactggtgccactactttaaacgtggtggaatacttccttctgagcgtctcgcgtaacgtcgttttgagaggatagacccattccgtaattgtgtcagagaaattcatgattccttactaaaccaataaaacagcacggttcaggcaaactaatccctcgcccgaacaacggaggtgacactgtttctgaggctgcagtgtcatccgttcagtacaaagcaggcggtgagcagatgagccagcaccacgctatatccgcttgggtaattatgtacactgtcgtacgatagacacaagacaagtagtcgcacaacactgtccgttgaaatggcagcacgttgtcgttacacaccctgataagttgactcttactacatagaaaatgaaaagagaggacgtcgtcaaacattgtgtggtcgcgttcggccacctcagtaagcatagttgaagccacagattcaactctaattttgggagtgtatcagatatccggccaaatacattaaatcgccacttacaagggcgaggtcagcagatgtcagccaaggatcggtgcgagcacaggtggtcaaaataaacaaatcaaacgacatttttacttcgctgtatacgaagctactggaagcgctaccacgattcactgggtgcaacagcttgatgacgaggcgtctctatctggatgtttatcaaacgagatgacccttgagttactcggcgtcagtcacagtgaacagccgaaaggatctcgacaggtgacacagtaagcggactgctcattaggaatattattgtttttcttgcgtcgaacaggaagtgctgaaccaactacgtagcccgacgtgtagaaggctgaacgcacaaccatcgtcagaggcgtgctgagtgctgtcgctaacgagtgtccttcaagttcggacggataccggaactggcgcaccgccactgcaatcgattcaccatcgcgtctcaaatagcagtagagacaggtgggaaggaatttcgttgctgtcaaatcaatcatgaaccccatattccttcccttcatttttttcccactgggtgtcctcagagggaaagttgttgcttcccgtgttccattagaatggtttagtgcctgtcgcgcaaccgcgaggcacgtgctggtcactagcggtctgagatgctgaacggcaggataccaccgggcagtcacgcggtttccttcgagtttgtgttttttggcgttgatggactttgtgtctctgtctctcattaagcagcgtatctaagctttgtcaaaggtgtgtagtcgtcctcgtcacggttgcggaatgcctctgaaaggctgtagtgaaactgcgcctggcgctagagacgcagtttcgatttccggtcgatcagttttccggttgctttacccagcaggttttctttggattccgtaggaattgcgtacagcctcattacgtaatcaccacaggtacggcagtttgttactgtctgcagaggagagttactacgcctgtccgcgatctgcgaaatcagacaccgaggagcgttcgtcgtttgatcgccttacgctttatggaactgtgttactgcttgccgatctatggtgtgtttttgtcgctaatacgtcacatacagcgtttcgcgctacagcagggaccacgaggctttcggcctctacagagctggcttttccgttttcactgaactgctcgttgcacccgaggcagtctttcttagtattcgactcttgccatagttgccgtgatgttttgattggtacggatgtccgcgcgaagtgtgttgctgattcctatacgggaaaactctaatatcggtttcgtgtttttagtagtagagcattaggttgtcaggtggtattctttgcgcattgtgccgcaggtttttagggaactgtgcttagcggagaatatctcgggaagtcgtcgtgcaggcttgctaacatctgattgggtctca

SEQ ID NO: 3697 - DNA, 2104 bp, Toxoplasma gondii
agagaagcagagggaggtggaagcagaaacgaggtctctaaaaagggaacgacggaggtgaacttgcagcagatctttccgagacaaacacaggagacggaaagagacaggatcctttcacggtaaaaaacataaaagagaagaagaccttcctccgacgagaccgcgatttgacacgctccgccttgctctccctctgcgcgttgaaaagaggcctccattcgctctgaggaccggcagttgtctctcgatgaacgtggaagcagccgacaaccccaatgcctgagagtctttgagtggcgactcaggtcttctggactccttgcgtcctgtagttttctcactaaaagaagatctgctattggtcgcataagattagctttgcttgtgcgactgcgccaacaaagaggtccggcctccgttgcaacgctcgagaagactcgcggcagcttgcgtttcttctctgaaagagggagaaagagctctccacgagaatggtcgtcgacgcacctgtgtactgaaagagagtggggaccgtggtagctttcgcatctcctgcgtcactctggacttgcgcctgagccgttgaaaagctgcgcgttttgtctgctcctccacggaccgcggagcgagccgagagcgccagtggctgcgagaagagcggcacagagctcgcacacgaagagagagaggagacagaggaaacgggagagacacgaagaggcaggtatctgttgcggaggagagttgaagaggcagctgtccgcgcgcagacgagcagcggggcaacaggcttcatgttgaagaggaaggcttcactcccgaaggcgggagaggagagcgttgaggagagacgtgaagtcaaagacgttgtcatcttgtctctaaagacgaaacgtgaaaaggatcgcaggtgcagtgctcgagggtcgacttcgagtctttgttgccaaagagccggagagagacaggggagagaatgcggcgacaggaaacaacaaggaacctgtgggaaacaagtgcaaggagaactcaacttgcgtctgcggagacagtgagaagcgccagcgaaacgctcttggacctgccacaaagtgccgcggactcgccaaaagaagaactgcatgcaggtggacccaccgctcgctcagctgtacgtacacccgagagcggtgtcggaaattcgcttcttccgccgacttgtctcttctcaggctttctttgacggcgccacagacaccggggaagaacgcgtcaccacgcggcagccactgcgactggctcccgttcctctcgcagcttttggaagtcgacgcacaaaggcaacaacgcgctcgccgttcaacctgcaaggaacgcgcaaaagcgtttaacatctcgcgcctccgggcacagactcaaagcgccgcacaccgcccagcacagaagagttcgagagttctatcgagagaagatagcagaaaagtgaaggatagaagggaggaaacgaagaaaagagcgttctacttcagaaaggaaagttcataaaaaactgggtcgcccgcgtctccgcgccgtcacacgcgtccctcggcgcttgacacactcgagcttttttacacacaaaagctcgcctcaagtttttcgccaaaaactccacttcgtttcagccgcttttcgcgttttctcgtgagcgacaaggaactctttcacggctctcccgccgttccttgattgcgggtcacctcagttggctcgttccccttccgttctcttgtctttgctcgctcttctttttgtgtacacgtgtgtgctcttcttgatctccgtctcgctctctttcctgctctctttctcccgcccccttcccttctctctccttgttcgctgtttcctcgatttcctcactcgggccttgttcgcattcctccgagactccggcagtggctatgcctgtctctctcctcgaggactgtctccagtttcctctcgccgtcttccgtgaagtagaacgcgcaacatccgccggtcttgttctctctctttctgcgtctgccaaggaagagactcagcagcgagtcgcttcgtcgccctcgtgcaatccacggcgcatgtggggtgccga

SEQ ID NO: 3698 - DNA, 1476 bp, Toxoplasma gondii
tgacttggagtatgattcttgaatatgaggacacagttccctgggtatccgaccccgtgctctgtcctaggaactgaaactatcaaactcactgttcaaccctgcagtatttgactcggttaataaggttttggctggatcctctgcaccgaccgatctcaaatcgcactgtctgtcgtttatgtaattttagtcgtgcttgtcaaagttccttgtatctgttcagctcactgcctacttgggatcagaccaaaaatatccactaatggtaaagattgcagaaaaaaagaacggagcgaattggcagtgcgagccagttgtcacatcaagactgatgattcatcgagctagtcccgcaacacaaagtatatcttcgctcccttcccagcgcacagacactacaacctccgtggctgtttctcacacctatcaaccacagcttgtactctgaagccggtagccgtcgtcggctactcgtgttgatgctgttcttcatgacatttattcggtcatttatccaaatacttctgtattcatgtatttccaataacacgagccagttcagtgattcggcgacgcgatttctctgaggtcccgaaaatcctggaactgttctgctctaacacagacttcgtgaactcgaacagagcaaaggacgtcgcgaatcacccagaaagtcgatggacaaaataagaaatgcactgcttgctgaggaccctggcgggaccacttggcacgagatgcctagctttttcaagttcttgaatgttttgaacgggcagcgaacagtgctggccactgttttgagcctgggccaacgtcgagtttgtgaagttcacgggaagcttgagtcgtctgtgatatcaacttatttccatttgagcagtcttgctccttttttgaagtcatgaaagagaacgaggggaagacccaccggatcaatctgtaaggagagagtgcaagatcactttgtctgcagtattgacctgcgagacaaggaaagatacttgttctggctagctgagctggtaggcatggggaacaaacgcatctgctgcccttctcctggtgcatgcttattccctcgtttttgagttagtaacagatggtccaagaggtcgatttttttccaacgaaacgcggtaccaagccagttcgtaaggccagctcgacgggcgacgctgcagaggcactttacaaaactttaggtgtacatcgatattcacgtcagcaagggctgttgtattctttgccattttccccatcccattgccggcttttcctggtgcattcgtaagtgaactgtactctgacactttttgtgattgggaccgcgaaataggtcgagcgccggctcttcatacagcttcgaggctgctgcccctcccttcactatagtttgccgtgcagcggcaagagtctcacggtgagaatcgccagaaaaaacaaaagggtggcaatgtggcttcggcagga

SEQ ID NO: 3699 - DNA, 2634 bp, Toxoplasma gondii
tggagaaggatggcacattttgggcttggaggaagggatactgtttttttatgttgatagtgttccgtagtagtagtgttgttgtcgcattagatgtatgttggatgcaagcatgcgtcccgcgtgctccttcgttcggcggattcccttttgagagaagtgtctggatgaaatgtatgaaacccgttaaggggggttgaagggtcgcgggcagaagtcctttctaataattaagaagactcggtacttctgtggcaagctacggatcattcggatgggagaacgagtgacgtgacgtatattcctcgcggagtcatcgttttgttagcgacaatggatgagtttctgccagaaacagcacagttctccgtttacgcctctaccgttgcaggaggcgtttttttgtttgcatgagaatcacgtagaagggtgtttcgtgtcaggaaccaacagtgttcctatgtcctcatcttgagttgtttccgagcgcatgcattacttctggcaggaacgctttcatttgacgcatgcgcagtaactagggacacgacgccatcagtgaaattgttcatgctcatcagtgcgctgacggaagttttcttcgcgacttccctttgagattccttgtaaatcacttgtcgtccccgcgctatactgcgtgcgaaagttgctgcccactcgtagagcattcgagccaaaccgggtacctcattttgcttctttaccagttcctctgtgaagcaatgaaacatgctccggaagcaatacttttctcagacttcggtcgccaacctacattaacgagtcttcacacagcagcttgcgagatcgctgtatgcagcgtgtctgtaagatttcctttagtcatgccgcaacggtgatcattcggaacttaatgatcagctgctggctattctagtggcagggattcaggacagcaaacgcggcattgcagattgccttgctcatcttaaattatcctgtttcgtggcctgatccgtctgcacggaagctggcagttcgctgtggaggcgagaatcgaatcctcccgtgtgtttccttcccttgcactcgtgattcttcttggctgttcgacgtacgatatcagtatagggtgtactgacgattagacacatgcactatcccctatctccctagtggaaattgaagaagggtactgccgtgtggttcgtgtagatttcacttctagacccggtctctctaaccttagatcctgggtgccaccactgtcagttgtagcgtgacggtgggagcttcggttgccgaaaatgtgcaagggctgcctattcctctaagccttgttcgtctgcttctccgtaccagcagacagacttggctgtgcgtgacgaaaacaatcagacatacgatttacaccgactactactcagctttgtctgtggtagagttccatctgctcgtctgactcgcttcgaaagtagccaccgaccgttgctgttgtcagggtgacgaagcatctacgttcatgagtttaacactgctcagtgttattgtgacgtttggaaagaaccatagatcggttcagttccatccgccagtggtgctagagtggaagcgcgttgagtccagggactgccctacgagcagtccgcctacggccagtataccgtcatcggcacacattcccgacattttcaccgcgtgtgtgaaagagacactgtcgtgagtatgaggtgcctcaggttttagaagtttcaaactaacttcaaataggcaagggtgaattgagcacgtcgggcgtgtctgatagaaatgatgagacatacgcgccacgctgtctccgagtcagcttcagcgcctgcctcgtcaccctcgtccccggccgcagccgttgaaaagacgggggagattgagtgtgacggaacaacggtccaaagcgggatgtctgccaagtcttttgaacactttcacgatgttgcctctgtgctatggtcatcggaaatcgcgtttgcagagaggcgctgtgttgccgggtcaggaaccagttgatgagccggtagagctcgcggcgacgcgagagacatgccagttggccattaccgttttcaacgatacgcgctcccaatgagtctcgcaatttcctggcgtagctttcttgagatgtctttctcaaagctctcagagtcgacactaaaaataaaagacacaaatactctcaattttcctcgagaaggcagtcaattggacatcggcgacccctttggcagttcgggcgcttgcttttccgtactcgccttctatactcccgctgccgcagcgcccgatcgttgttcgtggaggacctttcgtattttccattctggctaggtacaaaacagatttttgtttctgtgctgttttgagaggggaaacgtgctgcggctgccttcttccgtagtaggagactggtgcctccctgctagccctgagaaaacggggggcgccttggcgtccgctactggagcgggtccgcttagcattcgtctgcagtgcatgctcgagaaccgttgctctttagcataataattttttttatcccacggtcagtatctagaccaggctccactggcagcagctagtgtctcttcaatgcgcacccgaactttttttccagga

SEQ ID NO: 3700 - DNA, 3024 bp, Toxoplasma gondii
ctcagaaggcgcctcccgaatcccagagacatcttggcttctcgtggactcgcgcgaggcgccagagtcgagttgtctcctcgaacggatgcaggcagcgttccgcggacttcgcagacccaggagacaacgaggcctgggctcagagaggagacacccgatgaagcgaacagagactgcacaggagacgccaaagaagggagacagaggacgagagcagagacagaagcagcgcaaacagaagagagcgacgccggagagagagaagagggagacgcaagagaaggagaggaggaagaggaagagccgaggagggaagcagaggcagaaaagagaagaaactgaacgaggagtgagaggagtcgaagcagttgcctcatctgagattttttttcaagacactactaacacaacgctttacgtctgcgaaagtgtggacagttacttctgttcgagaaatcgcagttcagaaagttgacagaacttcattcgcattcaggcctttccttttccaccggacttttcgcagaaggacgcgcggctcgtctttcttcaagtctgctcctctgacgctcttcaaaaagacatcatcttcctgtcccagcatttcactcgcttatacagttcgaggtcgacgagaaccacgggcgtttctgtgagaagaagaaagatgcgagtctgcagatttcctctcctccagaagactcacttctgcatatcgatggattcgttttcatgaatgccaacgttattgcttcggattacagatcgaccgatttccagcgacctacacatgcatagtttttaggaagaagtcggcggccttctcaacgagcggatctccctacgttttacggagagaaaaaagacttccaccaccttggagagagaaggctcttttttccggtgctcggaaacgacccaggagacgagacacggccggtgaggacagagcacactgagcagcgggaaggcgcagagaaccaatgactgaagagaagggagaagaggcaaaagcctccgagagagacagaaacagaggagaagacaaaagggaggagaaagagggagagaaagacagacacccgccaagagagaaagagagagagatggagagacaggcgaacggggagaaaggaagagaaaggacggtatgagagaggagcgccgaactcgcagagcaggtgtgggccgagaagaaggagagagagactttacagtatgcacatccgccagtcttccttctccacgaaaatccgttctcttcgttcttgtttctcctcgcttttttcttcttttctcttcttccgtataccacagggggaaagctcgagaaagcgccggcgctcctgttctcgtcgggacgcttgtctctctcccaaggcgcgtttttcggagctctggaggcaacagctcgcagagcgagagcagagacactcgcatcgagcgcatggaaaagcgaaagattcgttttgttactcgcgtcctcttcaaagtgagtttcttcgcctctccacctgcactactccctctccgtctctcgcgtgtgcacagagttgctgtcagagggggggcgtttgacggagggatcggacaagcgaaggccgattttcgtcttcttctccgtggaaacatgactttaactggctcccaatccgcctttctcccgctccttcgagagaggaagacaacgcgagagcgaaggagaaaaaagaggaagcaactccgtcgcagggccgtctcgacttctctccgcccaccagaggagggccagagggcaaggaagacacagcgcagtcggaggcgtcgccgcgcggagacactcgccagccgaagagtaaaaaaaacgaaggagaggagaaagaagaaagagaagaagagagaagaagagagaagaagaaagaagaagaaagaaagagaggaagaacgggagatgtttcctcgctcccggcgcgggagagaggcgcctcaggagacatcgagccgggaacgagagcaggcctcgtctctgcgtggaggagacagagacggagcggggggtgggggcgtcgctgccgcagccgaaaaggctcggcaaaagaattcaggaacgaaaagagacaaacgcatagggcagaagaaggccgttcagcaggaaaatcgaacggaaggagaaggagataggaaacctctagtaccagcgcggaactcccgcgtgtatatcatggtctctcgacaagacatcgctgaaagagagagagagcgagcggctttccacgcaaagtttgcggagagcttgactcggagaaaagcgaaaaatccgaaaggagttgcggtcgcgctcgagaggaagaaatggagaggaaaggaaacaaagttgtgtcgaaaacgaggggaaagcgagaaactgtcattgttcggaggcgattctataaccggagtcggcaaagacagccgcgaccagcaacgcgcacaacatgacgaaaaggagaatattggcagaagagaccgaagaaaaaaaagccacagaaaaatgaattcaattcgcttcaattttctctcgcataacgacattaaatttcgttaagcaaaaacgatcgcggcattttcacccgtttctcccgaagtttcctgtttcccctcctgcctccttcctgggtacctttgggtctccccgtcgctccattgcatcctgttttttcctcgattttcgacagaactgcttcctcctttctgtctcggacttgtcctcagctcggcgtctccgccggcatcttgttctttttcctcgcgactcccccgaaattttcctagggaggtccaaacaacaaacagttcttcttcttctccttcctcctcttcttcctcttcctcctcctcttcttcctcttcttcctcttcttcctcttcttcttcctcttcttctccttcttctctcttctctcttctctctgttcttcttcttctccttcttctccttctctcttctctctgttcgtttgttcttttgtttgcgcctcctttgcacctttcgcctcccttcga

SEQ ID NO: 3701 - DNA, 2972 bp, Toxoplasma gondii
aaggagacgaagaaacgaaggaagccaacgctgaagacgaatttgggctcaaatgcagacgagccgagcagaaagggggagaagcaggcgagagagaggtgagcagagacgaagagtcaggagaagatgcggatgaggcgcgcgggagagaagacgccgttctcgaccctttctctccggaattccagaaaagaaacttctcatcggctacgaagagagaggctttaggacgagacacacacgaacggcgagacgccatacccgagggagaagaaaagaacaaaggactcgacgaggccttgaaagcggagaaacacctcgaggccggagagcgaaaaggggagagagaaagcaaatgtggggacgcatccgcactggtggggtccgaacgatagaaacaaggagagacagaagtaggaagggaggactcgacgccggagagagagaaataacagacggaagaggatgcgagcccgttggagggagaagagtgcgaaggacgggccgaggaagtagaggtccaaatacagcgtggaacgatctgtccatcgtagtgtctttgcattccaactctcgggtatgcttcacccgccactggaaaaaagccatcagaagtaagcggctcttcccgtctacacccttttgcgtctgggagttctgagacgagtctctgagttctctgtgaacgtttacggaggcgagagttgaaggaaatcttccttgtctcgacagacgcggctcgagggaaacacaaggccgccttccgcagccggacgacaccggccgtccccgccatctggggcaccggagacggggagggaaggcgggggaggaggaaggagcagggaggccgcaaaagtcgtagagatgcacgacgggcgaagaaagaggaaaagagaggaaggacgaaacacagaggacagggggggggggaagacagcgacgggggagaccggggaggcgcagaaggaccgcgagccacaagtggaatctggtcgacgcgagtttttaggcaagggacaaggacgctctgtgggagacgacgcaggatcaatgcgagaaagagaccaacggagagaaagaagaaggacggagaagcggagacaccacggaggcggaggagacagcgaatggtaacgtgcagcacatcttcttctacggactcaaatccccagggaaaccgcgaggagcgacggcagaggcttttcccgtagacagaatatcgaggagaataagcaagtgtcggaaatgtctgagaagccaacaggagaaattcgcgagaaaaaacggaataccgggcgtttttgagtgtatcggcgaagagccctccacgcgcgcgcgaattcgcgtgctgcagccccgaacaaccggcgtcgttcacagcgctctccagcccccccgttcttctcgtttctcgttgctactacgtctcatttttctcttcaaagaagaaagatgccaccttgcgcagtttcttcacaacaagggaaagatgagaggaaaagacgcggcaaaacttcgacgaccccaagatttacgcgctagggaggaagcaaattttgactagctttgtcttgctacggcgggaccggcgcgaacgccgtggagaccggtgaaaggctgtaccgttccttatgtagtctctatgaagaaggagggttatctgcgacatttttttatcttcgtgccgacaagaggcagaagacgcaggcaaattaactagaagcctgtcgagaggacggctctctttttcgcgcgcggccattcgctatataggtcgaaacggggattcttttcccctctcccagggggtgcgttctctgccacggcgctctcttctcaagatctgtacgctgagaaaccgagacaaattagccgggcactgccacctaacgcgttttccgcaagtgtccatcagtttgcggacgagaagtcttttctgccggcgcggcgtctctcggggcttttcaagagtctggagtgcctcagaagcgactcgttttcgcaagagagccttttttcttttcttgcacatgccccggcgaaagcctcgacccgcccgccgccactctttccgtccacacgcctcggtttccggcacatagccgagtcataacggagattctgacttgcaaggaaaagaaggaggaagaaaacgtgttctgtggactgccgcgggggtggtcaaattctcgcgtccccgtgccggcttactgcgaaactctccaggtacacatctgcggtgtttgttcgaggagggcgaagaaagcgggtgcacgggactctcgctgtagcgcgaaccgtggactgtggagcagcggctaaagtgtgcctaatctgtttttcctggtggaaaggcgtgtttctccagcttgcctttacgcctgcgaacgcgaggctttgtgcagggcgacaaacaccccgaaacaacacccggagtgtggctttagtacctgctcacgctgtgctgtggcgtgctggtcacctgtctgtttcggcaggcaggttagtgtggcatttagcgcaggtgaactgcgacaaaagtggaaaaagctggcgtttctcggtctctcgtggctgcacaagtcgccagctcgatttttgagctgcggaagaaaactgccgttcccagatccagaggagggagcaggttgtcacgagaaaggtggagctttttttgtggcaagaggcacgagacgcaaagacgggagttctactctcttcgtcttctttcttcttcttttttccttaacaacgtatccgtcgttttccactctccacttccggtgtccgttgcccgttcgcgcgccaccgctctcttccccgtctcggatgctgtctcggcaccgtctgcacgttgattctccgctcgtttctccgtaaacgttcagtttctcgtacgtttttctcagtcccgcgaaaattttgcgcactgacaggtccgtaaacaaggacagcgctctgtcccgcaa

SEQ ID NO: 3702 - DNA, 1645 bp, Toxoplasma gondii
gacatcacgaggttgcttacagcagctgtggaacatctgccttgcagcatgtggccgtcgcatcatggtcagtcccggtgttctttgagatacacaaagggtctcgcacggggaaacaagtcaacgcgtgagtagtagtatgtttctacagcgttaatgcctgttccccaacagatcggttagcatacaattgtaatgcagggatgggctggcgatacgatatgtggcaacagcatacagtggcctcacgacgacagccaatcgtagcccggttaaagtaccccaattccaagttgattcgtttggtccacatcccacaattaatgcggttgaatatgcactattttcagacagtttctcaatgcgatgtcgcctgctagcgacgtcggtgagaagcggaagtgttgaggttttcagggctgggtaaaacgagtacaggaaagctggaggtcgaggccacagtgggaccaagaccagctttgggctatcgtatgtgtcttctcattcaattgctagttttcccgctggaatttgaaaaacacacgcattcagcatgacagttgtccctcagttccacactcacttcgaaacacacatcgatcttacgtagcagtcctcagtattccgcagcaacataacaataccagatatgttatctgaccatgggtggtgccagcattatagaaacggcaagactgtgcggtgtaacgtggctatgtgaagtaatagagagacgccacacacatcattacgccacgcggtctttcatcggccctactgcagaccatgtagggaattaagaaaatgagatctaacagacgcctttaactcggaaactctgttgctccggtgtccaagagcagctatcttatgaggtcggggacatttctttgcaaatctggtctgccacgatgccagatgccagtaaacgcgtatggtcaacagccatatcccctcgtcccaattcttggaggctgccgcgtacgaaatttaagacactgctaagagtcaagcgatgcagagtacgcatctatatcggtgtaagacctacaatgggtttcacgctttgaaaaacctcatttcttcacttattttgagtagcgttcgtctctgtagacgatcccgaggattctttttcccagcgtgttgcaccacaggggacctgcatgcaaccatcccgtccattccttgcatgcagacttggccaccgcactctgaatgatcctcggacgttgcactttcagatagataacggcgtacccagatcatttggtcgctgaaactgaaacatgagtgaccagaaaacatttgctggtgctttgtgttggatctacttgaaatgtagcggaccgcaggtgccagcaaactaccggccagacacagcttacaacggtgtttcaccagtttacaggccataaggcgacaacctgttacctatacggggttcatgccttgaatcagttgatctgtcaccattcagaagggctgattttgtttcgtttatggtcttcagtcctcgtacgtgcagctcagcgctagaaagcgaggctgttgtggcggcatgcgtattccgaggcctacggttcgtgagtgaacatcttacaggtgcgtgaaagataggatcaaattccatatttatgctcaa

SEQ ID NO: 3703 - DNA, 4430 bp, Toxoplasma gondii
ttcgcataacttgcccacccgtccactcccgctccttggaagttcagcgtcacgagcgcatgggtcggtgagacgcgtttctccacgcacggacggtcagtgtatgttgtcggagggccgcctctgtggagaacgagaaaaacgtaccgatagggtagaggagagactggatagcaagacgagtcacgacggtcgacgtcagacgtttcgcaaagcggcttcggggcacgagagcgtcggcagctcggcaagcggccgtccacgcacggcgtctcagacaacacagggaatttcctgaaaaagaaggacacacccactcaacagccgcaggagcaatttgaccactcgcaacatgcttcccattcgcgcgtctctctgcccagggaaaaacggcgtagcagtccgccagcagctagtgtcggcacttgcgccttaggactgaggcgttcatgatgccttccggtgaacaaactccgctggcgcccgcgtttcattccaagcgttcatctagaaaagtcctcgcaagaaaatggcccttccaaaacgagttctttcgagtaactggccacgccttcacacctgccgcgctactatcgactgttcgtgcagacgaaagtcctaacgtgctggtgtctgtatcgaacagagaagcgaacggggaacggtcgctgtcgcccacctgcttcttgaatacgcttcacaacggagttctctgtagcttgcaccgcttggacgtcatgctcgcgagcggtttctgtcgcaggctctccgtcgctggagtcgaactgcaagtgcaaggcacaagacgacgttcagacccatgttgtgcggacagacacagaggagactttgtcagtggcattctaccagaaaatgaacatcacactacagtcaacacgcgctgcttcttcagatcatttctacgccggatgcagcccgctactccggagttgcgtgaggcaacatccgcaaacaccaacgtcaattgttgtgatttctagctgcttcccgccaccttctgatggctccacgcgcccctttcgcctgcacgctcccaccgcatgctgcaaacgagggcctgaagcaagctccctagttcttccagctcatcttctgtctacggcggatcttccgattcgattggcaagcttctgtgcgctcgttgaaggaatcagaatgagagaggacgactcactgaattcgaagcgagagttccgtcttcatctggagaacattcgacgtcctccctgaggcccagtttcagggacagcagcaatcgctgaggccaccatcctcgggtcgccgaggccaggggtgacgtgatacctcgcgtgtctggtgtttggccgccgtcgtggtcggcctcccccgaagtcccgcgcgttttccgtcgaagtgatgacgacagatgcgaacttgagagcgggattgccgaggcgagggcgtttggcttcgcgggcagaggcactgtgcgaactagaggttgggctcccgtctgcaacgcgagtgcaggcaggagtggcggagcaaacctcccggtggcaacatcgtgtgtggagatgcagacgaaggagtacaccgtggaaaagacaaagaggagaaagacgatccagaacaagggccggcgtcggtcggagaggcaagcagaaaacttgaagagggataagttttgagacattggagcgacgggtgaaagcgacttgcggcaggcagtcgcaggcgcacgggccctaggggttcggggcaggactaggtcaccggagtgcgttctagacgcacaggagacacagagaggcggatggtgacccacagatctgcctctagcgacttgtagttcatcacatttcattgtgtaagtgagtgagcagcaatccgcagaaaaagggtcccggcggcgctgtctcgaagacctagaggtccggagattggccgtccgcacttcaattgaggtccacagcagtgcagcgtcctcttccgagttcaatttttcagcaagggtgcattcaactcaactgtgtggagtttcctcacaaacgtttccggtacacagtccgacaacctcggtcgcagctttgaaagtgtagagacacacgggcaacgttaacgagcacaccgtctgcgcttcgggatacatgaagacacccgtaacagctccttttgctgcaggtgccccacacacctggaacttctcactcaacggaaaacgtccaaggaaaggttgagatgtttgacacacaaaaactgtctctagggacgcggagaaaatcctgtctctctcgaagggtcgtctgtcgcgcatgcgcggtggacggtgttctcgcggtccaacctcacaatgcagacacagagccgtgactggtgtccctttctaccaacttgcccgcaaggaacccatgagaagcactcactgtggattctctaatatattcacgctgaagtggaacaattcaccggccatcttcaggaaaccaagggaaagagcctcccgctgttttgccggcgcactcgtgccacgcctggagacgagactggtcagcaacaagtgtcttccctgcgttgaggcgagggacccaagcatcgcaactccacggctttgaagaacgtaactggacgggtattatcggcaaaaagaaaggcagaaagtaaacagcgaggcgaacagacggattgtccgtcttccctctgcatgtaacacggtactggcgaaaacgatgaagccgcggtcggaaaaagccactagaattctttatcggaatccaaactgtgtgttgtgctaacctatcccatcacagggaagtcgcggtgaactggatctgcaggttgcatgacgactagatgatgtactgaatggtgcctgcacgtttttagcatagttgggttccaacaagccaccgcgtgagtgtaggtattgcacagaatacagccaaagacgaattccatttcgcctcggagtttgcagaagcggcacaacgtcaggtgtctgtctgcaggcgctggctaaggatagacgtcatgccttttgtggggatggacctgtggctccagaacaagataactgcagatttgggtgaggaccgtgtacagcggcgtgtgccgacgcccactacgcattgtacataaatggattccgtaaataagtgggttttccactgaccctcgaagagctaaacagttgcgcgcacgatgcacgagatacgtcacccgtgctcattttaaatctcgcctcaaggcttccagcatcgagatggctgacccagtcgaaatgtgtttgcaaaggtgacgaaacctcttccgcataaacctacagaaaatttgccgctaaaaaattgtgcctagtctatgacaacgggtacacaggaagtcgagtcatgtccatccctgcgctgtgcgcctcttgcctgctgggtttgtctactttttgatgtcccacgcagacaagagttattactacgatgtctacttgccgctagccatcgtctagatcctgaaagatacatgctttatgcagaatgatcttttaaaactaagagttaaatcgcctcgaagcgttgcaccgctctatcttttcctttaaaattcccccaagtagtagcaatctacaccgtgggttgaaaaagacgcacaccagtttccacggttgtgcgacgcacaatccgacgctggatggtatgtgacagttattgttttgtcttggaaataattgtgtggcagagtgtttcagtcagaggagatcctgccctcattctccggacagacacggctttccgccctcgcctcacgagcttacacgctcggatttattactgcgcgtctccgtcgctctggaggccgtgtctttccttccttgttagcatcggggttttcttcacgtcaatcccagtcgcccacctgtttgctgtcaggtctcccgtttcaagtttgtttattcgtttatctctgtggtatattccaggtgttctggcattgtccgcttcttcgctgtcgctaccatgccttaaaacaaagatggtcagatgatagacaagggaaaaaggaacgagaggcagccattggtcctccagtggtaacatggtttctttatctcctgcattcatcgcatattgcgtgccccttcaccggctgaaatcacaagagtctataattcatgttgccgattttcccttcttccgtgtgtttcatctccagctcggcaaagctgcaggaactgggcaaaagcccttcattgtgggctgttcgtgcagggtatcctgcagcagaaacggcttctctcgatcgcggtcacatgtcagccgccaccagtgtaaccagagttcgtcatatttatcttgtttcgagtacatgacgtacttgacagactaagacaggggcagatctggattgttcgaggaaaaaggaatggacagaaaacgtcgaacgcttacggatttcta

SEQ ID NO: 3704 - DNA, 1821 bp, Toxoplasma gondii
gcatggttacaatcccgtggaacagttcttttggttcaagttttctgtgcgtcgttccgacagattttccccccaaaaccacaagtataatccccttgtggtaaaggaagtacttgctttccagtctacacaacacaattgccggcctctagcatcctatgacagtctgcgacgtttgttaatccatgctcagggaagccctcgctaagcagcggctcgcgtcgaaaaccacgccgactttgatgtacctgtgtacagacaactagcggaaagcgaaattccaatgccagtggaccccggatagcgcttttgctgtctcagaaagcctttttgatttgagaacataccccagaaactcatttgtccccttggtagtccatatccaaggaaggcaataattcgatgaaatgtagatacaataattgtaaatggcgattaatctacagaagcgtcgaggactctccgttcataccaggcgtaaaaaacgtccatccagttactaaacaggtgtcaggccaacaagaatctggtccatgtattccgtacagactaacattaggaaggagactaccacagtgaattttaggttttccaagaaatatatttggaaaaagagacttgctagtattaccgtaattacataatatacagtcccagccgttccggttaagctatagaagagtcaataaaagagttagacagtcgaaaggcatagaaagcatcaaattcactgactggtagtaaaaaattgacttgtgtagctatttcgcagactgtttcaacgatatgaataaatagacgttctctgcaagcactacgccatccagtgtaacctcagtttgtccaccatcatgcaatatatatgtatatatatatatatatatatacatatatattgcggatggttcgcgatcaaagcccacatagggttacgtatcatacctgaaccgttgaagacgagttaccgaagtggtcatggcatgacaacggagacttgtcgaatctcctctcgcagtcgattttctcgtcgattcataatctttatacagaactcgcacaccacgacgctagaaaccacgcgaacggaaagggaactcggctgctggttttgcagcgttcatttggcccctccccgcagtatgaactatgcagccagccttttccctacgcatcgtcacaaacgcttccccgacagcttctgtcttgcaaaagaatacactgaaagcgctttgctggctgtaagagaggaaacaaaaccgtgtctgaatgccgcctcagagtcaagaccggttcgttcgctgacgtcaccgcgcatgcagcgcgattttttcgcacacttttcagcccagcagccccagacagcatttgcagcggcgcgtactttcgtacatttttcgagcggccctttgctcaaggaatgttaatgtccatcgagttctatcatcaatgctatgactgtttggacatgtttgcggtacacgagcagctatacgctgggaggctttgcaggcgagccgtcagaccccaccacggggtaaagaaatcgccatcgccatatcgtgtaattgcgtctttctccgagttttctgacgccctgctttctgaggtatttgttccggtttccgtggtgtgtagttaatcgctgtgctctgtttctgtgcttgacccatcggccgcgccaaaatggccggtgcaaggacccagctctcgcgtagaggtgggtctgcgttctttactgtttgccgtctgtgagtccttgagaagagcaaatcacctgatttttccgcttgcgtcgtctcttctacttgcttctcgccacca

SEQ ID NO: 3705 - DNA, 2527 bp, Toxoplasma gondii
ccccaaagtgtcttgctcagagaatacacaggcatgcgtccacagtctagcccagtccaggggcatctgagaaagctgaaccatggcttggtcttccttctggggctccgtcgtcccttggccggctttgcctcccccagactccgtccagcgctctgtctccagcaggcgcgagcctcccagggcctcgggacccccggcgaaagcctgctcagaccccaggggccttttgtctcgccccgcttcttcgccctcgccccggggtgcgccaccgcgctggtctctcgggagatacaaatcgacataaagctgcgaaacggctgcagcctgcggcgcaagcgtcctctggaaagagtgcagagtcgaggtgcgaatactgttgaagaatggatcgtagacgcaggtcgccagttggtagtttggaaagacgaggagcagcgagcagcacgcatcggctcctggaacgaacgagccgggggcggggccagaggcaaacggagagagagaagaagcggaaccaaggcatgtgtggcgcgcagctggcgcggggggtcgtccagcctcgccggcaggaaacgcagaagacgagcccgcaggcgacgggagacatggcgaagggccggggaacgcatgcgagaacagaggcgggcagacagaagcggagaaggggagaaacggtgagaagggcgctgaacccaaaaatgcatttccgccaactgaacgcgcttgggagcctttggaagcggccgaggcgcctggaatcaccgaaacagctaggggcactgccgctaggggcgtcgagcaccgcaaagacagaacgggggtggggacggccttctcgaagtccggagcgttctctccagagaccgaagcacactgaggaagaagagatccaccagagtaacctcctccggccgcggctgagggctcgcgaggctccgcgtctgaggcctccaccggcgggaaggtcacatcgtagacatcgagagaagaaggccgtgcgacaacgagactcggaagggcagagacaaacggacagagcagaagatgttcaacacggtctgccttccgcagctcgtcgaacaagccgaagaggcgcgacggagcatgcgccatggtgtgtcggaaaggtcagaagcagagaaaagctgacaggaaaggtggagtcgggagactccgaggttccagcagcgtcctcagttcggggccaagcgatttcttacattctctgacctctggatgaggagaacaagaagcgagaaagggcgctcagtgggtctgccgagacagctggcgacagcatagtcaccagcgaaaaagacctacgggcggagcaccgatccagaaaacgaccaagtcacggagggaaaggcagaggaaaagaactgaagctttgtcagagtaagacggaatccaagacggaatctggagagaacaaaagcgtttctcaacaggacacaaaattcggggtcggctggtcctccgactccagtgttgtctgggcaggaggccaaggaccatgctaaaaggaaaacacgaggaaacaggccatgtcaaaggtttctcgtctttttcttggcgatctgaagagcgtcatctattttaccaacatgcctccgcacaaaaattcaggtctgtcacgggcccttggcgcattttccttcacgcagaatcaagaaatagggaaaggaacaagaaccgaagaatcttaaagaacccccttcgcctttttcgtctgctccgtcaaagtggaacttgttcgatggcatttccgctcgaaaccaagccttgatggctgcatgctctctgttatttctctcttgctgtcgtgtgcatgcggtcgaaactgcagccctgggaaacaacgtaaacaaaatgtctgttgagtttcaaggcgctgtaacctaatcttttgtgctgcaagtgaatcaaacaagttgcaccgttatcgacatctcgttggcatgcggatgacactaatactaagtgaccgccgccttttgctgaaattgcctttaacaccgcacaagacgctggaaaatgtgtgtacttgtacagagcagacaggtacagatgtctctgaggtatttcgaatgtatccatgaccaagaactgctcgaaagacacgtcgtaccgtttaaccaggaacctgagatgacggctgcgctctgattccacctgaatctagaatcacagagggggaagtgccggtgaatttcgcgttttagtgtcgttggtatatttaacgcgccacggtctctctcgcggaaagttgaaaggatgaaggtagatgtgaaccttaaccttaacacagagggtcgatttttcagtcggcccagaaaagcaacgcagaataacggtgggagggaagggggcatctccattcatcagaacggcctggaaaagccaggcgtcattaaagaatgaactaagaagaagatctgctgtattgtgaggagcgaatggagggaaaaagaagagaagaggctacagagaagggcggcgaagccaactggtggttagtaca

SEQ ID NO: 3706 - DNA, 1932 bp, Toxoplasma gondii
tcaactctcgtgcacttcttgagtggaattcagctaaagttttctcgaactctagttttcgctagaggcctgagttgacacatgtcagccccgggtggtagctcgctgcctatacgcagacggttgacagtgcttctctcgattttcgccctaagtgtacggattacaatggatctattcgaacattttcgcagtaaccgtactagtgttgcagatgaatgtaacgtttaattcaggttgcgtattcaggtacaggaaacatcgaaaccgaagccgctggtatcttgcggcgtctgcgcaacgagatttcaaattgctacaaacaaatgcttcccttctttctccagaaaaaatcgttttgagaggctatttctgcttctgtcgtgcccactcagttgtttgtgtgcatctgtctcacaacaccagcgaccacaccgtcgagttcttggtgcctcatcggggctgtgtcgagttccttaaagcggacaagtagccgtaccgtgtacaacttagcactctcgccggataactttttctttgttcgttttcctggcaccttcactcctgaagcgttggggtggggaaagcttagaagggctcggggctgtgttaccagcaaacgagagggtagcgcttttgcttgcatttctgtttatcgactcgacctatacagttatccacggcagagtcttcgtacatccaccttcctaaatgcaggatctggaatgtttcaccctgtgttactctagacttcacttcacatgtgagagaaacgcgcggatacgtagacgcctgtgtacggcgtatttctgtggtgtacgcgagaaatagttctcgtcggtgttctcctctgtgcaggtaagcataagaaacaaagcactccggacagaaagagtcacttacggttcgtacaaaaacgtacacatgacgacatacacgctttcccgtttccatgtcatccgctttgcgtcgtgcgtatgtttgttttttctgtgcatgcatgtatgactggtccagtttctctttttagaagccagttaaagtgcggcagaaaggagtcacaaaattctcatctaattgcctcgcttttttttgaaggtaacgtaaaaatgaagcaccatattctgtcttccgcttggttcgcatgcatgtttctcttttccaatttttcgtatacaagccgccgccctcgagcgtgggccagcgctcaggtcgccgccgctcctcctgaaggcgttgaggccggagcacacatggatatttgcaagcgaagaaatgcaaatgtctctccttgtgttccggtgttatgcgcggagaaagacattagagaggaacaaagtcaagttctttgtttcttggactttctgcgttctacagtccccacaattccggcaaccctcctcactaagtctgtgcaactttctctccggtccccgttctgcgcttcccgtcgaggtgtgaagcggtctgagaaccagtctctttgcgttcttctttcttccgcggttcgttctttcgtttctgctcctgacttctctgtacctcttccttctgagtacttgtcaccacctttctctgcgcaagaacgtctctttttctcccacccccttttctccagaggttccaaacaatatttgccttcctttcgcccttgtcttgtcgttcgtttcttcccttctttcttggcttttcgcctgcttttttcattttctgtgttgatttttctcgcgcttttcgctgtctcgtactttctcgactatttcggcgctccaccgaggtagaagttcgccctcagttctcccctgcccggcgtcgactccatcgaggaaaggtccaacaaccttgcagaaagggggactgcgttttccctgaacggctacgaagctttctgtccaggctccaattcgtctgaccgcctttcccacagaaaaa

SEQ ID NO: 3707 - DNA, 1852 bp, Toxoplasma gondii
gattcctgccctgttgttctctcccgtattctcctctccacagcatgtttccgtctgccgccgaaagcgacaagcctccggagttcccctctctgacaggcggggagatacctgagagggaagcgcttctctcttctctctctcgccctcttgctcctcttgctcctcttgctctgcctcccttttggtcttccttccgtctctgtttgctccaagagaagtcctggagaggagctgcccccgctcgggcagcgaggcaggagacactggagcccagaagcgccgcgctcacttcgccgtgtctccgccaaggagtgcgagagaaacgacgcatggacgagatgggcgcgggcagagagagaccccccgcgagacgcagcggctgtggaggcaggagagcgagaagaaggacgagctgaagaagcagctgcttcggagcctcagagacgaatcccgccatcctgctacgccatcttcatgcgttcgtttcgcttcttcctcgcgaggctccttctgcgctcgcatgcagcagaaatgcctccttttttttcgttgccactccgtctccagtctgttcctgggcttcgcggcgaagtcgaaagaaagaagtgaacagagaagggggagtcgatgtatttttcaagttcgggaacctctctcgcgctccaagcgactcggcagaagccagtggcacacacgctgtctgtacagcccgcagagcaccgaagaagtcctcgttccagcagtcaagcttcttcctctgtcccggctgctttctctgcctccctgggttgggagggagggagggaggacagacggagcagcagtcgagacagaggaagaagcttgactgaagcggcaaccgccggcttcgacctccatctgaaatgtcagccggaagaagcgcggaacagacgaaatgaaggcgaagcaggcgaaagcgagaaacagcgtggtacttggcgggaggacgctagggactgccagcgcagcgggcgaagtcgcgcgcgaaaacgaagggaagcagagacacgaagagagagaaacaggagagctccgcgcgaggagacaagcctcgctgcgagaagaaaaacttcgagaaaaagccgcgtctctcgctttctcctgcgttcttctctcccgtaaaaaacgcgaaacgcggggctccggtggccgcacagtgcacatgcctgtctttctcgtggtgtcggtcaacagcaagcagcctcccagaacgagcaatcgactcttctctcgtctttttctttcgcatcccttcttctcacctgcgttcttccccctcttcgtgtcgccttcttgtcttctttgcgtcgtttaggaacagcggctcctcagagaccaagcgagagagagagatagaggtagagagagagagagaccaagcgagagagagaggtgcctcccggggaaaagaagggcgccgtcggtctcgccgcagcgactgcgcgctcggcgggagagaggaaatcagcagtgtgtgttgtccgtttgcggccgagacaatttggaacgaaaagtgtaaaagagttttttctgtcagaagagcgtctccttcgctcttgcttctctgtttcgcttccccccgtctctcgccggtttccgtctccgtgtgaaggcgccgtagacagggatccttcgcccgagaggcggagacaaagagctctcgtgttcggtcttgttctctgtcgttttcccctccttttgcttcttcacctctgctttttttcctcgctgcggaacgtcttcatcgccgctgcttgtgcgtggctctccgcgcctctctcctctcctctcctctctgccccccccccccccccgcccctcccttgaa

SEQ ID NO: 3708 - DNA, 3942 bp, Toxoplasma gondii
ctgagtgggtagccgagagaaactccgagaatccaggatggaaattcgggagtgacgaggagagtgggaatgcttttcgacttctcagtaggcgcttccaaaaattcaggggaggggggggggatggggagaggggctgttgccctggtggctattttatctattgggaggcactgccggtgatctcaccgaggaaaacaaattgctttgtgcattgtaccacctacgtgtgtagactttgtgcatacaaggcaagccgtaagtgccattcgtgtgtgcgtctgatacacgcctagttccgtcggacgttaaaacgagaggtcttgtggcttaaacggagtaaatctgcaacgcgtgtatggaggcatcgcgccgctgcgttcggcccgcggttgccgagacaacgaataagcagttagaaactccagaaaaacttcgatgaaacagacgcacgtggtagtcgtgagagagacatgtcgcatgcagccgaccgcatgcaacagattggacgcagacagagcatttgaaagactatgtttatggcaacaagaaagcgcgagagcatgggtagtgtgggcaaggccctctgcagatgctcgtgttgtctgggtgtgtagctccatcacatcagcagccggttcttcaatctcattagtcccgccttccttcgtagttcataaactggaaatcaggtctgggcatcgacccgaggtcgaggcacaaaaggcagctgaacgtctgagtagcatcgaattcttaaagaattttccaaggatttgtgcgcgcatcggcggacacgctttgagataggaaacacggaggtgtaaaatacaggcggggtgtctacacacttttctcttgaaaacgcgctgaagatgccttcataaacaacctttgtttcctccattcgccgtacaaactcgacttgagagctccgtctaccatgtagtgactgtgtttccatctggaacttgcaacagaatatcaacctttttgcccaggtggttgcttctctccgtgcggttgcaagcaaaaggttacaaacttgcactagcggcggaacacattgtttcacacgatacactgcggtcaaacgtgccatgcacagtcctttcagaatcctcggcgagttagggcggcactgtagaaatgcatatatgtaggtcaggacacgaaaaaaagggtgtgagggaacgacgaagtagtcattgtctcagacctacggggaattcgacacacagcgaagtgggtgtccaaaaagcgacgcagctccccatcccaaagatacacgtgagtgaaggatcacgattcagtagtaagtacatgcaaaaaacgaaaatgtatgaatacgagtgtacctggaaaaaacagtgatgccctctcacactgggtggagcaaacgcgatgtggctgtgtgctatctgtgaccgtggattctggttccgccccctattggatgcgtccacattcacggtggcgttcgaattataagcagcgcattaaatgttaccgaaatgaaggatgtttaagacaaaacgcagcagaagcaaacaatcttgctttgcctgtcacaccacacagcgctgtcacctgagttctaatccgtgaagccacttgaagcagcaaagtgtgtttttcgcctgttgtccgacaatctcgccccgcagtggtttcccccaggactgcagccggacacacaacctcgggacataaacaagaaatgcgtccgaaaaacgctggtgcttcaattcctgttcgctgcgataactcgaccacagtcaagcacttctcctgttgactgggggggctgagcaacggaaacgcttgccctctccaggacttttctaatgtttgtgtttttgtcaaaacttctctctccgctagctaggcgattgtttttccttttcggggatcctgggtcaacgagacgacaagtggcaacccggttctgcgatgagtcactgcagttgctttttccagccctctggtcacgtccgtgcagacgtaagaaaaaggagtgaacgtgagtgtaggaaacaaagcattagtaccgaacattccgcgcggaattaagagcatggctttccccgattctgtgtcgtttctcgactccggttttaggtcacccaagtcggaggtggacagcagaaaaatcgcttcggctcaaacgcaatatttgttgagtagggtatttccggttgtgtgcaaatcgagaccacagattcgagattcggatggcttttccttttccaaataaaactgatcagtggggaaaaaacattcgaacgaaaaaatttggaaaaacggggggccctgtgggtctgctgtcgcaagactcgccgcaaaacaacttaggtcccacacacacacgcaaacaaacgtgtattgatgtgaagagaaaagcgagtaaaacgagaagggagagagtggtgcggcatatcttctctttgtttaaaactatgtcaagaacaccggcggcaacgactctccgatcgtgtccagagcagggctgtacatgcacccttgacaaatttggacatttttgcgtatgtcgctttgttttgtgcgtccgcgaaagtttgtgtgtggaaagaggaactcagagaaacgcatgtcaagctgtcaaagatctcgcctcctttccagcgtcttgcccacggcctcaaacgccacgggcaggcttgaccgtgcccggatcacttttggtgtcctgaagtcgcgtttccctctttgatactcactattatgatggctattcctacgggtactcagatattcgatttcgttaggtacctttatgaggagtccagatctagacgacaagaccagtagcaattcagttgccgtggagagcgggtcaaccggttgtaagaaacctgtcgactcactgtccacctgagggacaaaacaaaaactccgctcgttgccgcagcctctgtgctgcgaggcgcaccgacgggagcgaagacacataaaggaaaagacaaagaaacagtgagacagagatgccacagcaacgaccgtccaacaacctcagtcgcggcaggagcgtgtttccgtcgttcgaaatgccctttgaaccccgaaacgctcagcatctattctggttttctggaaatcccaacgcaaactcttgaagcttctgtgccttcatgggacacatgattttttctggaggaaaccgggcagagtgtcggacggcagcagacgcttcagcacagaaaagagacacaaatgccatgcgcaaacaaacgtgatgtgaatgggattgattttcgccgaatcggtctctccattgccttacacgtcttggcaaggaccttcagctggacttcactggcttccttttcacctgctttacctgcaaaacaacctgttccttggaaacacccgcaagccgagcggagacgactccgaagctttcgcgttttccattgaggacttcctcgccttgcagctgcttgcttttcttttcccctccagcctaagaagtctccgtcgcgctgagcgtcaacagtgcatacctgttgaaacagctccgtgtcgcgcatgtgattccaaagtcctcgtagtgtctctcctgaagtgccagggttggcttcgtttctttcctggaaactcacggtctcttgagccagtgaatcggggctgctcccgtgcgtctcagttgacccgggtgttctgttgtctcctctctcgcctacggtccggggatctgtcggtgaaacctcgatgtcgacgccccagtgcgtctacgtgcatgcgtgttcacctgcaacgagctcatattttgtgatacccacacggaaagtctgtgcgcttcggtgaaacactctgtcatggatctccatgtttctcaaggccccttttcactctgcgtcaattcctctgccctttgaaaacgtccgctttttggggtcctgttttcacccaaccaagcca

SEQ ID NO: 3709 - DNA, 3284 bp, Toxoplasma gondii
tgaaaaactgggaaaatcagtcgagggcaccctcgaggtgttccggcgcgaccgaaaagtggtagttcgtgtgcgtgtgctcagtgtacgcgttggtgcagcctccgtgctgcttgatgaagttggaatattccgtttcatccggaaacttctccgttccgaggaatagcatgtgctcgcagaaatgcgccaagccttcgacgggcgggggatcgaagtaagagcctacattgatgtccagagcggcagaggccaggtctgccgccgggtcgctgactagccaaacagacaggtggttcggcagcttcacaaacctgtagctgcgcttgttcgtttttggtttatcgatgtcctccgtctctcgtagcgccatcttgagcataacactatgcccaaatagtcagctttaccacagaaatcgataagaaagccgcctcacagcgtataccaggtgacaactgacacgtcgacttggattgagggtgcaaaggatgagaaaaaacctggatatcccgcccgcctccccacatactgtggcggacggatcgaggggtcacgaagtgctaggggaagggtgataactaacagagaacaggaaggtggtaactgttgtctatgttaagccgcgaaagaagtacaagctacgattgcagttccctctggctcatgctgccgcagggacttcacgggaaaatccggacgctaacacagcgggagctatgttgaaccagcagccgggactttttgaaggcgaatcgttgacttgacaaaaaggaaccagaagtaaaggcatgcgacaaagggtaggaaggaaccagacagaagaacttcgcagttgaaaaaatgcgttggctgaccctcagaactgcgatgagcaaccggcgagcagcctaagacggtgatgaacaaaaggtacaaggtggcgggtgagcacacaaccggaagaaacccagtacggaagaccaaggaccgggaaagcaagattgcagcagcactaaacgcggggacggacgcgactggggtagtcagcaacgaagtgttacagcaaaaaaaagatgcacggtagacgctacgcaagagtagaacgcgcaaacggcagcgtgcggcagatgcagaagacgaacgcggaggaattgacgcgtcaagaagaagaaactcgttaaaatcgaggcggatcgggacgcatgatagataatccaagagactgccacaaaggaaggtacacggggaagacaggcagtggcactcaggagacgttctttcagcaaagtttccggctgcagagacgaagagtccgacatctgagcccgctgtgggcgccgagacacactcaagacaaacaattctctctacggtgctgaaaattgttatctaaagtcagaaagactctaggtgaaaagtaagtcgcaattcaaccataagaagtctcgatggcggtttgtggaatgattcggtgcacagtagaagtaacgggccgatcgcagaggcagcgattgcacgtagtcgactgccgaagaccaaaggcgcgatacgggaggccttgcacttgcaagacgttgctttctgttacaacatgagtgtggaatcttctaagtcaagtgcatgtgtcattcttctgtgtgatgtagcgacttgtgatctcggagactagattttggatgaatcgatcaaccccgaggggacttccgtgcaagcgcgttttaaacttctgagcttcaaagtcgatcgcttgatcttttcgacggcgttgaaaccgtcaaaatgaatctacttgctctgtgcacgaaagggggtaccgttttacaacaatttttagcatgtcctgtgaatttttgcacacgaactagcccagttgctttgtgcgcattagagagatatgtgactctcctcctcacgaatgttccggtcggctttttaccaagagcgagtcggccactgcggcggaccgtccttctggagtggtctctctgcggcttccccttcaaggctgccggggtttctctgctgtttcgtttcgtctcaaggaagcgtgtgacgtctctctaacagcccgttcttttccctagaagatgtgcgtggatgacgcgaggaggcgctctcatttactccaactgtctccttgctaacaagcaggggtaggtgacgggtgaccggcgttctgcgtgccgcgctgacttcaggtggctcgggtgacgtggcgcgggattccacagggggcctagccaatggctttcatgtcttgaatatgttcgtcatttacatggtgaaggtagtaacgacttttttctgaagggttcagaaaaacatgctggacttcttctgtattttttcttcctcttcaactcgaagatgtacgacaaagacactgccgcgaccgcactggaaaccacccatcgcctctgctcattcactcggccgcttcatgagcggagtcgcacggaagcttcgggaaaaaacctgaatcgctgcaaacacgatagatcggccttttttcactgagcaaagacactgttttttctccttgacgcctggatgttccttgcgaggtcaactgatgttccttcttgattcgacttggtaaccgtcctcacgcctcttgtgcaaggtcctacgaggaaacgaacgctcctcgaactccgtagaaggtgacgactgcagacgattcagcccgcagaacaacggaaagatgatgtgttgtaggaaggagccaatgcgacatgttgtccaaaatcgtttcgagtgtctgtttagaattcgagctgtggccacgctcttcaagctgcctccgtttcgcgcgctcccggacgaccctccaaacccaaacacgggcgagtgaaacgcgagacctctgtcgttcccctcattttcgagcgttttctccagagtgtcttgcatgctgtcaaagtgaaaacgcctaggacagtttatattgatttgacgcacgtgttgcctccggtctggttcccctgtacgaggagcacgtgcagctgacatttttcgtgtatttgtctgacacaagcttctcttcagtacaaacacagccgagaacgcgtatgagggggggatcctgcagtactcgtcgacagaaaatttgtaactatatcccttgttactcccgatttcgtcttatgtatgtcttttttgtcgcccttttccccgtattcgaatgaaatcttttatttttctacttccgtcacggagcgtttcgccgcaacaagtcgccgtgcctcaaccgttccatgtaaggccagattccgaattctttgggtgacgttccgccacca

SEQ ID NO: 3710 - DNA, 4553 bp, Toxoplasma gondii
tattgcctggaacctcgaggtgttctggcggtgtccatagttttgcgcagcaaccgtttatccgaggactgcactctggttcgagaaacacgtatgtgcttcacagcaaattcaggtgcatccatgctctacgtggcggcgtcgtgttgctttatgctctcgttttgtgtgcggctttttacttttttccagccgagagaggttccacgtggaactgacgggtgcaggcatcagtcccccacacgagtggctgtttggcgagggagcggcggctgctccaagtgcctcggtgaagtttacttttcaaacaccggtgaacggaaactgtccgtcgcctggacaccttctccgtcctgcttcccaagcgacccaagtaaacgtgcaggtctgtggtaccgaacctgtgagttcgactgcgtacccgaatcttgaaacgcgcgacataaaatctacatgcgtagacccgattcttcagctaccatgggtgggaatacgctctggagtggacgagagaacggtatctccgggggcgtctcttccgacgggtggaaaccgacatctgcatcagacatctggtgccacggagccaagtgacgcgggtgctcgggatgaacgccacagagaagcatgtgaagaacatgaatgtgtatgtgaggcgtcaatctgtcagttgtctcacgacattcttcatgacgaaacacgcaatgaggagcggaacagcggagaacacagtcagacacagtccgacagaaggcagcaaagtagtgacggaggcagcggcggatctgacgactcgcacgaaaagaatcccactgcttcttcagagaccgtcggtgccccagtcctgcatgcgcaaaatagtccactttcttttccttttagtgcagttgccgcgaacgagacgctagagctggacacccaagaaggaatgaaaactctaggggaaacacagataggttgcagtggatgcacgcctgcggagcgacaaaacagactatgtccacgaggacggggaagtggtatgcctgtgccaacagggaaggcattctcaatgaaggactcagattcacttttctgtagaggatcctcaagaaatactcccgttgagagcccgtgctcccggcaaggcactttgtcgcatgtccacccggtggtggtcccagagccatcctattctcaaccacttgtgcaggccgggtctgcagtttcgtctctcgagtctctcggtgcctcctcaggctgggtagcatcggtccatcggtctgccttagcgttcccactcttgctggactgtggttctagtttcgtacagcaagacagcagatacggttacccgcgattcgaaggcgtcccgccctcctcacctgccttcctccgtttgttacttgtggaaggcagcgctttgttgctactggatgtggccaaagaaaagtgtttttcgcccttttataagctcttctggtcgcgcgaggaagcacagcagctcaacaaaaagaatgccttggccgcgtggcaacagcatcaagctcctgcacttcatcgacttgatcaacttcgccttcttttaacggaggtgcaccgacgcacgctacggcaaggcgtcgtgactcatatggtaggaggacagacggggtgtagacgtcttgagaggagcagcgaacgggagaaaggtgataggagtagaacggagagcggaggtacgtcggaagttcctcgtggagcaggcagggagggagacgaaacgagagagaatggcgacagcctcgatcctgagggcggaagcagcaacgcgggaatcgtaaaagccgtgggagagagaaaactatttcagcaagcgagtgattgctcggaacagaaactgatgcagcaagagattcggcaaatagagatgcagatcagacgaattcaacagcaaatcgagctagttcagcgggatcagcgcgaaaagcaggccaaggtacttcaacggcagttagaaaggcaacatggggacacgggattaacttggccggacgaggaagaaacaacaagggcgggcaaagagcggaacaggaggcgcgacgatggagagctgggaggcgttgtcctccaggtgacacaaatgggcctcgtcagcgccgtcatggttggtgtaggagctctaattttctcttcgataaagaagggagcgtgatattttgggtcatgttttgaacgggtgaagacgagtatcaaagtcagggtattgcggcctggtggaagctactgaatgaaatgctcccccgggtttcctcatccacgggggaaagagtcgacacgggcaattcccggcaacgtcgagacaccgaaataaagaagatccgctagcgattgcgccattggggcccgcggacgaagaaacgggctcgaagtgtgtggtttctttattttccacttgtgcgctgacgtgaaaggcgttacaccgtagagaagaggaagcgtactaatctggggtaaagttcgtgattggagttttgcttagccttcctccgtttgcatcggcgcgcgaccgaagccggcttgcgtttatcttccgccctggcaaatcggttttctgtgccgcagcccgccaaggacgcaggtgaccaatgtagctgcaactgaagaggagccgtatgcaatgggttcggttaaacagttccctcgttacaacccctgtgggtctggcattcgagcggttttctgtctccgaaagaaagtgtaaagcacactgaagaataaacctttcccgcagctgaacaaacctgcttgtggtaccatcctggcgtcctttccccgttctcatcctccacagttactgtcatcttccagaagacggactgacccgttctcttctattgcacaccgtttttttgagaagtctacatgatccagtgattcgaagtgtcgtcgtgttcggttctgacgaatatacatgtatttacatttgtgcgggtattgtgcatgggacaggtacatacaatttgactagacttaatgtgtatacatttatgagtgataatccatgtttggcttcgtatgcatacacatgcaagtatgtgggtacccatactggttcttaaacataggcatctacttgctcatatatgtacgcattaatgtatgcattttcatgaggtgaactcgatgaaatcgtttttccattcgcccagggtcaccgtgcctgaagagtgattgtgtggtgggcgaatgtcagagtaatttttcctgagcctttgtgatgactttttgaagctgtcccgaaaggttgccatctgcctcttccacttcttctctgtaacgactcacgaggcacgtttctagcaacgcgcccttctcaccgcatgcttagaagtgtgcaagggagatttcactgatggcactcatccggctgttcacggtgttacttctgcatgatggacgcagcaagagcaggacatattaaggcaccggtgtgctgcaaagcactgttactgcctacggcgcatctgcgcctaatcccaccacaggctggagtacctacggttcgaacaccatcaatcactttaacggtgcatgtctcgtctttcaacgatgtagaagtctttgcaacagccacaggccagccgtaccatggtgaagggatgccacaactgctcccgttgttcagcgtagagaaatgatatcccggcatgccactaattggtagcaagcgcggcgtggacggtgtcattgtcaccagtgactcgccggaccttctccccccaaaacagccgcacatgggctcgagcacttcaactccgctgtcactgtgtgtctgttgtccacaaaggcgaggcaaacattaagcccctgagttgttgccagtcagtacgacttcctcttgccgcagctcgtgggcgatgtgcgcttgttcgagctgtggcctttcttcttctactccagtacgaacgatgatgtaccataggtgctcgcggtcaccgctgtctcttgagagcatgcgtctcgttaggcacctgccgcgagagggtgtgaaaacgaacccacaagtcgccagtcccggtaattgcctcgaggtcttcgccagtagtgcttcagtctgacagcgaggacaacagaaactaacatggaaaacgccgaaggaaacggcccatgaacaagtgtcgagtgagcgaactggtgctgtcgaggcagtacagccctacagagacgcaggttgcggctgccgttcccgatgtcacaagaatgggacgtgcgggagattgcaagtggttccgataatttacatggagtaccttctttaatcaaaacgatacagtttagtggtaagtgtgcaactaactagcctttatcattcatattttcatgcatcaaaaaaactcgacccactcttgacattctgctttatggatgtcctgtttgcggtgcctgtttttttaaccggtcacgccgtttaaaccctaaacggattggaacggagcccttttctttgtggagtgcaagtcccgaaacttgaagaacaattggcagggtagccctgaggtgcctcagtgtttgtgtccgtcgtcccagagaga

SEQ ID NO: 3711 - DNA, 2132 bp, Toxoplasma gondii
ctgtgtaatgacgcatgagagctgttcaaggttctacgtctctctgcctctgcctctctaccggccttcctcgctcgacggtcatcgtctccgactgttcctccgtctcggttccttccgcgtcgaaggccgcgcctcgttcgccttcctctgccgcctcctccaccccacatgccccctggcgccctgccatccagtgcagagacagcacctgctgtctcccggaaaggagacacttcagtgcactttgcacgccgcgcggtcccctgggtcgcagctccctcggcgctcttctggctccgctctctcttcttcgtctccaaccttccagaggcaccgcagggatgtgaaagagcaacagcggcagccgttggaccacaagaagaagcagaagaagacgcagcaaaagaagacgaggaagaaggaacaacagagagggaagcgacatccagatctcccctcgcggatcgagactcagcagagcagccacggcggagacgcgggccttgcgttcggtctctcgagttcgccgacacatgaggcctctctcgtggtgccttggcggcttctttctcgcagataagccgaagtgcacgaaacgcattggaagcctccggatttgctgcagacgtcggaggcgggagacgggaggcaagagggaagtagcgacgtcgctcagggtcccagaacatcccaggaagatccaggggagccgcagaagaggaagaagtcatcgcgtctgcgtggcggcaagacggacgccggtacatgtgtgtcgaggaaaggagatgcggcgagtgcgagctgcgagacggcgcgaaaggttccagttctcagggactagagcgggagagcagaagaagagaagaaagaagaagagtggcgtaggaggagcgtggagttccgatttggggagcagaagaaccttagacgttcgcctttcccctgcttgccgtcaccctaaccagcgtatcgcagagaagagcatgtttcctgcacagatgcgatgtacagtcctcaagaagaggcctccacaaagggaagttctctggaacaagcatatcagctctggccttggtagatgatcccctctgcgcccctgctattcgcgttcgatgtagcgagctacgaaacacggcgatccgcctctgttctctcgaggcctgcagctcccttgggagagttcaaacgcactttgcgtttgctttgaggatgaacgcgtccctttctctccaagacaaaagagagcagaggagaatcagcggagccagaccggaggcggcggcggcgcgcttgagaggaatgagtctcgagcccctcgtcgtacgtcgggtgtaactacaccggcggccaaacgcacgggaggctgagtaaaagagaagcggagcgaaaggggaaaagaaaagcaggacagaaggcggttcgtggatgccaccttagagacaaagagagaatccgcgaagcaatcttcgtttcacgtgtctttcatgccacagagcatgcacaccctcggctttttctctttcggacagctatgcgcagcgagccttccactgagttactttccctttcccccctctcctttcacttcttctttctcttctttctcgtctttctcttctttcgtttctttctcctccactctcatgtctttctagaggggatgaattcgcgcaaggtgtcgaagcagctggaagagaagcacgacatgcaaggcaggcagcgaacgagggcaggttgccagtcgccgcgtctacccccgtggttagttaaaaaccaggaaagccgagggaattcgctcgtctgttattacgatcgtattcgtttctagagaactccaatctctcgcttccccgcctcgggtcgctctccctgtcttcctctccgaggcaggccgactcaccggcctgacaccgaggagagtcctggaattctctttttgactttccccgttctcgcacattggcgtttcgccgtcttctcgctgttctctctctcccctttgctagcttcttctctccgcctctcggcgcccaccgggcgaacccccgcggtgtctcgtctgtctccctcgcggacttgccgcgcctcttctgccgcttcttcttctgcctctctgttttttgacgaca

SEQ ID NO: 3712 - DNA, 3905 bp, Toxoplasma gondii
gtgtgttgctacacataagatggcagcgagtagattcgttacggttcattctgctctgctgataacagcagactcagcgtacagttggaggtattcgaacactttggccgcaagtaccgttgtgagactctcttggcttctgaagttttctccgtcaactgaagttttcttgcagctaggcgagatgaagccgcacaatggctactgcccaagtgttcgaggagaggacatgcacagcgacagagctgcagcatagtgggatacgactgctgcttgcccactttctttggctgttttcagtggccactgacaatctctttgttggcctacgggacgcccaggtccagaggaatcttcgtcgcaagcaaatgatgattgactacaagcccctccgacagtactacaagtataaagtggcgcacgcgacgtcaatggatgagcggctggactggcactgccggcttcagcgcttgcctagagactcttcacccacaagatacaggaaccggtgccgagtgtgtggcagggctcgaggctactttcgcttcttcggcctctgccgacaccacgtgctagacatggttcgaaatgtcatgtttcctggattcaccaaggccgagtggtagaagtggtggaactgtgaagcactcctgtcactgcctgaagtgcactgacactgttttggttacttatggacgcgtaacagctcattatacaaggtcggcgacagcctttaagggctgtataacacggcaataggccccgaagacgagcgtcgcagtgttctgcacgtcaaactgttgacagacttctacctgcggtcacaagatccccagtcttgtggaacaggtcaccgtcaaaaaatcgcaactgactgctaatgcaaccaccttagctgacaagagtgtccacacgtcttcactgacaagtccatctttgtgactaggatatgcttttgccctctaaacagtacatcccactgtgtgtgcaccaatttcatcgtttgggggggaggggctaactaaacgctggcgggcgctccggcatgcttccacacccaaagctgttatacatattcctgcggaacagcaggaggcaaagcgcaaacctgcggtgatatttccatcgcgcgtcgggttttaggcgatcgacagagcgaagctacgacgttgatcagagtattttcgatgtgcagatcaaaaaccataaaaagtcgaaggtgccgtttccgtcccattcaaactcaccatagagtgatacggctggcgtaccacacaaagtgagcgcgcgcgaaaaatcagccacgcaccagtatccggcagagtatcggcaacgccagtaaggcccgttggacgcttctacgcgtgatgagaaaatctataaaaaccctgtccccggcgagaagcagcgagtcctcgtatcaccccatgagcaatggctccttggagggaaaatggtcatttcacaggtgcgcgagtaagggggagaacaaggccttgtcagctgaagtacaaaacaagacacgctcttccctcccgatccggtggagaggggatattactacacatgccggaagccttgaatcaggctggcaaatggcgccagtataaacaacattaacgaatatcagcgggtcgtctgcttttatgcatcgtgttccttgaagccagcgtcccctaggttgcgacgaaatgacctgtcgcttcactagacaaccttgctcaaaccgtttgcggaatacgcgcaacgattccgttcaagaggtagcaaaaaaaacgtacaaccggtgatgagagggacctcggtgtagttttatttctgaagatgccgagtaatcgcgtgccagaatagatgcttgaagcggcgaatctcgaatctgcggcgtgcggtttctggggagacccgcagcggctatggtggacagcgggctcccgaattttttgtgaagcgtcgaaagattttcggctccaggctgccggtcagttagctccgaaatagcttactagttgctgggagaaaccctgttttcgtcttgtggcgtctgcggggagatcgcttgttgctcgtgaactagctgaggctgttcgggcgcgggaagtccaagttgtgggacttgggctgggtattcgtcacatatcgagggttggctcgcacgcccgcaggctcctccgcgcaaaatgtagtacatggaatcgtcggcgttaagcttgtcgtattgagccctcttgtacagctgtcgcggctgggtttctgggtacggctgtgaacagcaaacaaaaaacaataaaaacaagtacgctgacggactcacggactccagtgtcatgtgtttcaggcaagatgtaccattggtcgcacccctcccggttcggtgaaacacggaaatctctccacgatagttatcaagctgccaatagttcatggagttaggtcgccacctgatcctgtcatatacttccagaatccaccattacaacctggtgggtgcagacgagcgagccagcttatacctggtgctctctacttggcacactgatgtgtgccgactttcgtctgttggcccacgtacacttaaccaagatgaatgccagactcagggaactgcatggcaataacgatgggatgtttcgtttctccgaaagttaccttcagggaagacgtctcgcagtgcccgctctggaaacgcgcagatgctgcgccgggagcttttcccgtcgccacatcttcctccgtcttttctcccttgcgtgggcagagggttctgtcaaggctgctgacttccattggatggcgtttgacatcacgtgtctcgaagggcccatcagggtttgcaagaggtggtaatcggtttttcacaaccggaagtctgtcgcttcgatgagcatccggttcgacagtcaggaatcggtcccactgcagcagatgtacagacccacagatcacacggggaagcgaggcgctcgataaaaatgagggtttgttgacgggcaatcgatgggcaacgatggagtcatcagtatatcttagctaaggcttacttgtaggtggcttcttcctctacgatcgtacgcgccctgcatgcgtttccaggtgtggtatgttgcgtctcggtcgagctgcttaaagtccaactctacactcgcactaccgccttttctgcatgtgcaaaattccattttcccgtcaatggcttgccaccttgtttgaaaatgcttcctctggtccgctagatctcctgcacagattcgcagatgcgaccgcttgctggatcggactgccggatacaagggcgtctgtcctgctggacagcctgtactcccgcggagaaagtctgcagaaacgctgtcaccctgcggggatgtgcagtatagcagctcccttactccgtcactatagcctttacccgggttgatgcgttttcgagtgtgctgatgaatctcattcatgcggcctgccgcgacacccgccatgtcgggcgcagaaccaaaggccagctgggagagtttcggacgtcggtgttccgggatgatatcttcccagggatcatcaattgactgagcgcacgtgtttttcctcgacgataatgagggcttgcctgcatatccagtggggtcgaacacccggggctgtgccgtgcccgggattggcactgcaaggggtccacccaccgacgtcgccattgcgagaaagagcaagctggccagtccgaggcggaactcgaggaagtcactcacgcacctgtctagcacagaacaaccgaagactgtcttgccgcagcagctttctcgatacagaaaacgcgcatcgaaactagtgtgacagccgaacccaaaaagcactgcgaacgagacagaacgagaccgaggcagaccacgtccagtggatcacttgagtagactgagcaa

SEQ ID NO: 3713 - DNA, 2344 bp, Toxoplasma gondii
tcctcgtttagttataagcgaaaggcaagaggattttgaggttttccgccacttgcaggtttccacagggaagcaacggtcagtccacgtgttgttgcctttcagaaaatgacagtgtactaggtggggcttttgtgcttaagcagccggtggtagatacgttggtttgttttccacccagattctttcttggtttgatttcctcactgcttctatcctggtgtttacagctatggcggaactccaagggttctttttgttctgcaaagacaacgtggaccaggctttggcaatggccgagtcgtggagaaaagcggaccaggaggcccgtgcagcggtgatgcgagagcgagaagcggcaaacacaaaaactaacacggctagttcagagcaaaaggaaccggaaaagctcgcagttcagcagaaacactcctccacagggaatacagagagtggcagttcacagtctggtcactgcgagaagcagagtgcgtcctgatgatattagctaacgtgcccagagatccgggactgagccgtgcagggaagaggatgaatcaacacaatcttttttccagttggtcaatgcccctgagttccctcttcattactggcactgaattgtgccaccacagtgttactcgaaagcaacaccaccctagcgtggtgattacaggaagtaactctacgctagggtttcgaatgcgatggcaaaagtcattgaaacggatggcaattacgaaacgaaaaccaattccacgcggcaatgtgaattgtgaattacgagagattccttgaccgagaagcatataacggggtaaacaataccagtggacgtaaaggtaggaacacgactttataccaaaaggtgctgtagtggttgaggtgccacattcgaggccatataggtcgcgtcagaaacagtagatgtggcaaactgacggctcggatgactgcggctgtttctgtgcttttgggacacagaacgggattttagcttatgataaggtaccgtctctgacagcacgacgggggtcatccaatctggagcacagagcgtgaggaacccggtcttgcaaatgacgctggcattgtggctcccatacaagaaatattttcgggaagcccaggtttttgtacattcatgagtcagttgttgtgtttacgtgttccgtcacctgtttttattccgtcatgttttcccgtaaccgagtccccaggctactgtccatgtcactggctagatttgtctgcgattctcgactgtctgtttgtcggtccacctgcagcaaactgccatagttattttatctcgttccttttgaagactgcgaaggaaacataacacttctccctgacgctgcacataccccagcgtctcaaaaaaggataggcttgtccattcataacgcaccatttaatttgcttcaatcaactctcgaagatgcaccctaaccggtgatctctttcctgtacatgcgttccagagttggaagaggtggtaaaacattttttgagtttgagaacagatatctcggaactctccgtaggccccaccaagcccctaataaatgcagcattcaaagcacaacggaggcacaccaatattttgctgaagcggacctgctagtgtttttctgtatgcgatgggcccgacagtttaatgtcgcccgtgtctcggcagtaaccacctgttaccagcgaaaatgaaacgaacggcacagactgaccaacagtgggcgacacagtacatgagctactgccgaaatttcgagcatgctccacgtgtgggggcccgagcgcccaagctttgagatattgtcgtacacccgcgagctcaagtgtgtttattttgaaggggattttccgtgcttggacccatttcacgcttgcaacttctacaatgttccttcgaccggctaggaacgccaggcagactgcgagttcgttgtttcttctttaaatatgtagtgcgaacaacctggcaacatgtctgagagccccgcctcttccaatagccttcaagtctgttttcatggtcgtttgagcagagccgaatccactcttatgccttctagacaacgcagacgaatgtgaaggcttccagagggtgttgacgattgtgtcaccagccctgcgtgttccgtacaaggggtggcttggcaaggcgaaaggagtcccgtgtagctcctggaggccaaccagccctgaaagcgctcctgcattttgtaggggatagcgtatgcgtagttgggaagaaaccgctgtggcgagaagagctcttgaccccaagcttgcattactcattgatgttctttatgaagttagagagagactccgacaa

SEQ ID NO: 3714 - DNA, 1867 bp, Toxoplasma gondii
aaaccgttttgtgcataaagacttttgttttctttttctttgctgtcataggggaaattcagtggccatgcgtcgcatgcatgccttcccctctctcttcctttgttcttttttctcctctcctctctgtttcttcgtctctttttttgtcctcacacaattgctccagacaaatcgctcgaggggggatctcctgttgtgtcgttcggtgtatctgatgcgtttgggggtttcggagttgatttttaaagtaaagaaagcgacggcaagcagagaagaagcctgcacaagtagaaagcggggagaggaggctgtacggaatctggaaaagcggcttccccagagtgagcgacggagacaccatcgcccccttgcctcgtcccttgccctacagatgcagggagatcagcacagaagtaaacgggcagaaagagagattaggagagcagggagagagcgagagcagagggagattaggaaacagaagagatcaagaggagagactgtagaagaggagagaaagagacaagttgagtgaggacggaggagggacatcgacacgagcgacagggagaagagaacttcagtagagagaaaaaagtgaaaatcagagagagaggctagacgagaagagagagaaagtgactacagcagtcaagagcgagcatcgacgaggagagaaagaggttttcggatcatcgtccgacttttttcagccttcgcatgcgaacctccttcttcgtcgctcccgttcttcgtttctcctttccccgaacggtgcaattctattgaccgagaagggatgttgccgtttggcatggaaaaacagaaacttcagagaaaagagaacctcttctggcgcctcacctgtgtgtgagctacgctgcaggccttgaaacttctgtgctgaggtgcactttgctctttctttcttcttccactgccgtcaaaaagaaagagtccatccgtaaaaaacagtctctctttctctttctctttctctgtgtctcatcttcgtcaaagacctcgcttctcaactcgcgtccggccccccgcctctcccgcctctcccgccgcgttcctcgctgtttgaggctgctcgcctgaggcgtctcgacctgcagaggccaggtctgttccgcggagaagaaaaaattctttggggaatcgaagccccgtgcctcggcggaaaccacggacttttcgcctcggaacaaacgcatgcgacttccagggtgcttctttgctcaccgagtccgcagttttcgcagcatgcgcgcttgcatggtggggcagaggcattcctctggaaaaataaagaaagtctggaaatgtggaccagagaccagctactttattcctcttctcttaccgacgcctcagcttctctcccggttctcgtcggacttctccctcctcttagctccgttttcctcgccggtttctctaagcgttatggcaacagtcgcaacgccgatataatactcgagagcagcgcgtcttctctccacttcgttcgtcgcttgtcttcctttcttctttccctctccttttctcttgagtcttcctctcctttccctacagtgtcgccgttttttcctcgacgcgcgaaggcgagagcaaacgccgcctgggtctctgggctttcagagacactcttgcgagacccaggggagacccggcgagatcaagaaaaacgagatctcgaggcaaccgagagaaatcgaggaaaggggagactgagaagaacgtgggagatcgagaacagcctacagggctcacaagaccttcgcgagaagcaagagagaccagtccgaacgagaaaaagacgagggaaacagagagcagcttcgtccgcgtgcagcca

SEQ ID NO: 3715 - DNA, 2002 bp, Toxoplasma gondii
cgttcagccttggtgacgctctgacgaatgtccatctcgactctgcgtcgaaggcgagcctcgtcctgactctgtctcttctgaagctcgcgcttcgccgcctcgcgctctgccgcactcagcttcggcctgttcttctccacgctccgtcccgtcgccaccgcggccttaagcgtatctgtctccgccttgcgcatgtcgtcgaggaacgcgtacgcctgactgaccatccgcagattcagagggccgcatgcctcgctgaaacgcgggtctcgcgcctttcgtccctcgccgcagctcttctttccctggatagccaggtgtcgcagccgcttcatgtgcatgtgcatcgctgcttcgcgagaagaggagctcggcacagtcgcggacagagggtactgcgggggcgcgtcctgcggagttgaaggaagccccacaggctgacacaaagtacgctgcggacgacgagaagacacctccaaaggagattttttgttgctcttcttcaccaccttcttcacgcccttcgctttcggacctgcgcgtaacgggcgagaagaagaagaggaggccgacggggtcgtgtcacggaaagaagcagacgaggactctgggggggcatctgaagagcaacgggcagagacaccagccgtctgagctctccctgcgctctgctcctctcgccgaaactgtgcttccagcagcttcagttgctgcagaggcacagcccgagcatcttccagagaagacgctcgaagcttctttgcgcccattctaacaccgaaaagtaacaaactagcgaaaaactgcttttcaaatcttttacccccactgcttcgcttctctcgccttctccggagctcaggcactaccacacactcgatacatatacatatatatatatgcagagagactttctatgggtctatctagctggaatcgacgagggagatgcctgatgtttggcgtgaggtttgagacgaaatctgcggcttgccaagagggatctcgtcaggcgaatggcacgcaggtataaacttcgggagaggttcttgagttcgagagcagccttccgagtgttcaaagaaggcgacactcgcgctttgaaaactacgcttctatgaatcaaccacgagttgaaattttatcaggaacactgtttctccaaaacaaacgcattgaagccgagcctcgcagctcaatgggaaccgcgttcgccagagagaacaagcgagaagaagagagaagcagaaagaagaaataagagacggaggaaagaaaaagcaaagatctcaggaactgttggtttcccaagtcgacgaggaaaagtacgcttcgcagaaggacagattgctcagattcgaaggaaacgggcgcatgcagcactcggttttttcgcaggcatgctctttgagtgtgttgcagaaagcgaagtcgcgagggaaacacgcagaagatggctttctttctcgtgctcaaatgtgaacgccaattcgttgttttcttcttctgtggcgttcttcttccttcagaagggagagaaggagtctcaagggctgatgggaaggagagtagctaatcggattctcggttgtgcggccgaaagttgttacgaacgggaggagcggatttcttctccctagtcttatccgctcgtctcctgtctctttactcttattcttcccctccgatcttcttctcctttctcttcagtcctctcttttttcttcaaccttcttttccgtcctcttcagttctaccttcccttcccttcagttatcttcgttcctgtgaaattctccgtatcccttgtcttgtctttccttcttccttcttcttaaggcttcttctctctcctgagttttctccttcttcctcttgagacgtctcctgtttcgagtgttccgctatctctggaaacttttgcctctgctttcgcttgagtcgaccgcgcttgctgcgtatttttctctctttttatgccggacaaccgagttcttta

SEQ ID NO: 3716 - DNA, 4771 bp, Toxoplasma gondii
cccttcgcgttcttcgattcctcgtcactcgactcggcttccttttcgtctgcagaggacgaagactcgaccttcctccccgcctgcttcggagcggccttgccatcacgcgccttcgacttgtcctcgcgctcgcttccactctcgctgccgcctccactctcactttcactctcacttccgctggcgctttcgctctcactgtcactgtcagactcgctgctggaaacggcgagggcgaatctgctggcaccgcgccggggacgctcgtcctcgctggagtcctcgctcgacgactccgagtcggtggactgaaaaataaaatgcatggtgaaaggcgcgaaaagaaggcaatgtccatgtctcccgatgcccccctgtttccttcgccgcgacagtgaaatctactctggaggcgacgcacgcgacagaactgaagaacgccttggtgatcagaactggaaccgggcatgaatgaaccgtggattcgcaagaggtgtgtatctgaagtcaataggtcccgacaggggcaagagggaaatgaaaactggagaaaagggagtgccgacgctgaagtaggactgagccgtttatcgaggtggggaagaaaaactgttggccgctaaagtggagagcggcaaacacaaagcaaaagcggcacactcacatccgcagctggaacgggcgtcggcttctttgcttcgaactcctcgtcactggacaggccaccgcgccgtccacctcgaccgcctttcttcttcggcgccatcctggaagacgcactgccattgaaaacaaaaataatggcacagacaagtacgacagatgattgtctcacccggttggatgcgaaacagagcaagcgaggaaagcttgggcgccatgcggcgaacacggacaggagtagccagaggaaacaggaggagaaaccaagaaaaatacggaagtgacagtgactgcagcaacagcggaaccatcccagacaggcccacagtttcgcgaggtgtgtagtgtcggccgaacaatagagagcgaacgtttgcttacctgaagcagctttgtgcgggaaaggaacttttgcgcaagtcggggaccgtgcacgacgacggcggggggtgaatggaagatcaaaggagtaaattcatactatggcaatggattcggtggcattccctcgaattcgctggctgagattcctttggcggtgcttggaaaatgtaaccaagagacagcaagaaaactcagggaccgcgctgtggcggcgggggttgggggaagacaaatccgttcgtttctccctcagagaagcacggacagacaggatcaacgaagttcgaactcccaatgcaaggacgaaactggtaaggagtctaagaatgcttaaaacgcagcaaagaggcacgaaaccggcgaacgttctggtccgcggtgtggggagtgactgagcacgacgaaaaggcgtccggtgcgctacttcgcgtctactgcagtgggaaaccgcgggaaacggcgccgagagaggcacctcccgtggcgtacagacgaattctagtttttaaaacgggcgctggagagaccccggcgccctcaacaggagcaaggaatgaaaacaaaaaaacaaaggtggaccgcccccaggcgcagttgcaggtgcgcaagcttcgctcgcgaagccccggggagtgtgcaagtagaggcggtcacaccgtccagctcttggtgttttcacaaagaagcggaccatccccctctgctgtctccgaaaaacgccgacacaaagcgctttcagcaggaatctgctgctgttcaacaaccaacacagagtccgttccggtggttgtcaatattgcatgttcaattgaaactggacagccaaggactcgcggtaatggctgcaaaacaaaacataacttcccgttggagtcggaagcctcgtaacagtcgctgcatgtcacttttcggctgggaacgttgttccaccgcttttgcccaggaagcatttcgcacttctccgttttcagctgcgccataagcttagacacaagccgtacatctactgtgatattgccagtatacagtgttgattttttacaacagctgcactccgtgttccgccgcttaatcacagtctgcttgtcaagttctgtgtacctttctaggagaacactccgtacttcagatgacacgtaaatagttcgcttatggtactaggaattgggagatcgcgtagaaacgaccttaaaactttaccagtcaatcggtacaggaaagttaccctatgttccgtaagaagtcagctgagtgggaggcgattcactcgcagtagcagccgtccctgaacgcgttctgcatctgacatactttcctgcactttgcccaatatttgccatgattcttcattctttaaagtccgtacacgtgctaacggcgaaagcttgtgtctgttccagtggcgatgagcaaaagagccgaccgacgggtgcgctacttcagagcatctaagtgcttgttccgccttccgtgagggtgtctaccttgcagaattcagacagaagatcaagttctttgcctgggtatttttgcgttccgtacatgtgtaggcaaaagatatgttatacaggttcttgacctgcgcagtctgcgaggcacacacaggtagaacgacctcagcgcctatgagcgtaggatacgcggaatacagctctctgcagcccaccaacttcgtgagcacccttgttgttagtgtagacgtacaaagacagtgtcattagttggatgtttcaggtcacaaatgaaacagctctctggaaccctcctgcttcgaaagaggggacaaagcctagcaacaaacaactccgtagaaggaacgaggcaaaatgcggattcgtatggacgcaatccacagttccccaggatttagttttagtcacatgacctcgtttaccttgtataggcaacatgtcaaatgagtagcactactttaacttaggttggagtttttgcctcagcagtacacgcgtccgcgagggggatgcgtgtatctgtttcacaggtactactgtttatggcttggcaagactctttctcattgccaacgagcacaagaaagcgctgcgttctataaactcgtgcgaaggcgtctgccagcagtcaaatatttctaaactgaacggtcctcaccgtgcttcactaccagacagcaggcggcgctcgttccaagtaccataccatgcagaacggataagctttccagaaaggagtacttgtttgccagaggtttccgctatctgggggtcccctttaaggttgtcggcgaatttccactcttcgcgcttgaatatttctggagatggcaaacttctgggacgttgtgtgagcgcgacccgtttcgtttcctgcagctgctctgagggaagtgtgctgggtttgcgaatcctccctcaacttttgactttctttccactccagattcttactctcttgctacctctctctgtgcttgcattcgtgggtcttcatccgtgaaacgtaccgtcttggcggagccggaattccgtgtttttgcaccaccgacggcagatcgtcgttttactcttgaatgtaccatgtcaggaacggagctgaatgaggagtctgggtgttctttgcccttctcttctcgactgcagccggtagtgggtctctttttgcctcttaaggagcatttccttgatctatgatcgggttttaaatgtagtatttcctacctccactctgttccactttttgatacatgcgcagaaacgttgcattagctgtcgctgccgagccgacacgcgcaagctacgaggtcagagcggtttccagtggcaaaaagctttttgtctctcgcatttgactcggaacgtctcctcggtttgtttcttgtttttgacgatcctggcttcctcgccggattggtttcgtgcttgtcgtgacgcaaaagacaactgcaaaaccccggcgtgtcgagcgctttcgtccggcaagtcggtcgctgacgtttccccgtgactcttcgtatgctcttcattttgtgttttctgcttttctaatcttttcgccctcagtctgtctcaatttctccgtcttgcgaggtcggcacagatcccccctcttcttcgttgaagcgcttgcacgagcgctgcgcaaaagacccgccgagattcctgtgtcgctcacaggctcttctgcttctacttctcccttttttgctggaccctttcttccttgcctttttcttctttaatcccctgttttctcttgcccactttccttctcgtctccctgtatcccctgctctccgctgcaagcagctaggttcgctgtgtctctgtttggccgtctctcgctttcctctcgctcccttccttctcttttgtctctcttcattcgtggctccttcccttcttaacccttttcgattttccacgttttctttttccaccctgtctgcgatcctctattcttgtggctgtcctctttcgctggattagcgcctctttgcgactccagcccggccgtctcccactgcgtcttccagtctcgagctcacaattcaattccttgtcccctctatgtcccgactcgttcttctctttcctgtgtctccagcgtcgccctttccaattccctttcctttcgtctctcgatgcgcatgtgtatctcttctgtcatcatctcgtcgttgaaccgttcttccctctgttgtttccactgcttccttgcgtctactttgcgtacacgacttcaa

SEQ ID NO: 3717 - DNA, 4375 bp, Toxoplasma gondii
ggttgatgtacttgtgcaaatacgtctgtactgtttccgttgtcgttctcaacaaatacgtattattgtactgcgtatatatatatatatatatatttattgagagaggaaaagagatgggtgaagcgtggctataatccgagagagacgcattgccggtcggcacttgtgcgtcacaggttgtcgtcggatcgtggcgttgggcttgacggagaaaccttttgttgcaagggtgcagttttccacagacaaaaccttttcaacgtcgagggtgcagaaccctgacttgaattttcccttcatatgtgtcaaacaagaccctcgtaagataaagggcacgcccccaatgatttactgagtatgactgcatgctggagtgcgagttttttcacatctgtgagagcagagcccaaacaaagtagtagtgtttgtcgtcacagataagcagtactgagcagatgtttgctgtgtcagttcttgttagccagcgcgagttaattacttttgaggagatgaatctgtaggcaagttgtatcttgtgggattgagattgtttttgtccaagtctcgtctggtcgaaggaccttacttctaaacgcacgcacgcgcgacgaggtaaatccaccagttgtgtgcatctcctcgccggtttctgcctggcacaacctgttcgtcacttgggctgccgtaaaatccttcgtttcccactaggagaacgaagtatcacatcgtatggcctccaaaaagacagatagcgagtggaaagatttgcgtctttggatgtgactcgagatcccaccacacggcacgagtaaccggacatgatagaacaagaacattttccttgcacaaagcagggaacacgtacacaggtttatgaaagagaagccacactccatatgcacccaggacacacgcggggcaacgcttgtgggtgagcatgacgtagtctcgtttacgctctcctgtgttgccgggttcctcttcgagtttccttgctcccgcaagtacattgttcacttgtgcattctacatttcatttcggtgcatccatgcagtttcgctgtcatcgaggtgaagatctcactctctcgccgctaccggaggaaacggggtggtggtaagaagcgagccttttttccggaacagagaatcaaataagcaagagcacacaaactaaatagatgatttccttcactcttgcatgtcatctgctgcttaagacgcctcccctatccttccatttgagagttcacctgttccgcggaaacaacttgcgtggctgcgtgccacgttataaaggtcttttagcggatactgggtcactcccccatatgtgagagaagtgtctcctgtcgttgcttttccccccactcaccttgcaccgtctgtatttcactctgtgacgtaaaaatggtcgtcatggatcagttcttgctgtgtttctctcttttacgttctctcattcatattctatagagattgttgttcccccttttccacgtaagcgaaaaaacgcacctgctgcgtcgatcacgtcgtgcatcgcttgtcgtgctttctccattccgtcgctcaaattgtcgattattgccgcctgaagctcatcatccccctggcaacaagtcctcaggaagtttcccatttgtagtatctaacagaaagggacaaaagaactgatgctcagacaaaaagtgtgtagcacgaaagggtagtacctcctcgctgtcacatgttaagacgggatctggcaatacaaagagaaacacgcctctggcgtgtttgtgattcagatacgtgtggtatatatatgtaagaaaatgtgtattttgatgaccagcatgcaatcattctacagaaccgcaggaagtctgcatacatgtacatatcagagccgtgtcagttttttaacaggcacacgaatcgtatagatatcgtcacatcctgcgggggttttcaagattatgtttccccaagtagcttccacactcagtgttcgtcatgcaaccatcagtaagcaccacaaaaatgtgcgatcgcccaacacaccaaggatctattctttttgcaagttgggaggtactgccggtttcgaacagcgagacagaaatgtctctcacagagcattatcgatgacatcgtgtcattttgagctgctgttccttgcacagaagacgtttttgtagtttgtgttgcacgagatcgcgacattctggttagtgtcggtttgcttctccgcagacattgtgccaccccaatcattttcagctgtctctccgatgtacagtgctcctgtgaacatttgcattcggtgagcttgattgcgaaaatatctcaattcctgtggccatcgccggacctagaaccgacgaccaggagtaggttccggcggtggtttccatggggtgtgttgacacacctgtttatccttgaggttcttttaaaaggaacagccaaaccgatggtgtcgaggaattctcaagcttgtttttctgagcgaaaagtcagctagaatcgacttcgtaatacgctgtttgctatatcgcgctctgggttgatctctacgcctgggacttggcgggattgtgggaccgagctactggccagccctcccgaaaagccccatttgactcacaggttcggaaaactatgtcaggagtgaaacggaaacgcagaagacgtgagcacatctagaaatgtgggaaggtccttagaggacacgccaagagccatcgcgtgcaaggtctgcgacactgggccagcgctttgtagtcttcgagaagtactttttgtttctccttgaaacaccaccaaactcgtgctggctttgtgtgcctcgccctttcgctccccaaagaaggacggaagcgacgcactcgtgatcaaatcagtctcccatcctctacattcttctgtctttacctttcaggatgtgttaccgctgagtcaaccgaaggaaagggattcgggctgcgttttctatatgcttcggtctcacgcactctgcttagctgccatcggtgccagtcaggttcccgcttagtgtaaccttgctgtcagacacggtttggttcccaattcaacttttttttgcgtttgctcgtggtccggtgttcataaacgcagatctcatgttcactttggggggacagcgacaactgaactgacctttgttttttgccgagctgcgttaaagatgggaaacgcttgctgctctgtggagaagttcgagccggtaggtgactgcgtcttcaggcccactcccgcaaagagcaaaagagactaagaaaagcacagaacgacaactacagaacatacgtaaagaggccgcttccctcagaaagaaatcgagtggggcactcattgccccaggcttcctggcgtctcttatcatcgcgacacttttccctctcgtgtgttattttttcgtctgacgccgaaacaaattttagcccaatgtacacaacagaggcgagaaaggcagtcgccgcattttttgcgcatacccagcgttcttccgaggtcgtgaaatattgcgtacaccaaaacgcgatcgtttcaccctgttcaaagcactcacgagtgtcagcaaaacgaccatagaagcgcatatcccgactctcccttcacataactgtacaacgtggtattcaagggaaggttggaggcagccgaatcagagcaccgacgtctcaaatgtctttgatccagaaaagctgaacgagagggcctttagatgccaccccacaggatctccgcgtgtcccgtggaccaaagacaatacactttcgagcagttcctccttttctcaaagtagcaaggaacccgatgacggtctcattttggcgacgcgaaactcgcctgtcctcaattctgaacctcaacagtacagatttgcttgtgtttcttttagggcagcgacgctgcggtcaaagatttccttgtccgggcggcaaacgggttgaagatggcagtcgtccttcaggtgtggagaagagaattttcgaaaaggcagtagcgaacggcaacttgaattcccgatttgccttgagacagacgagtcgcaccagtgcacaaaaacggatattgtcgctcctttagtacgaagcttacacgcatatatatatatatatatatatataggttgggaaaagtagtatataccagcgcaaacatatatacgtctgtacagatatatccaaacgtatgctctgcgtgcattcacctgacttgttttctgttcgcaccatgaatgccacactcaagcactacgaagacgcgcagactgcttggaaaagtttcttctcttccgttcttctcctcgtcacctcctccttcgtcgttctgtaggatgggtctgacctggaatgcataa

SEQ ID NO: 3718 - DNA, 1660 bp, Toxoplasma gondii
ggagaaaagaaagctccacctttaggaaagaagaaaggtccgcctttgcttgggaagaaaggtttaccacctccaaagaagtagcaaggatcaaagcgggcaaaggggcactcgcatttcatggcccggttttcgacagttttggtttcttcctttgttcttcctcagtgcatgtgcagtgcaaggccgtgtatcgtaggttcacaaccagttgcgttcgggtgtggagatgcagtatcttgcttttgagagagacgttgaggctgacctccgtacgaccgcacaccgaaaggacatttcttgagctgctgaacgcagttagcttggtgtctgtttccttgcccagaattccgcgtttgctacaaacggaaagcatccactttgtctgatccggtgatgcgtccagaggtgcgaaacacagctcaagacgtagtggctagagaaaagtgaaatgtgccattgtggacatgtgaccgacgtgggaacaaacatcggctggccaaagcagtgatgtgcgagtttcgacaacgcaggagagacaagcaaatcccttatgtgagcgaactgaagttatcgcaaatgagccacgaagcctttcttgtccttttcaaagagttcaagttgagacatctatagccttgggtttaacaaacgcagctgttcggctagtgatcctccactcgtcgtcctgataaatcgacaaactgcgagaggagctagatatttctttcggtgtggaggcgggtaaaggctcgcttctttgtacgcgagacacggactacccattctgatttcgtgtaacagctctggataatacgtaccaatttccttgaatggcagtctaggaattttttggtgcgatagaaagctcctcgaagcgttagactcgaatgaaaaccgtcgataatctctgtttaggaaactcgatccctttctctcaaagtgtcaatacacagagctcgaggtgaccaatcaacgacgcgtgtttcttcgctgaaaacatcctgcgctcttacgggtaaggaaaaggttttttcactctttacctggtaatgaaaaaaaaacaaagtcgcgtagtcataattcctgacgccggtgcctctctgattgggatgacgaacatcgcaagtccttaaacgggcggtcgctcgatttttggcgcttgcatgcccgctgcagtgcatgccgaagacacagttttcgtcggatcattaacagcgattggcttttctagcgagttgcatattggtcttttaagttgcggccttgtcagcctccgtgtcgcgtcgttttagcagcgaggctctttccagaatcagcaaagcgagctcgtgtactggtcagtaaattgtcaacaggagctgagtgccgtcgtctacagccggagagaattgtcggcgtggttgttcttttcctccttaaattgtcaacagatttgttctgtgagtagtatattcggatatctcactttttcaggaggtttcgcttctccaccagggctggaaacaccgaggaggcactctggaggaattgagcagattagcgtgacagaacgggtttggcggtaatgtctctcctctacaagatctaacgaaccgacggcgaggcaaaacagagcgaagtcgtaccgaagcattgatcatccaaagtatagccaata

SEQ ID NO: 3719 - DNA, 4956 bp, Toxoplasma gondii
ctcctttcaactctccgcttcacgctctgtcgcgcaagcgcaggcaaggactccgaccttgctccaggctccgacagaacgccagcgctgcgcgcagccccgcctgaaagaggttgcgcgccgccgcggatacgcacaggaacttatgttccggagttgcacgcgcggtctctgctcctcacctcttcggggaagttctcgacgaacaccgtcctccccaactgctggagctctgtctccttgtgggggcacccggtgaccagagaggccgcagccgggagcagcccgccggcgccgggaccgatggagacacctaggcccagttcggttttcttcttctctgcgaggatcttcgcctggagagcggctgactgaacagcctggagaagaaagtggagagagagacacacagagaaagagacatttcagtgctgggcaggaagaacgcgtttttgagaagacagaacgcagcaaaacagagactcgagagaggacagggaaaaaacagcacagtgacagcaccccaagcgcctcacggacaaaggccagacacacatgtttttcgctggtttttttttcgcctctggccttcgcgtacgcgacgtcgccctttgaaagcccccccccccccgttccccacactcgattcacgaaacgcgggtctccaacgacggtttgccgcttttgcggacgttttctctctctcccttcccctcgaaggccgcgagttcatacctgcaagttgctgaggtggttttgcatggcgatttcgacgacgctcatctggctgttgaggggcatggccccgaaggccgcggcgccgccggcctgtccccccagcgccgcgaccgcgcctgcagtcgcgagctgggctccggctcccagcgcgccgtttgcctcgaattgctggagctgctgctgctggagctgctgcagctggcggacgccctcgccgacttgccccggcgcgagagctggttggccaacgggatgctgcacattcaaggcggcttgcttcgcgagcgcctccagcgaactggagcccagcgcgccggaagcgcccgcgagggcctctggcgcggcgatgaaggtcccgccgcccgcaggttcgacgaccgtaaccgtcatggggacgttgaggagaggcgtattgttgagctgcgaggccgccgtgatgcccgcagaatccttgaactcgaggacgcaatagcgctgcgctgggttgttgaggtacgccttgaagccgatgttcagaatttcgccgcagtgtgtgaagatctgtcgaatgtgatcctccgtcaccaagggagacagattcttgatgtacagaacgtttgcggtgctgtacagcgcgcgcgtcggcgcggcccccaggcctgacgccccccccaacattttcagagcggccgcggacacttggtcaaaagagagcggacaagcaaggggaagctcttcagcagagacgaaagacgaagcaggtcgagggagaaggacgcggcggggtcgagggaagcgcgaagcgagacgaaggcaacaaactcacggagggaagagaaggcggagagaagaacagcggcaaaaaaaggagcgagagagacagagaaaacgtggaggcacgacgcgggactggactcgagagagggagcggagacgcgaaaaacgcaagaccttcttcgtgtgcatgtacaggcttcgcgatttttttgacgacggaggacaaagacagacagatgaggaagaaacaacagacagacgaagagaagagagtgggcgcgcgagggaagacaagaggagaagcatcggccagaaagtgcagattcttggggggacgacggggcgttcagcgggaggcgaaaaacggcttgctgcaaggagaaaggaacggagacgaagagttcacttcaactgaagaaaaacatcgaaaccgcgatgaagaaaaacaaaacagagggtgcaaggcgagagagatacgcggagactcttgcaggcgaagagctccggagaaaaatcgcactgggcgcgcggcgcggacgggagttctttaacagcggggtttcctctggaaatccgttttcctaccgagtggctcggacagatcgccgcggatttgatgggagaaaagaataggagcgtggcgacttttcagagcgaaagatcaaggaagaaatatactcttccttcgtcacgctcccagaggcccccgcgccgagtctggcaccaattctcgaggccgagcacaacgactagagaaggacgcaacaaagaaacgctttcgacgccagttcccaccgaaaaaagagagatttctccggagaaaaactcgaaaggaactcgaggtctcccccctcagcctcgcgcgtcggctgctgctctcgcctcccacacatgcacagcagcgggggggagcggaacgaaattttccgcagtccaagaaaaagaaactgagaagcgccgcaataacaccagagaagacaaagaaatgcagcgaacaaggtgcgtgtctctcatgaagtcgctgtctcgactctttactctttcccccgcttgtctactctgggagcggcagcagcgccaggcagaaaggcaagtgaagaaaactttgtcttttttgattcgcaatacacgcacactgcaaggaagaggtgggcagccgaggagaatgttagaaaacgattttcgcctgcaaaaggacgttgcacgagacggaaacaggcgttgtactgcaggggggtcgcaccgaggaccacaggcatgagaggcgagccaggtgtgccggtggctccctgttcaggaaggaaaggcaaggtttctcggggtattcctttcgagaaatgcacgaaaggaaaaaaggcgagtcttttctcctgcgggggagttgccactgccgcagagtctttcgtcagaagaagaagcgcagctggtagcttcacggtgagcacacggcttcgctctcggctttcacaccgcttttcgagtgagttctccaaagcaatttaggctgtgtagatccggaataacgcccgagcatttacactcgcttcactatcagttgaccgcttccacccctgagaaactgtcggagaggtccgtgtgctttcagggtgttccgcgtagagtgttgtcacctacgacgtttcttttcctcgacctttttgcgtcgtggaacaacactgaatctaacttggaaagagagcagatcacgctctccgcaccgaaagaaggagactgtcgcaaacggtgggaacttttgacaagaatacaacagtgtgcagcgaagtcctctctcgcgtctggttgctgaagttcctggggacccggcgtcgaggcagcgttgcatccgattcgtacgactcgagggcaactcacgtgaaggcgagcgatccgagtgaaagacaaacgttgagaaaatcgacagcaaacgagaagcggttcttcgcttttccccgtcgtctgctcagccgtctgcgccgggctggacgaaggaaatggcaccaatcgactttttctgtcttggggtgggtctcacgaagattggtcgtggtctccctccctcctgcaagtgtttgtttgcgttgaagcgaaaagaagaaagaacgtttctttctttgtagcgagccctccgacggcattcttcattcgcgtcttgtcttggttttttttgggggggttcggttgcaccgggacaagagagagtgcaagtttctactttcacgcaaggcgaggttcccagagttctctcgattttcctcagtcgtcttctttcgaaaattcggctgttcctaagaaaaaacgcaaaggctaccagagtctcccgtgcggcgcccgctgcgagagtcgcgaggtgagaaggcgcaggaacgctgttttttcgcctttcgcttgcacggcggctctctggccctctcggtctttgccgagtcactttttccagttttccttgtctggttttttctgcggggaagcaagcaatttctctgtcgaccctccgcgatcaaagtgcaggcagaacgctgagactctggaccgcctcgcgaacaaaggcaagtgcggcggccgaaggcggctgcttctggacgagctctccttttgaaagccgtctttcttccatgcgaaaacatttttttcctgcagaattcggagtcctgccgtgacagaggacggcggtttccctccgatgggtatctgccggcgcacccctttcttcgtctccttcttctgtcgcgtttttctttctcccagaagcgcaaacctctgtgctgtctctctcttttctctttcgagctgcaggaaaggcggcgaccgcgagggagagtctggcgacgcagagcgacagactcgttcgggagatttagggagcagaatcgttctgctctcaagggtctctttttcctgcgctccaacgcgatctggaaaacgccgcgatttccacttccaatcgtcggtgtcaaacagctggtgcgtggttgccgacgcgcttgactgtctcaaaaaaggagacgctctctactttttcgcgtttctccttttctctggctgcattctcgatatcccttctgtttacccttccttctgcgaaaacagaaagtccatttttcgtaagtttcggcgccacacaggccggtgcctcaaagttgccgcgtctccactttctccggtcttcacgcgaaaaaaaagaagatctcttccttcattcggtccaccatcgcgttcttcgcgttcttccttttctcctcgaagccccgtcctcctctcattttccttctctcattttcctttttctctccctcggctgttctcgtcttcccccgttttctctcttcttctgtctcgtctcttccctcttccaattggcgtctcgccggtggtcgcgaaggccgcgatgtagctcgcatgcacctcggagcgcgcctctgcggcttcctttttccgaactgcgcagaactcgacacccgacca

SEQ ID NO: 3720 - DNA, 2537 bp, Toxoplasma gondii
gctttccatggcagccaagccaccgatgaattcacccgtttttgaatccatcgtggttcgccccgaaaaaggcgactgtgaaaggcggtagggaaaagagtgtgaactgatttacacgatgtcaggttatgatactgctttggaggggctcatacgaatgtagcaaacgccactacggcagcaaacatctggtggtaacgtgacggatgcctctaaaaaaacataccccatcgatatcttgcctctttatatggcatcgaaggacgtctcgctcctccatttttcagaagaatcgtttttcttccacaaagtagaggccgagatgtgtgtctgctgcgcgcgtgcgaccacttcctttgtcggggtggcgtcgctccagggcgaaagcttgggcaagatcgggtgtcgatctgagtgacggaaacacaaactatttccctcatggtttctcagggacagcgtacgcagtggcaggcagggcttctttgcgagctttctctggagaatttcccggggtaaactggagctgcaagaaccatctccacgacagggcaccacttgggcgacattaggagatgtggtatgcccgagtactgaatcggacaaagtagactacggtcggaattgttaccagagcgtatggtttcgtcgtcaatcgtttgaaacctgaaggtttcacgtgcctcggtgtgcacatgtttttgacgggtccaaattcatgatttggagaggatgtccaatgcagcgactcacacaccgcagtttcgttctgaaaatgaatttgttgttacgactgactttgcaagctgttcctgatggactgaactgcacgagcagacgaggccgtcgtatcgcgttgtatttcttgcaatgtcatttgcatggtgctaaacttgtgtgtaagaccatgcaaaagaaacgattcagtcgactcgataccgtcgccggtgctgaggcatcgatggcaatcgcaaagtaccagaaatattgccaggaagtgcatacagaagtgcttccgacgtttcgcaaagtaaataccggcaagatttgtattcgggaacatcaagtacatgcgagaggaaaagcactacggtaatcctcaaagtagagagtgctcgagtcatgccaggcccttcaggttgcaaagaagacgtcattggtctgctaccaagtaattcgaataaacagtcagcagtgcagtgagaaactcagttactagcgacgagcagacgctgacaccttttggaaacggaaaccactgtactacgcgacgacgaagacactcagagtctgtgtgataggagattttttaccgtctagacggcttctgatcggagggcagtggtatccgatgctgaaataaccggcctgcacgacgtctttccacgaaagaacactacagatgactctctctaatcacctaacgctccgtgagtctgctttacaatgccaccaggccgctgctgtagtcgcatcgtctgaaacactcggagcttcttcccgaactcactgtatgaggttctgtactgtcagaatatttcctagcgctttgcactcggttgtattgtgtcggtgactccttcgtcctatcaatagcgttgacacgcggacttcccttcttcacatactctatagcgcgacaagcgtttgcgcaaatctctggccttacaaaaaaaagtttatcggatgcttggacttacgatccttctacttccaagtcgaagtgatgaggacggacctggagccggcgtgtcccaggcacagtcgagcgacgaaaaaatcgggaaacgtatttcattggaaggagcccttcgcagaaaagccggctcgtgaaaagattggcgggggaagagaacgggaccgaaaaaagagtgggaaatcgctgaacggtctgctgaactgttccctgtggaagctgtcaaaaactgcccggaccagggagcgcgtgccgcctacttgtctcatacgagaggtgccgtcgtcgtcttcgtacttttcgcttccttctcggttacttgtccggcacaacgtatcccgcttttgctcacttctggctgacccacttgtcaacattatcgtcgctgaaattgttttgtgcactgttcgctgcaacacccgtttgtgcatttagaaccagggtaagccaacagcgcagttgaagcgtctgctcacggtacctcgggacgggttcctggtgtcgactcgaaccgcttcatagacatggaatgaccgtcgttccaccctgcgcacccttcttagtttttgacagacgacgcctcaaaaacgtgaggagttccgttttcctcgcccttttcgcggcgtttatcgcgagtagctgcgtcatgcaccagccgtctctactgagctgtgccggccgagcggatttttttcaagcgcaggcgttcctgcgacgcctcgaatctgccacagagaactgtcgagcccctcatctcagttccgtacgtttttgtcttctgtcggaggatacttcgtggagagcctcttcgctacattctgcgtagcgaaggttgcgaaga

SEQ ID NO: 3721 - DNA, 1352 bp, Toxoplasma gondii
ggcaactcggtaggttggaagcgaaggaaaaagcgagacagaagaggaagaggcgacaggggcaaatgcgcgagaacgcgaatctcgaaagcctggtgaggccgagcacgacgcgccaccaggcgaaagacgcgccgcgagcgaagcctcagtctgacaaacgacgaagaagaaaaaggaaaaaaggaagaaaacccaccatccccgaagtttctccagaaggcggatccaggaaaaaaaacagagagacaaagtctcttctccctcctctgtttcgactccgccatcgcgacagcaggcctgtgcctccttcgatgctctgacgaatggccttgctgctggctgcgtcgtcgtcctctcctccatcttccttgcttctccttccttttccttcctgttcttcttcttccttctgcttccggtgctcagtctcgccgcggttcgcgtatgagcgtctcgtcgggagtgagagacgaaggttgttctctgcctctggagcagagcggttgggtctgtcaccgagaaggcgcaggtggagaagaagaaacggcttcagcaggctcttgcagcggccgtcgcagatcacactctcctcttgtttgcactcatggcctgagacctgctctcttctctgtagagttcgccttgcttcgcagatgggccatccgcgcgcgcatgcacagctgcctgcgctgttcgcggcggcgccgtgacagcggtgctccagaggatctttcgaaatttgccgagaaattctctatcttcaggagcctcagtcgacaaagaaaaagtctccttcatttccaactgcagcggaggcaacggatcggcgctctcgtggtaaccacagcaaatctgcaacatgtccggacctcctgtctttaagaaacagagaaaacagaaatgaacattcacaactacacgttggcatctatatctctgtatatataaatatatatatatatatgcatatatagatgtacgttgtacatatatatatatatatatatttatatttatatgtatatgtatataacgtacatatatatatgcagtagaaacgcattagagagacatagcagtccggctgtgtgtgtctacagagcacagagaggcaggtccgacaggccatgcagactcttgaatatcgaaacgcagacagagagcctgcaaggcgtttcgaaaggtcttggtgcagcggcaggttctgcaaagaccgcggagaaaaaaaagagccgtctttgctcagggagaacgaacagaggagagcaacttgagaaccgaggcaggtcaagaaggccgcagcgaataggaggtttgagacccaaggagaaacgagagccgagagcaaa

SEQ ID NO: 3722 - DNA, 3266 bp, Toxoplasma gondii
aagagcaaaagccggttcctagctttccttacggcagagtagcactggagggccatcctggcgttgaatctctttcttttctgtggcgactcgtgaggttttccctccctcttttgcttctcttcctgttccgctttctcttcctcgttccgcgcgccgattgtcagccaggagtttccctccttcttcagtttctcggcgacgctcttcgccgtctcgccttcgtaggcgagctgctggagggcgacgaggtgagggtttccctcgagattttcggggagttcatccatgaacagaggaaagttctcgtctttgtatttctgctgcaagtgctgcagatactcaggggtcacgttccagtcaaagaggccgtcgtcatcttccatcccggcaacctgaggcgcgggcgccgccgggcagcttgaagcctgtgaagcagacggagaccctctggaggcaggggcctgtgagtctgttgccatggtgaaacttgtagaaaaactcgtgggtccgcggcaaagacctttattgtttgcacgagtgcttcaagtctcttctatctctttagaaaactaacagaggattcggggacagagcgagaaagcactggcggcggcacccgtaaaaggttgaaagtcccgagaaaagcagctctaggctgtagaaacgatagcatttcagttccccagactcacgaagagtgtatatcagtagcgcgaagttctccgctcgtgggagtgtgcattcataggtgtcttttaggtgcagacgttagtttttgtttcgctccagagactcgagacttctccacgcacgtctgcatcgaaggcgggaggaaggtaggtgtgtctgtggagaatccttaaagaagagaactgcggaatgcggatttcctaaaagagtgtttcgaatcagatgacaacagaaggtccgtttagagttcgcatacggaaaacgaacgaaaaacgcggtcaaagaggcggccttggagccggaagtcacggaggaaggactttccgaaaaatcaagcaaaagccaggaagatccagaaaagctaagctaatccgttgattgcacttctttcccacaaggctgtgacaaaagttttttccaagataccacgccaaactctcgtgaaaattttctcgtgaaagcgtagccgttgtgtcgaggctactgagggagacacagggtagtcagggaactagaaatcccctcggaaaaaagacgacagggtcataaaggacaaaaactgaggcgataagctcgacatcagacaagagaacaaggcgaacgacggcaagaggagacacgagaacggagacaacggaaacgaggagaggagacacggcgatgtagttgagttacgacgatgcgcagaagcccaaaaacgcgcaatgaagaacccaacgcttgaccgtcggagaaagggaaacactccatgaaaaagaaaatgtatttaagtccatttccgcctcgtctacgttcctcagaaaaaagaattggacgcgaaaagaaaagacacgctgtttctgcgagcacctggagccggcgttcggcgccttccgaggcgaagcgtattatcctgcggctaggacggtccttacattctcttctgtgccatttttgtcaagcaagggaaagactctcggattgatcgaacagtcacggaaaaggaacgcacgaaacaaaaatcttaaatgccgttgaagaattctatcgaggcattcgcgccccggtacaaatcatagcagtcgtcctctcagtctgctttgaaaggcttcggggccaacagaggcggtaacgcaccgtaatggagatgtttccgtgtttgtgtaacggtttccatacctgggagtgtttcagatatccattccgctttctaaaagtgccccacagagttgtgcgaaggaagattctttgctgtcagcattgtagggacctcgtccccgttctaactcatagaccaaggctcgtcgagtgtgcgtttcacgacagacatgtggtagaaccaatgaagcttgatttgcgtggagcgtttttaagccttgaagaataaatgctcgagtgttcaagtagattccactcacaggtcagctttgtgccaagacagaagagtagttcaactgaatgctgttctctatcggtcttctgcagtccactggggtggtgatgtacgacagcaataaagaagtttgttgtctgtacctcccaactggagtcatattccgtattctaggtcccaagataacactggcaataccatgactgaaatgtgtagcagtaagtataaatagaccagtaccaaatctgagttcagatcatacaggccctttttaattgctctgttgccccctctcaccatcgctggaatttggggtgttgcatttttcgcttgaattttgcgaccgacacggttgggactctcgctgtctgccgaaagctggaaaaaagctaggaattcaacgtctgtcgcctaatcgctgccagtctcctgatctgctctagaggctcactgtccctaggcattattgcacgaattcacagaaagtgattcttgcaggggattttaacactgcgtcctgcttggcgagtctctggcaaaaaacccagaaaaaacgcctctcgagcccagcttgtcaaggaaaggagacaccgagttgctctcccgtttttctccgtgtctccgggcccctggagacggaccttgtcacacttccgcttcgtagacacgtggaaatggttgtcttctttgcaaaatgaaatagcacaaagcagtctggagcatttatcttctgggggtcctccgaatgaacaagatggaatatcgaacgttgcaatcctgagatgtgacttctacgtggcaccctgagtttcttgcttttccgctgggccagaccagtatgtattgttcctgtgcgattatcgagtatacgatcctttaggtaagcgacggaatttttctcgtaagctttgttgggacctgaaatgtttcagcctccgcttactttgcatggtacgaacgggtcttgcggttcccttggttggtctactttttccttttgcgtgttccttgcgtgaaggcaagcgcggaacggttatttaaaagccctggtctaactctccggacgttttctccgtggtttcttgtccttttcccagggtctcttgttcgcctctgttccctctcacctaccggagaggagggcggagatggcccaatgtcgtattttccgctctttccttccttctgctgctggcaaaaa

SEQ ID NO: 3723 - DNA, 2475 bp, Toxoplasma gondii
agacatttccggtaggaatccaaaatttagggtgatcatctgctgttgcagcacaccaggggtcgtcctctgccataaaactaacacgggggtttataggagcgggtcggctggtacccgttcccacgcgtgaatgttgttcgccactttgcgatgcttgtcgtctacaggccaaaatcgttccaccgtccttgtcctgccacttttttagggttgataagccgagtggtgccgccttcacatgtggtggatgaggcagtcaaagtcgcaacatccatttcgagccattccttgccgatgcgtgcgtctagaaatgcagattatggattcctctgtttgtcctactggtagaacgctagatcactagaacgttcaaggccgttgccgatcttgtgtggtgaagctatagtaatcaccattgtgccctgtagctatttgcttgtgtttgtccagcatcattttaatatcgaacatgtggcgccgtacctgtctacaaaaatatccagactagacggttgagctttacctcatcgacttgcctttggtcatcgctctttgcatcggcctatcctgtcattacgcagtcattgcggcgaaggagtgcgtcaatcgagcgtacgaaatgccattacaagaaggcctgctcttcgaaaggcgtcttttccacgggacgtttgcatacgaagaccgcagagagggcatgaccgcctttgtggaaaaacgaactcctcagtggcatcacaaatgatccccctgggacatgctacccttcaggctgaccgtgcagaagtgcggctccccgtcccaggcttttgagcaagtgcagaaaaagagtttcgagttttctctcctctgtgatgtcatatgtcctcgcagaaaacaggatgcacccgcgtgatctctttcgattcatgctttcgcacagtcgcatcaccgatgcgtttttccgtagataccacaacaggcagtcgtgaatccgtcggctgagcgaccagacgcatttcccctaacagagacactgagacacaaatggccgccgacatgcattcctctgactcgaaagggtcaacctacaactaggacaatcaacacgcagctatacacaaacgtacactgacactgtggcgctttggcacgaagcatacattatccatagtcacttgagttatgatacgtgttgcatcgctgatcccaccttgaatctcagcagagtgtagcgtgcgaagcatttgggtgtagtcctacaaacagatgttcacgctaccagaacggtggtagagaccagagttcgtcacgctcggtattgaggtactgaatgtgtctcaaagaaaaggtgaaacaatatgggatactgttcacgcagtgagataatgactgaatctcaagctcatggtgtggagacgaagtcttggatgagcgtgttctgtcttcccatggcacctgacagtggcgtaatactgcggcagcacgatagcgacattgagacgaataagtgggacacatatgcgcataataaatgaacgaagtaactgcatgaggtgtgtgttttcactgccttaatcagccatcagtggacagttgctctaaggttttacgctactgaccacgtcccgtacggcatcgcagtgttgcttcacggcatctccaaaggcctctgctccacacgggtgcagcttcgcaacggagagacttctgcagggcagaagttttgcaggacaaaaaaacgcgaccataacgactcttcttcaggacgtctgttgctccacttttaactattgacaccagtaagagaagtaaacatcaatcggttttacgccagccttttgaagtgactgacatgtgttatattggctgctctgtcgcaaaggctcgagtggttgtttttgtggtttcaggtggcttgcatgcatgcgggaacgaagagacatacacaggaggccgatgggtgctccgtcgtagacggctttctcctgttgaatatcccgcttttgcatgagcggcgccctaattatattttgcaattctgtggcgtgctgctgaagatcgttcacaaagccattcgtgaggaaacactattcctgctgtgatacgccttttttcgtcctccccgcaatctgaccccacgcgagacagcgcgaacattaaacgagtcgacattcataatttcattcccgtcttagtcacattttttctgtcggtgccttttcttggtgtgtcgtgtcgcgagaattgagtattagtctttcgtttctccgtgctggtaactgggcactcgcatcttctgcgccaccaccccacgtcggacgtgtagcggtgcgtgtctgtcgtggagcgtagtgcgtttgtctggtgttttccttgtgatgagttttttcatgccttggtccccctgtcctgtgtagaaagcgaattttttatcgacgtgatcccctgccttgagccaatcttgttagagtctcaccgtccctgtcatca

SEQ ID NO: 3724 - DNA, 3647 bp, Toxoplasma gondii
gcttgaattcactggtttgtccgcgtcgctgggtggcactcgacttgcctttcctcttcttcttctttccggatccgccgcgccccgtctcctctctctccttcgttggcccattcttcttctccctcgcggtgcccttcttctcttcactggtcacgtctctcgcctccgtcgacgcctccttcgcgtcgcagtccgcgtctccgcttgcgtgcatgcaggttccgtctcgcgcttcgccctcgcaggtccttcctgttgctccttcgagggcaacactcgcggcagggtggcaggtgcagccgccccggccctcgtgtccactgcatggcgctccactctttgcggtctcctctccatcttcgtgcaagcagcctggtgggcatgcgccgggcggctgcatgttgctgttgtcgctcgcaatgaggagcaggttgatgaaggcctggttgcaggagacggcgtccttcaaacgggcaattcgcgagtcgattgactcctgaagcagtgctttgtcttcgggagcgaggcgccgcaaatgcctctcgattcggtgcacctccatcagcgcatcctgttcgtacagctcaaacgcctgccgcacactcgcaaagtgctcgagctccgcctcgtcctcctcttgtctccccagggagacgccttctcccatgtaccccagttcatcgtcgttctttccgctcgcagccagtgccgagaccacgtccgcagagggagagacgccggaaggcgaagacacttcagaccgactcccttcgttcaggaccattgtgagaacatggaacactgaggaagagaaggagcaagggggaaatgcggcacagggagaaaagagagagaagagagagaagagagaaagtgagaagtggggtatagagttaacccaagaagaaagcgacgtggaacaggcacagagaggagggaagagcgcagcagtggaaggcgaaaggtgaatgtaaaggagaggtgaaacacacgcgataagctggccggcggctagtggataaccaaaagatagcgagagctacacccaaagacacggagaaggaaaagcgagagttgaggaacctgaggaagcaaatggaggcgactgaaatccactgggcataaccccgagggagtaacagaagagacttttgtccacttcgtcgcgacggggcccttgaatctcgcaacctaatcggaaagccactgaatcgacgtgaaggggagagacgttggaggaaaggaagaagcggaaaagaaatcaacggggaacggatgcagaccaggactttcgcgcagacggagagaagcggcgcgttttcgcgactaagagagcgccctgctaacctcaaggaaaggctgcattcgtaagagggaaaagagcgacggagagaaatgggaaatttgagagaatagcacacggcaaagagtccagaaagcacacgccaaagacgcagaagtgggagcccgaagcgaagaacgcgcttcgacaccccgcacaccggcgaccgcctatacagcacgaagtcgcgagtctgtgaacaaatggatgggatcctttgttgtcttttcagatttggctctcaacgagaacgagtacgatccaaggtgaagaccggtcaggtctgtctccctgcgaacgccgcgaaccaccgtgggtctctcctcccctcgccgggcttttccagcggtttcctgagttgtgtgactgaatcagaggaagaaacgttctcgaatcggatccagaactcgaaaattctttcaccgtcaaaaaaagtttggcgaaaagcgggcaactcacacaccggtcgagtggcggaaatacgccgcaacagaccccaaacgccggagtgcagactgggtcgcgaggtggagaaacgcagcaaactgcagctgcgcctctgctctcagttctcgggcggaattcgagcacgtggcgaaacgcgcacacttgacaggtttcgccagagcccgtacaaacggagcggccgcgatatgagtcgcttttttgctctgcttcgaaagtgtgcgcgaagtcgacccattggagctttccccaaggcgcgcaagtcgagctttcgctctgtctaggttcgcagggattcttggcgccagcttcgatgccaaaatccgaaagaagtgcattttctattgagacgctaaggtgaattaactcccttcaccgggtgaaaaacgcctcagttctgcagacggaagcggcaaagctgcagttcgttgcacgacagacacttccgcgctcggctgatggttgtctcggtcccgcgagccgaagtctgttaaacacgcagcgcagctgggaatccaatccggcccctacctagaggaagcgtcgtttctaaccacctgagagtgacagcttgtatcaaatccggtgtttcttggcagttttgttttctacttaggttcgtattgggggaacccccgtgcaagatgttcattaagccgcggtccccgtgaaaccagtggcgtacccgagtgcgagacacacacaacgcagctgacggaccattttcgccggcgcttgctcgctacacgtctctccgcgacgattcgagatcttccacattgggacaatcaaaacacacgagtttaggattcttaatatatgtatgtggagaactcctgagatcaagtgtaccagaaagtgtgctcgtaccgaaaatgtacagctgtcttgctgtactgctgagctacttgacgcaaacagctttcctaacgccacttctttgttaatatcgcatgtggactgccgtctccgcgcgtcgcacgcgcgggaaaattacggcagtgtgtgtgtgctcgccagatgatggtggtcctcgcaggcgacgatgcacttcggccacctaaccaagttgagctagttatcaacgagggaaaaacaaagtctgtgtgtatcgcgcgaaggatgctgcacgtttgcttccagcactccagtgtaaatacaccccggcagcaaaaaaaatctgcttgcgatccgcgccttgcgtgtgagagctaatcaggccgcttccggtgtagtttttcggcactcctgcataaattttttttctttctccccgaagggtgtgtgggacgcagaaaagaggagaacgaatcgctggtggatgccggtttttggacaccgtgtcgcgggacaaggtgctggtcgtggtgtcaatgtgcaagcggacgtggattcccggacaacctttcaactcaagagtggtgtcccttcacagtgattccccttgtttttctgtgtcgtcttattgacaaggcagacttcagctgggcacgggacgggtgcattttctgcaagttcatgtttcgtctcgagcaccagtcctttgtgaggtccagcgaacccaccgtcttgtggaatacttcccggtggacaggcttctgtgttttgccagttcttcgtacttttgaggcacggcaccactcaagtcggccaactgtaagatgtggtttctgtctgggtcagtttctgctttccgacaccccaaactgaccgagtgaaaccctcttcatatacatcctgtccgctgtgtgccacggcgtgttggtggaagctgtcatctttcgcgttgcgctaatcgtgcacaccagcgagtcttttcaggcatcgcttctcagaa

SEQ ID NO: 3725 - DNA, 3521 bp, Toxoplasma gondii
gtattattattcgtgcagtgtcaaccgggtcgctagtctctaagacacgagcacactgtcttcaccccaaggcgcatgaatatatacatatatatatatatatatatataaacatatatatatgtatacatatacatatatatacatatatatatgtatatatgtgtgtatatatgtgtgtatatatgtgtgtatatatgtgtgtatatatgtgtgtatatatgtgggtatatatgtgtgtatatatgtgtgtatatatgtgggtatatatgtgtgtatatatgtgtgtatatgtatgtattaatgcatatatatatatatatataagcgtatgcatactacaggcatgaatgcacacagatgggtgtacgtattcttgcgcgaggaggggaaaaagagatgcgcatgcgtttggagagccttacatgtgtagttctgtagaggcatctcggtgttggagagagatcgagcgtcgcgagcgcgcagcgatggacgacaaagacctcggggagacgagagagttcccggagacaacagtctcctctgcgagaggcgcagtcgtcttccggaaaccaagcagagaacctcgaagagaacaagacaggctccggcgcgtttggcaccaggagacgcgcacagactcgagaacgaagaaacgaagggggcagaccaagaagaagaccagggagaagaaagagagaaaagaaacactgggagaagaaagagagaaaaggaacactgggagaagacggagccgtggtacggtgatgcgagaagacagaaaggagaatcgagaggcggggaaaggaaacgcggagaagaaagtggaaggtgagcagctggcaatgtatcgatgcgtacgcagacactggagaccgggagaagctggagaggttgcggtgcttcgaaggaaagatgcgaaggaaagatgcgaagggaagaagaaagagcttctgaaatttcagtcgctctctgctctcgagcgcggacagagaagccgcgatccgagcaggcgcagatgtgccaggggagaggacggacggccgaggcggcgagagaaggcgcatgcagcggaagacgtcttgacagaaaaagtggagaggagcgaaaccaggagtttttccgtgacgattgttgcggttggcaaaggacagagcagaggcaggcgacgatcgcgaagaagtaaagcagctgatcggaccgcgagcgcagctcgcgcgtgagaaaaagcagcggagggaggagaggaagacttgctggcagagtcgcgcgaggcaccggttccctgaaaaagacttttacgctctgcagtgacctcgcgctttcctcacagtttctccccacagctcttcttgcgacctgctctctccccgacttgggcggcgaaaaaaacgcgacaaaaaacgagaaacatctcttctccgcggcgaaccttctctctggaacacacagccgcgcgagcgcggttgcatatttgcatagctgctggctcggacatcctgggggagagaaactgagggtggtgaaacaggaccggacggagcagagaatggagagagaggaagaaaagaacattctttacttttttggggagtctccgagtcgactccgccggagaaacgcccaaaaatggcctctctctctagtcctggggagactctcaggtgtgcactcgttcatggcccagatgtaagcgcttagagtttctttttcttttgtgtctttccccacagaacgcaatgctttcttaattccttcttgattcacactgtggagacaccgtaaccagaaacaacagaggaggcgagaaggagaggacaacgtccgtgaggactcagtggccggcagtgcattgcgagtcctttccttcgcctctctctcttgcacttcctctcaaggactcgtcctctctttcttcgtttctctctctctctttgaatagctctctctctcttccgatatgcatctcttcctctgtctgtgtctttctccatgctcacctgcatatgcatatatatacatacgtatatatacatacatttgcctaacaatacatacatacattcatacatacatacatatatatatatatacaaacataattacatatatagagagagagacacagagagagaaatatatatatatatatatacctctctctttcctacctcttgccatttctctttctctctccccgtctctctgactctttcctattcagcgttttctcttgcctttctcatttctgtgtatttgcttcctcgctcttcctccgttgttgttttctagctcaccacaaacctcttcacctttttgccacgatttcccttttcgtctttcggtttctctgtctctcaagtgcctgccgaccatcttcgctggctcttcgaactcttcgaactctttctcatcctcgttctcttgcttctttcctcgacccccctgtctgcgtatttctcttttctccttgcctgcgccgaggatcaaacacagaagaagcgacagagcgcgcgaggcgcccaaaaaagaaggaacgccctgtttagaagagagattcgtcactctcactccacacccgcgcaaacgatttaccgcagctctcgattctccaaagctaaacggcgtcggcaaaaaccgctgtcagcctgcctgtcgatttcatgctttttcggtgccgacttcgcctctctcttcgtgttcggttcttgtctttagtctttacagctgcttcctttcttcttgaccttttcatgctttaaatcagcaccgaggtcaagtcttccttcagagaggcagcaggccttgcggcggctaacgtggaaggtccgtttctggtgcaggatcgaagttacgtgagaggcgctctgtgttctcactgtccagagcaagttgagactccaacgcattcagtgtaaagttcaaacggaatgcaacgcgttcctctaggctgttctgtgtctcttctgtcagttggggtgatggggggtctccgactgtcgccgcgtcactgtggtttgctcttttctcttgcgtacggatctcctttacaaacgtaaactttgagcaggacagacacgaaggacaagacacaaaatgcctctacaaagcgatctttcttgtctactatttttgactgaatctggaagggaagacccccgacatggcggaatctgctcctggattctcgtacacaaaaaaaccaatacaaggggactccctgtctgcgaaggcctctagagcgaaatgcagaagcctctgaagtgactcacccagtttccctctccatgcaccttcaatctggaaacagaaaggcgacacactaactcggtttccgtttcatggtgacgactgttttttggctcgaaaaaaaactgcgttctccgaatataatccgaggtcagatgaatttttcggggaaatggcgcagccgaagagcctcggcgaggcgaggagacggtcgctgcgccgccgtatataagggcagatggagaagcgaacagagagaaaagagaggcgaa

SEQ ID NO: 3726 - DNA, 1961 bp, Toxoplasma gondii
tgcctaagcgcatgcgtcttgtgagagcaactcgagaattcaagttttccgagacgttgcgagacagaagctcccgtgtgcgtcttcactagaactgtttttctcacgtttagagatactcacagcacaggaaatggcactgagagctgcgttctctcgcctacttgggtcccgactggagaccgccctgatgcgacgaggcccaaacacacccaggcatcaagagtgcctgccaattctatttatcattttgtatttaggaaccaaacagtcgcgtcacatgtgaccacggcaactgctgaaacgttccgtctcgaggatttgctaatccgcaattccagcttccggtaggaggcgtgtctccgcgtaacttcttagagcgacaagggagagactgctcttcgtgatggagattctggactctgctgttgcatacagcgtgcaaccatgcgcatgatatcttgcagtttccatggacaagtttttctctgcttttcttccgtttgttctctgcgcaagtgcgttcacaactcgcggtgccatcgagcgagtgttgagcgaagaggccttgccctggtgtagacgctgccggttatctgacgcgggagaaaactactactcagatgctagtctgatcagtaccatcgtcctgggagtaatcatctctgagactggattatttataagctttttctggagactatatcctacgagttggacgactggtttagatcttgaaggtctttttgatatacctctcgctagcctggcacgggttgagttgctgagtctccgacatccacccgcctcgctgtgcgcaagatccatatagatgaagaaagtggaaagtgctttctgcctcgacggttaaggcgttttggtagccttccgacgtttggtgaaagaggcagcagcagcccccacccagagcctgctcttcgttgtggtgccgttaatcagaagaattccatcgttactgccacttcagggaggtttcaacaacacaaattctggcaaagtaccagcacgaagggaccccccgtggctagtctctcgcacaccccggaagactgagtttgtgattcattcgcccacccagggatgtgcgcggacctttggatgtacgacgcctcctccatccatctcttcaaactcgtgaggctgtaccgccgttcctgacgtactgctctttctcttcctcctcgctttatttgcggatctgcagctttaacgacagcatgtgtgtgtccgaggcggatgctgtatgcgagctgcacggcgagtggatctcttgcttctgggttcttgtctgctctgcttgtgttttctgtcgccgtctacggcgtaaaaagagagaactgcatgccgcaaatgagacgctgtgctctctgatgtcgagccggtcaacaactcaaggcggcggccggttcaccaaaaagcgcaacaagagcgcggcgggtgaggcatgaacagcgtctgcgtgtagcacagagatgcgccgcggcaagcgcgacggtcgatccacgaagcaccgcgagagagctggatacgagtcagggctcgcgccaggcgttcttttcatctgtttgtgtcttgcctctcgtgtgtttctctgccgcggaacttcttgcgcgtttccgatgtcttttttcgcgctgctgtgggcgaaacggcgaaacggaggcgcgccacgcgtccaggagagttcgcacactgcgcgcatgtcctgtcgcgtcgattggcgccaagcggtcagagcacaaaaatcgctgatctacgatgcagagaatcgatttctcctgtcaaaagcgataccaaggaccttgtgcatgctggccgcctcggaactcttttgtttctcgcgatttgtcgtctccgcgttactcgctggcggcgcgattctgctgcgctgtctcagccgcatggtcgagcgacgtgaccaccggtttctccggaacgga

SEQ ID NO: 3727 - DNA, 3105 bp, Toxoplasma gondii
acgtctttctcttctacgtcgataacgaacgaggcgaaagtgacattgctacagttgccgtcactgtcaacgatcaagagatgcagcgagaatgctgcgtcagaaatttcttcgtgttagtctttgttgcgggcgaaagcgagacacacagccttcgcgcttggcaaaccgttttttttaaaccttttccgtgaatgtccataacggggaaaacgaagcatgcagttgcgtgtctagtgtgcgagtgcatatggacgtgcagatatatgaggagttaacttcagttcttgcggttttgaacggaagtttttggtttttgaaggtgcctcggaagccagtttcggaacaccatttaaaagattcggtcgacgtccgcaaactgagcagcggactgagggctcacttcaatcgagactttctcagcccgaaatatccacaaagactttcgccgttttagctgcactctgtctcatttgcctcgaggccgaaggacagtagaactcaaacgcgcgtgcgaggagtctcaacggaaatttgctcgggtgttgccgtcaggtctcatcgccgaaactgcgactttcggtggatccctctgtgttgggcgcccttctgtggtgacgtgaaaaaaaccatccaggctagaaccggttttcgaacatggtgacaatcgtccgccacatcttgctgacctttttgttttcggcttccctttccgcgagttcgacttcggcgtcgaacttctctttctgatcctccttgtggcggtcgatcgcgagtttctgtctgcgcttctgccgtctcttttctttttcttggctggccttcaggtctttgtctgtcaaggtgtctttcggaggcagcttcacgttccccatctccggcgcctgcagcatgtgtccgatggcgtaccggcggactttctccaacaggctattctttctcggcccgctaacgaagttcccgctttcgccttcgacaggcacttcgtcgaagtcttccacactttcccttgtctctccgtctgatttctcgtctgggtctccatcctcctgcgctccgtggtgcccgcccaaatcttctttctcgaccttctctccgttcttctctttttcggcacgaaagctgctgaggagcgcctcaagagcgctttcgttaccctctgcaaacgggtcctcttcaacgacaacattctcgaagtcgtccgcagtctcttcctcagactcttcttttgtcactttgtctgcatgtgtttcggtctcggcctgcgtccccgcaggtcctgttgttagtttctcgatcttctccgccgagtccgcagccgatacgaagagcgtcaaggacagagggaaagacctcgcgtttgcttgtggggcactcgcctcccgtggaaaaaaggaagacgctgcgatgtcttgtgcactcgagaccgcatccggctgacgagcactttcccagcatcgcggcctcccctccagcaaagccccacagacaacaacgccggcgacagctccgacgaacactctcctgcgtctccccatcgttctctcacgaaaaacagacgccagccgttcaggtcgcaaaccctatgccctgaacccttccacgtggacgccgagaaacaccgaaaggaatcgcccacacgactcaggaatctgtgttcacagctgcatcaccgcgtaaacagacagtcacacatgcacgtacatcgacagctacgcacaaatacccgtttatatatacatatatagtcttgtttgtatgtccgtaaaataagttcgagcttttagataaaggcagacgttcacaaaccagactgatgaaaggcaccttgggcgcctgtggaatattttgattcgaagaatacttgccgagcaacatttacaggacactcaagccggagccattttccgtctagagagtccttctgacgcttccggaccccgctctgtggacggacgctggtgtcgaaacacgggatgcggaaccgaccagcattattgtctagacatgtagtggtgcagacagtttcgtccatgcaagcgtgtatggtagctcggtctgagaccccacgcagattcgagccccccttcgttgccttcaaaacacctcagaaggaagactcctgccctgggagattccgcagaaagcgttgcccgagcatgcaaacgccgatgtatttttcgaaagaagcacgaacattcagccaagaaaaagcagaaacagaggagaagaactaggaccgagcgcgttcactggaacttggcacgcccagctgccttccgtgtatggcaattcttcgcacatggacatcgaacaaagccaatcccctttggagttgggcacggataaagcatgtgcatgcatgcaggtgaacgtacacaaagagaatatgtggacatacagtttccaactgtattttcacgtgtctgtaggtgccgacgtttgaccgacgaaacggggcgacagggggagcgccctccgcaaccagaggggggtcaaacggaaaaagcaaaggagagatgtatgcatgcaaaacacaaagagaacagagcaagtgcctcaacgtttctgcacgtactagggacgaaaacagtccgaattgtccgcgaacaaaaccccccaaagacgggcaacgtttaaaccgctcccggttggcggcacgggcgcctgtgcacgcgtgcagacaatgtgatctcacgagtgcgacttttttacattcgcgttagtaccgtttcaagtcttcttttgcctctcttgactcttgacgaatgtccgcaggaaagcccctcagaggaaacgtactccgcgcgttcatgctcgctggcagagccggggtcgtcgcgtctcctctttcctgtaaagcgcaaagcccaagcaaaggcgaaacgggttttatcctgggatcaaactggggggaattcacagtcttctcgagcagaaacaaaacggtcttttgtcctcgttttgatggcagggaatccgcgcacgggtgcctgaattgtgaggctcgggagaggctttgaggaggcagcgaaaaagccgagagacccgttctttatgccggtttcttcgggccttctcaacggctggctcgactgcgctgca

SEQ ID NO: 3728 - DNA, 716 bp, Toxoplasma gondii
ggtttctcgaaatgattctttttgggagcctcgctcaccttttctctgtaggagaaaggagagacgcgcgacaaggttcgaacccctcagagaagcgcagctggcgggcagccacagtgacaacaacaaaaagaagaagaagagaagaagaggcatcgtggctgggatggaggagagaagagctgcggcaaaagaaggggacagactgggaagcagcgattcggagaacgaacgtctcctcgctgactaaaggaagcgacggacagaaagcgccgtctcgcgtttctgagcagtggctatcaagagacaacaaggggaagcgggggagaggaagagacaggtttggagagcagtgccgttccgctcctcctgagaggggaagcccggcctacagaccccgcagtgcattgcacaactcgactgcagaagggggacaagcagaacgtggtgaggaacgtttcaattctttttcaggactttgttccagctgcagcgccccccttcggtgtgcatcccctcttccctgttcttttggatgtactttctcgagtgccttttttcatgttcgaccttctggcctctgtgcactttgtcagcaaaaccgtcgagacaagccttcagtctcgcgcggtggagaagaggaggaacgagaggcagagtacagctgagaacccgaagaagacggccaagaaaaaagagaacggtcagatccagga

SEQ ID NO: 3729 - DNA, 4601 bp, Toxoplasma gondii
cgaacttccgagatcccgcagctttctgcagatgttcgagtttcttctgggcgagaatccactccgcgaggcgtcgatttcgcgtctggatgtcctgcagaagcttcgcgttgtgctcacggtgtctgcgcagcggctcagtgacgttgaactggaggtcgcgcttcagcttcgcgtaggctgcgtgtggtgcgtctgcgcgagtcacgcggtggacggcttcccgatacagacatgcgtctcggacgatgcatgcgtcactcttcttcgtcaggtggaggaccgcggcctcggacaggatgctcagacctgtgcagaggtgctcgacgccgtcgaggaagcgcgcgactccgccctggagagcctcgaggctctcgtcaaagcgctggaagtcgcgaaccatgccctcgaacacagggtcctgcgccttcagcgaggtctccagcgagccatgctgcaaccgagacaagaagtacaccaactccgacttgatcgccgacaaagagtcctccatcttcccccgagacgaactactcatcgagacagaaagaacgaggaggacgcgaggggagacgaagctcacactcccgagagacacagggaggaaaaggtcgggggcagagaagaggaaactgaaacgggggagaaaagagaaagagacagaagagaacgagagagaagagaacgagagagaagagggaagtgaaagggggagagagagaagagaggaaagagaaacgagagactgaaggagaggtcggcagaagcgcttagagaggacgggagagcgctgctggagagaggaggcgtcgacctccggcgaaaagcatctttggctgatgctgcctgcgcttcatctctgaggaagaaaagtgagaggtgaaaggccgagaaggagaaagacgggagcggagcaggagaaaacacacacaggggagacgcaaagaagaacgggagagaagctgaaggggagagcaaggggagaaaggaacgagagaaggagagagaagagttgagggtcgacgaaggcgcggaacgaagagaagacaacgatggcgaagagaggaggaaagtgaggaattaaaagaatcaggagaagagttgggcgaagcatatctcgcttgccctctctttttacctggccggcgcgtcgcctctctcaccgaagcgccggccgaatcgggagggcaaagcaagaaacaaaaagggaaacaggaaagccaagactttctcgctttttccagaccctgacacaccacgtcgtcggctgtttcctctgcgccgggcaaacgcaaacgcggcgagtttccgcgacgatgcggtcctcctgtttctgtggcgaggaggacgtacacccgacagctcgacgcggagaggcactcgcttgggtagtctccgaagaatttttgccggagaaaaactccacggcgagagcgaggacgagagaagccgcgaaccgcgcgcgaggaaaagggagctcgcaaaggcgccgctttgctgcccgcccggcgcgccgtcgtcgggccgcggttcttttctcaacccccagcacagacgaagtttttcgctgtccagcgaatcggcaaacagacggaggaagtcagtgaaaagaacggcctggcggagagacctggaggagagaccgggaggagaagaacctgcgaaagaagcgaaagtcaccggcgggattcggaagacgctccagagttttctccggctgtatgtccaccgcgagtcgaactcaaaaacctgaaagttggtggttctccaagccgtcaaaaaacgccgagacaccgcacctaaaacgctgctttcgatgcacagcgcgactctttcgcagctgtcgcttttatgaagcatcactatacatctctgcagttcgacgggagagaaaaccaacggagggaaatgcccgtcaaaacgcgtgattgccaggagaggcgccgttgcagcttccccgtagtcctcgagggagattttccgcgggaaagtcctgcaaaacaaagtcgcttgaggtcttccccagcgagttctccctcccctctgccgaaaaaacaagtgactcaacttcagtggtactgcagtcgcccctcgtcttctcgcctgttgtccccagcgtccgtgtggaggcagttaattcgttgtctaaccaacagacaatctgcacaggcgctctacagaactcgaggcagacagaaatacatcccaaaatataaataaataaatataaataaataaatatatatatatatatatgtacatatgtacacgtcgtatatcatctctaacctgacatacgcataaacatgaaccaaggcaaatacatatatatatatatgtatatccaaatacatatatatatatatatatatgtatatctatgtattatatatatatatatatggccgacggtctttagatcggcatgtagacagtagagggaagcgaaatacctgctcgatcacctctctgtgagcatgtggatgtggagggttgtgtgccagtcgatccggtcacgcacaggctttttccatttagcgctgcatgtctgagacgcgtttctcgctctctctttgtttctcgctctctctctctttgttctcgcgaggcttggcggcgcaggcctgcaagagtagcgaggaagcagagccccaaaaaagcttcaaggcagcagctgtgctctgtgtgttggcgtcccctctcaggccgaacgaggctgttcttttcaccgtcgcaaggcagacctgcgtttcagcttcaaaactccttgcgacgacctctcgcagccgttctttcctgcattcgcaaaggccaagagaggagaactgctcacagacatgagctcttctccacgcagtctcgggttccaaacgctctcgtttaccctggcgcatgcctgagcacacacacacatgcatgcatacgcaaatgtaggcacaccaggaccacggatgcatgcgcgcaaaccacgtacaagtcggcaaaaccgagagcgactgaaattgtcaaggactgccttgcgcttttttttctctccaaagggccacgtgaagcactcgagtctaagcgaagactttcctcatgctgagtcacatctctacctatatatatatatatatatatacatatatatacatatatatattatataatgtattatatataatgtattatatataatgtaatatatatattataatatatatatatatatatattataatatacataatatagtatatataatatatgtaatgtaggatatatgtatatataatatgtaaatgcgtatgagtgtatgtattgagaagttcacgttggccttcccactctgaagaacctttgctccgggcagaaacgcacacaggctgtctgcgagtctgtgctgagactccctgaggagttgagaaagactgtggcttcgaccgtctgcagaaagacgcaactctgcagagtcgagacgaggagaaacagagaaacgcggaggcgccgtgattgttttctgcaggtgattcgcaggccttcttccgcagagccgccatccatctcgactgttccttcctcgctcttagttcttatcgttctctctctatctccctttctttgccttcctctcgctccagtgtctcactctcctgctctttcttttcttctaaacatcacaccgtcccctcgcgcctcccagcttcttttctgtcttgtctcgcgggtgccgagttctgccggggaggccctggacgcgcgcgagacgctccgtttttctggagagagaaaggagtcttttctcgcagggatacccgctcaacggcttttctcttttccccaacgcgtttctccctgttcttccctcacgcactaagggagcggtttgccgcgtccatagtagtttgtggtgcagcttcagagtagactagcgctggcgacagaggtccgcttttcggcggaagaagaccgctggaagagacaagcgcgggtggggggagggtggcgacccgctgaaagcagcaggcagagaaggcggcgcgacgtcctttccttttggacttgtttttgacatgaacatctcctgagcgaagaagtcgagaacagacgcgaggcctcgctctgtcgcagcatgtgtggcggagagcagagggcggccccgtcgcgcctctccacgaagcctcgcccctttcgttccttctgtcttcttttctccccttctttgcttcttgtctctcctcgtcttctttctcctcttctctcctccaattctctcggcggaaacaggacgaattgtccgccgtcagccgcaagacagacaccctacgcggatcgtccgcgtgcgaaccgcgactctgccggcgctgagaggcaggatcgcagagcgcggaccttcttttcaaattcacccgagtccgagaggcgccgaaaacgccctccaatctgctgattgccgtgacaccttgcggcgtcgaaaggctcccgtaaatcttctctcttcttctctctcgtcttctccctcgtcttcttcttctccctcgtcttctcgctctggcgttctccctctctttcgggcctcgttctccgtgtgctgttactcgctggttttttcgcgagga

SEQ ID NO: 3730 - DNA, 1718 bp, Toxoplasma gondii
caaacgaacagggactggaagagcaaagacatatcaacgaagttttctatcctcaacagaaggcctcagctcttccccactgatcattgtgccacacactatggcagatccctgaatccacacacacgcatctatgtcttcattaaggcaaccgataatatatatatatatatatatatatatatatatatatatacatgtgtaaggggacatggtgtatacacgtttatataatcaaatctgtatacaagtatatacatacacatgtatatatatatatatatatatatccgcaagcaggaacgtatgtctacgtttaaagagatagatatatatgggcgtttggatacaaatgacaaaatagaacggagaagagttgagttcgtttagcaatttcagacggtattagatagctcgggatgacaaactgagcctgcttaccgtcaggcacgattttctgctgaagataataggcctcccactccgcattttccctcacgtctggagaagtcagccaaactccattgccctcgccattctttttctccgcgcctttgcctcccttcttcttccccatcttgccgccgagacgtgtaatgcgttagagaagacgaagcaggaaaaacgcaggaaagaagagggaggaaaggaaaggagagacggaagacaaggaagaagagagaagagaggagacggaggactcaactggacaaaaggagagacctaggtcgaagtagaagagacagagaaggcacacacggcaaagcaaggagactggtaagcctgaggcaaagaaagactggaggaggagacacgaaaagaaacaattcagagagcaaagaacagaaacgaagtgcaaggtgaaaaagaacagagcgcgcgcgggacagagagacagacagctgcagccagagtggcaagggaccctgagacaacgaaggaaggtcgaggtcggaagctcggtttaaccaaggcacttttctaggagaagaagaccacgagaacaagaagcagtgaagaaatacctgcaaaagggcagagggacatggagttcagaagcagaaattcggtcaagtttgagaagcgcttcttttccagcgtgcatgcgttgtgccagaagaagcgcgaatcttgctcttccgtcgattcgtgtggggtgtgtttcgtcctccacattttctcaagactaggaagctgtttttcatcgcagctccctctgtatcttattcgtctttctcgctcttttacttttgctgttctctcgagccggagcaatcgtcgctgtgccacacgcaccccagacctctctcaccctgacgcgcgcagaaacgcgtaggagagaccattgagcatatgtattaatactgcgaagataacttgggtgaccaaacctgtcctgaaaaaggactttcttttccttggcaaatcttttcctatcatccacagcgtccccccttgtgcgtttttactccctttccctccctcctcttcgacttctcggtttcccggttttttccagctcgctggttcggctctgcatctgtttccttgccttttccttctggtccaggaccctttctcggctggtttcttagattctctccatctgcactcgtgtgtctctgtcgcgagcttcgcttccctctcctggagtctcctggccctctgtttttcgatatttcgcctctgcgtcactcgctctcctgtttcctccaaaa

SEQ ID NO: 3731 - DNA, 4274 bp, Toxoplasma gondii
aaagtgcattcgtcgtcttctgcaaagcgtacctcttgtccgaacccaaggtgcgacgacggttctaacaggggatcgtggtttagtggtgcgacggggggcacagaagcacagtctgtgactgggactgtaccaggggattccatttgttgcatcggagtcaatccgacaaccacttcttggtcagttctattttcttgggcaccgcatacggtggactgactgtggtggtcgccgacttcttcctcatttttcctgctcactcccaccggagagtccacaaacgaatggcacgagacactcagatcttcgtcctcggaagcaacccgcgcagtctctgaaacagacagacagtgatcggaggtctcagaagggacgtcaggtaccgaatgagaggcgtctgctgggaaagtgttcgtaggttggtcttctgtgcttacagacgaagcgcggatatctgcgtcgaagtgacccagatcttcggcaccgcacttcgcgattagaggcgacgcgtgagcctggccagagcggtctgaagggagaaacagaggtgtcaatacgtcttcatgcaagtgaaaagcgggggcctgtggacctaaatcgcggtcagcactgtcgggataggcttcgccgtacgatgtggcctgggaggcaccagcgaggtcaacaccaccggaaatgcagttggaattcgaaacgtcgcgggataaactggacaaacagtccgctgtcaactcaccctcaggtaaaaggtcctcttctggattgaagacatctctcgggagagtcatcgccggatttttcagacaagcgtcgagttgaggctcgacgctgtctggcagcttccgagctgcgagagagtcaaccgactcgagggtgtccattcttccgctgtccaacgtggaaactgtaccaccaaactgaaacacaggagaaatcctagacggaaaacaacatcgaacaaaatgatataaaaatgaccctagcgagagactcacgtcgagccggcgaccccggttcgccgttgaacacagccaagacagcgcattacctcgtgctggcgcgctggtttcgagaagttgccacaagtgaatttgaaaacagagacgctgaaacaccgagctaaggtcccgcgcggcaacaaaaaaccgtggtaagtcatatgcgcagagccgtaaaactcatgtacaagtttgcgcagctttgtttgttgccgcaatcgcggtgcttcacgagaaccgatgctgccaagaacgacgctcgagggacttgcgcgcgtacaagcgctggcgtcactcgaagcatcaaagacaaggctgagaaagattgggggacagggactactcgaaacagctctagaaatggtgcaaaatgcagtagacgtaaaaacgctttgtgaaggtgggataaaagaggctctcgtagacaaatgacaacaacaagtcccgaacctgccacgccgaacgtcgaactgcgtccgttttcgcctcagcgctccgcgctgcgcgttttcttgcaagcgttcgcttcgagcgtctgtagcacgcgcacctggtgggagctaacggcgcaaacctagaagttcccggtcctgtgtttccctctgcgattttaggtacctcctttagggaaagcaagcgcatgcgtgatattggctcgcgtttctaacacgaaacgagagtaccgtggtcacttgtttaatctcgggcacgcgcatagtgcctctgaggaatgttcgtaggcttgtctagcagtcaggctgctcgtttgaggcatcgcttggcgtcagcaatgctttcaaattgagtgtcgcgcctaattccttatggcttaagcttatgttttggtttcagtcccgcagagctgctggagacattaactggcagacgccacagacaggagtggaaagggaaatcaggccatgttagttgcgccacagtgcaagcgtgaagctcgaaagcttgggaacatcctgcggagacaaagatggcgtatcagtccccagaagctgcagcaagagatgccaacagttgtccgctccttagcgcaagatgcactagattgttgcctgcgtgtttaatggagttctgtgccaaaaggtatgcgtcagcccagcgaaacgatagccgtgtagtttggaaccgcttctggcggacagttgccaagtttcatgacgtaacccccacactcaagcgcatgaagggaatacaatgctgtggcacggtcttcgccagaaacaccagtccgttttgtgacaacacaaaccaataagaccaacagagatgttcacaatgacaggccggatcgcgggagaatcggtatgcgaacaaaccccgtttacggccttggtttttcggttatctcctgagtcttccacggcgaatatgaaagttcaagaatcacgtagaacattcatgcaccgtctggagtatcctcaaacgacctggtgacaccaccagacgaatcagttggagtgttctgctgcatattaattttgtactagagggttttactatcaaaaacagcgatgctcttgactgtctcttcatgtcaggagatcacgacccaaaaacatctgtgacggtaaaaagcatattacggagcttctctgcgcctatattgctccttcatgacaacggctgtgacacgggtgagttgtcttctttctggcttgccgacagtgacacctccagtcaccttaggtgtcagagcgcctaatgcagcttcacccacaaccggtgacctgttcggttttttgtcaacgcaccgcttaccggcgctccacagacaatggataatgaggttgtcagtgtttgaaagtgaaataaaaggccactacttcgaggggtattcgccttcgtgtgcaatttcgctgcttatcacgaacactcgggtatcttcttctgtaatgccgagtttaaaagccttttagcactgatacacttaagcattctgctattgcagatgcttcaacactattcctgcatatacccgacgcgatctggtgcttgccttgccacacacgcacgaactgccgtgagcggttccatatccgcatccgttgccgaaagccactgtatgggacttcgcgcgtcgtcaggtaatgtgattcctgtgaagaatcgggaaatctattgtcaaaaaccgcacacatccttgcgagtgtgcacttctacacttcaatcgacagaatcgattctacaaaaacccgcgtagacgagaagtgacgttctagatttcctgtcccacgtgcacctaggcaatcggtttcgtcacaccaaatgccgctgcccgccacatcaacatccacataagtcacaagagcgttcttgctattgtttgttgtctgtaagagagcttagatttctcacggtgccaagacagtgctttctgaccggctctcggtgcacacggggtggcttctgctgcacttttgcctcacctctgaactattataaggcaggtgcctggtgcgaagtgtttagcagcaaccttcgcaccgaaatcacgtgaccagcttctcgtttcacgtgagttccccttcctgcagccggcgatcggtctttttagtgttagcgacggtagtggtacgatccagaaactccagcaaccctttccagctggcaggctttccatcactgcattctttctgtttcgaaaaaagaggtttgggggaaatgaccagcatagatcgctggctatagttgcttgcctaattctgaggaggacatctgtctcgaggaatcgaagcccctcgcatgtgagttatttgtctcctcccacatgcgccgacatgacagtcaatttcgtgcatcgctccgagctgcaggggaaaagacggtgcatgtgcatgctttaccccccgtcccgcggtggcaactgttgtcagcactgtatgtcctaaaagacggccgctgccaatggacggcaaaagcagcttcacgaggacgggcagggaacgaaggaatttaagattcaattcaacatccgcaatccacctgcttgacccacagcagccagttcgcgaaggcggaggcgtgtcccgtttcgagggtctctgttagtcagacgcttggcaatatcgttctctaaagtacacggacaaaaggagggttttggcttacttattctgttgctgcacaaacgttccactatgtcggtcggagagcagcacttttgtttctcgctcggtctgggaccggttcccggcgccgtcgaccccgtgtaggaattgcctccagggcttgatttcgggactttagacgctcgcaata

SEQ ID NO: 3732 - DNA, 4474 bp, Toxoplasma gondii
atctgtccgagaagcgacgctcggatgctccacataaaagtctttttcgatcggggccaactgctcttcactccactttggctcgacgaggtgcgaccccatcgcccctgcgtcgtacctccctcggcggctcccatcctgactcagctggctgtggcgccaaggtgcctcagtgcctcgcgaccgctggtcgccgtaaccaggtgcgtggccccgccggggtcccgccccggggcctgaggcccagggacccgcggggctgccagggtacccggggttgggcgcgtagccgcccggtggcgggtacggggcgcctgcttgggcgccgtaagaagggcagggggctggggggctgtatgtgggggcgccgaagcctgtggcattctgtcctccgtacacactgtagctagggtcgtgcttggggggagggtacgcgttatgagggggttggagcggcgcatacgcgtgaggctggccctgggagtaggaaggatcataggagggagggaacgcctggtcagagggcgacgtcaccggtcccaggtcaggagaatacgaggaaggcgagtaggggtacggacaagaatcagaggagaggggaggaagcgcttgacctgtgtatgcgggggggttgacggaggcgaaagaactcttggggtcgctgtagtaggctggaccgttccctcccgctgcacccgggtgctcgggggagctgccgcctgacgcgtattgggggtccgtttcacttctcggcatggacgagaaaaggcgggtcgaggggaatgctgaaagatactggtaaaacgctaccctatagctgtcggggcttccggctggggccggacgacagtgccacgaagggaggcgaggagccacacgagacacggaggcagacactcgagatgtgcctctgggggcgcctgatccttctcgcggaaaaaccgttggaaagattgttcgcaaactctcgctctttctcgaagcgaaacgacacggtcctggcccggcgacgcgggctgaccgggaccgcgcctggcttgcgagcccccacatgatgcttatgctttgcggcacggaaggaagcacctcgtttttagtgaatcgaaacggttccaaaacagagaaaaatcggtgcagcgtcttcaggaagaaaggttctctgagctacgtcgacgcacaatcgtcactcaacacccacgctgaacggcgcatgcgggcgatacactgagtgagcaatgcgtgatcttcagaacacgaacaaccacacgtttcaggccaaagactgggctttaaagaagaagaagaagaaccgctgttcactccgacaatgaagaaaatggcaagcaaaagaagacgacgaccgaggatccgccggtctcaatcgagatcataactgcggggctggagccgatgttgaaacaatctaacgatcagaggagaggcaaaaggctcctcccacatgacagacgaagcaacaccaacgaggacagcacaaagaacggtaatttgtctctcaagagagagtgagcgcatgtagaccgtcctggcatgactttttgtcgacagccacatgcgctctccgcgaaaagcagacacacttgaggggagcctgaccgccgagcacaactgcatctcgtcgttcgagagtgtggaagcgacaacgcgctcgctgcttgtttagggaaaagccgggaatatcgctgataccgaaatcggatctcctgacttcttcatgttatacgatgagctctgtgtttctggaggggctgtcaaagtagttttccatcaatcaattcccacaaaatgtaaaagtccgaggcagtaaagaaataggaggtagcatgtaacgtttacacacaggagctaccgtcaagttcggtaatcttctgcgtatacacacttcgatgcgtcagcacttgggccgcaagcgatgataactctctcacagaagaagttcttgcatgcctgctgttgttcaaggggttgaaggctgacaggcaacgttttccgaagctgggtacaggtattccaatgcaccggtgctctacagaggtagacataacatgctatcccttcaaagaaagggtttacatgtatggattgacgcgatcagcgcgcgcctgccgtaagaagagataccatttgcgtggttaaaggaagaaggcgtctttttcggtgacaattagcatatgtgcgtgtgtgtgtggtgcctgggatgggaacgagcaggtggacgggtgcaagcacgactctcagaaaatatagtgaacataacatgacagatgtggctctgatttctctgaaatcacgcagcgagggtcacattaggtaaagttgctgaggtgggagcgctgtcatatatccaaagcctccgagccggcttcatcggctacatcacttgcttacatttggtagtgttacattcgtgggcggcaaccctgtgacgtgtacacttggattctgcagttaatcaagtaatatgctcaactggatggctgttatcattggaacgagttaccgtccgcgatctgagcagaagtgttcggctggcagcaggcaggttatcgtctaaagtcccggaggacgtggaacatttaaaacaaataaatgagtgcatggaagatggtgtcgaggaagggacaggacaaggtaaggatacgagttcgaagaatcatgcaaaaacttgaagagcaaaaaagcaagtacaggaggaggtaagaatggatgaagaaagagagagaggcaatcacctaatctggctattgtcgagcggcatctgtcccaaacgggggctgcgccatgcagacggtcccaacaagcctgtcgaagatcgacagcaatcttcccttgtggagttcccgtagcagtcatcctaacatttgtgcactgtagtctcattgagcaaggcttcttgtgcgacgaccatttggagacgtttcttggatctttccagcaatctgctgttttcgatgttctcctgttctcatgcatccaggggcaaaggtattgtgcgctgtcagctcgtcgagagaaaccaagtctttcacctcactgcttccacaactaaagtgaccctgcgaatgtccctattgagatcgtggtgtgttagaaactcactgaataatgcgaaatatgcgtgggtgctggtgtgggcaggaaaatccagctacgaggcgctggcactctctatttattcacgcgcggtagcggacggagaagcatcttgctttaaaattgtttcggtggatttcgagagaaggctactgtagtgagggctacgtcccactacttctctgggaaacctgccttctcgctaacggcgaatgttgtgtgtgtcacgccccacccctcctctctgatctggtgtttaacagcgttgttcacgttcacgccacggaatcatcatttcttaccagcgtgtaagcgagtaactctgtttcttttttcattcggtctatatgaatacgttttccttcagagggcacttaacgcgtacacggttctgtcaagaaggggaaccaagttccccttcaagcaagtgcggtacggtgtaaagggatgtgaccgcatcaatgaataaaacgaaaaacgaacactcagtgtcgccttccggttcaatcgagctacacgaaacatgtcgccgtatagaaggatactggaaagcgatcataccaataagtgtcaccttcctgccgatcattgtagccggaagggtatgcaggaggctacctttctcagtgtcacatttcttctctaaacggatgccttctgaatgaacctgatcttctttattcccgatgggggatgaccagctaacacttattcagagatatgctagtgagcacacgtgcgacgatgaagtctttgttttgtcatatgtcagagcagctcaatacgtggggggcgggcacgcttgcgaaaagcggttcccgtatcctcatccgcgatgaattcacactcgactacagctgtgacaatcaaagtgagacgggcttatttcttctttaaagatcaccgcctttcctttatgtcaaaagggttaccggtatacggaacatttcgaaacgcttgcatctgacgaacgccaacacaacctgcattcagctcttccattcggtttactaagctcgctgtgagatctcccatttgtcggcaataagcgacaagagcgccatgcaaaatatattttaagttgttcgcttgcagcaggagtcactgtctctgcaccagtgtacagaccgcctttacagtgacagtgcgttcgtttccatctcctgaaacgtgtttagggtatgttccgcttcacacgcaccaaagctcgctactaggcttgggatatcaatgcatcgaggttcgcactttatcccctaagtactttcgaaccgtcaatgtgtatagcgacctcgtatatacaaatggtggccctcggataccgacactttgccacattaccaagggaaatctctaaaaacga

SEQ ID NO: 3733 - DNA, 3695 bp, Toxoplasma gondii
caggcatcgtgaacaacgggagagacgatggaagcgcagtggagaggagggagaggtgaaagagacggagaggaagagaggatgagaaggcagcgagagagagagaagaaccgacgcccgtgcacggttctcttgtctccagagtggggattctctcccgcttcttgaccgactctggcgcgcgttctctcttttctctcgcaaaagactcctctcgcgccctaccgccgcggcagcaacaagtctggtctcttgcagcgagcgcctccgtcgaagtgatctgaaccggacgcgaaggtgaaaacgcaacgccgagccgcgtgaggcctcgttcgcctctcttcagatcctagacaagccaggcaaactatcgcgaactgtcgcagggagaaaacgaattcatcagagacagcgcgggcgtggagaacaaagaacggacgatcgaggaagacagtgtggacgagggcacagttccggcctcgaagaaagggatttcctgtagagcacgaaggtgcatgcaggggaagaacgagggagaagtgacaaccccgcgggggaggagggagtgacaacggacgacggaggaaaccgtttagagtttccggaaacgggctgattctgagccgcggcaaaacgcaaagtaagaaaacgattcgaaagagtcgaaagcaagcgaagaggtcagcggaccgttcccgacgacagccgcagacagaggcctgccggatggcggaaccgttttcctcccgagtacgtgaacaggaaaatacgacgacaacggggaggtgcgaggaagaaaggagcagaacagcctcagaagacagcagacagaatgccgagttttgtgcaggaaacgcacgaaacggagaagccccacagagaagctggggaggcagctgagcgctgacgcctccagacgtgtctgcagcagccgtggaaacgagaagatttgaggaaattgaagaacgcggaggagaacgaaacgtgaaaaacgctttggatccacgcgagagaagcaaaatggtcagaactccgagtccgtttccagcaagtctgaatcgggaacaaggaatgacggggtccacaggaaatccttccacttttcccgacagatcgacaaaaagtaaaaaaccgtaaaacactttggacgagaaaatagagacctggatctgcccttctgcagagtttcctcttccctagttgccaggatcgacgttcgctcccgggggaaaaaacgcaccggcagtggacgcaggcgttgcggcgagacagcttcgcggaaaagagacacaaagagaggaaagaaaaaaagcgcgagcgaaggggaaggcagaggccgtcccgccaaagtccgagaaaaatggcaaacgcggagaacaggggaaacagctccgccggcggcgtgtgagaggaaagtgaaactgcatgcagagccgcctacacgcgctttcggtttcgcgtgaaacagcgcactgcttccgcaagtcccagtctgggaacaggagctgttttccgtcttcagtctttgcttcttgcgaaaaaattcgcacgagcaacgcgaagctgccgcgaagaagacctgggttcatgtccctagtcacacaccaggggtcacacggaggccagaaaactaacagccggcgctgctgggcgagagactgcaccgcagaaggaaagtcgttccacttttgcagaaactcgtggcctggccgtgatggtgattcaggagttgtggagagtgtgatttccgcgaatggagggtcatgcgcagtggagggtttcccttttacacgcgtcctgcaggaagggaggccgccgcacacggcgacttggtccagggcggattgtctcgctcctagaaaaaactctgttttctatgaagaaaggaggttgtgcgtcggactgtagaggatacgtgtctgctcgcgttatgtgcctattaacactctcgggtcagggctatgcagacctcccaaccgaggagaaagttgtccaagggaagtcggcaacccactggacgactaggctacgggattccgacactccacaagctctgttcagcgggtactatactgccaaggtgtttccgtcagctttgcctcctttcctggttcgcagcgagcccagaaaagaggtgaaaagaagacaaaccttcacttttgcacagttccgtctgctcccaacttccccagagtttcacttgtagtccagtgtcccgttctgcccactcagaacttgacatagaaagtcacattccatacacacgcacggacacaccaggaaatgccaccggccacaagaagtcgcagagtctatggagttaacgttctgcgcgaatccaagcgtttgtgtcatgctcgttcttgtacgtttgtttttctgcaccggtgtgatttagtaaggcgctagcaaatgcacaagactttggcagcacaagttggcctgtgttcacaggagaaatcccaacaatgtaaaagtgtaaagctgagtttacagggggtgtgcgactgggataccactgagaatgctgccttatttcgatcagagctgttcaactgaaaagaagtcactactttgtttggttgacttgcgggcggaaacactgcggaccacagatgcctacgcaacaaggaccacctttaaggaagctgaggtgaaatgccatctggattgccgggggatccgggacgagcgactccgagagaaaattcgtggaacgcatttcaaacaactgaagcgtaagacacacgaggctggtggtgaaagagggcgcgaagaagtgccggtaatagtgtggagcacggcaaaagggtgtagacagccccgtacgaccatccagatatttcttacaaccttgttgtcatgtgtgcagatgtagagacattcgcggggcagaatggctgtgctatgatggcagaattgttgcttatcttgcggtgtgggccttcagcgcggagcctctgtgcacatatgttgcgtcttccaatgcttcgtcaacaactgcgaacagaacgttgtgctggcattcggttgtcaggatatcccgctccttttccctttaaacgaaagaagaaaggaaagcaccacatcgaagtcccttgacggtccctgacgtctctcgcagcattgatcagatccacgaagcagcttcctaagtggcagttttttcctatgcgatgatgtttactcgagggatcgttgcatgtagccttctgcattatggtcttcgagtcgtactgcctgcaagctctatttgaaattatcgaccgggcgccttgtttgtttcacagcatgtgacacccgcagcgggggcgtcagaagccccattaattactctttaaaatgccacatcagctccatgtcaacgcctgtataattctactcaaaagctgcttctctggtcgggaatttcaggttcgcaacgagccggcgtctttctgagactctctcgtctgcttcaacacaagaaatcaacatagcgtattgcatcgcactccgcccgcaattctgtggctctgttcctggaattacgaacggtggagtggaagtatccggataccacgaaagcgaatgggtgggacgagggtgtctaccgacgacggtacagaagcagagaaagcgtatgaaacattccatgttgacgtatgataagctaaagtccaatctgcgtccccacagcactgtccctttcacca

SEQ ID NO: 3734 - DNA, 4797 bp, Toxoplasma gondii
cttcctccacctggagcatttgttccatcatttctcttctagcagcacttgcctcctcttcctctcgctcaccattgttcgtgatgtcctttccatgctctcccgcgttcctccctgtcccgcgatccgcatgactcgccacactgttcgggcgggcagaggagaaaggcataccgttctcattcgctgtgttgcctcgagatgcaaataaggccatcgacgactccaaacgcgatgtgcctttcaggccgtgagagcttcgtacgtgcctgtcattaccgtcacgcgtacgcgcctctgcctcgcgagaaagtcgcttcatttcaccgcaggaaggctgctgagtccagtccggaaccgaccctgtgaagctgttcctttcattcttagacgagaaaggcatgcgctcgaccaaatggggctctgttgaggctccactgtcgtccgaaacacagggaacggttccggaagtagagccgcagcattcgacgccaatgttggtcgctgaacccgacgagaatctttcggtgaccgtaccgtcgctttcgcagagaccacggcaccctccttcacggtcacggtatctcccgcaatcctctgcgtgcaggggacgacggccgccagtccgagtgccagcaaacggaatgacactgttctgcattggtaatgtcgaagaaatgagagaaggcgacgaaagaaaagcccctgaccacacctcacatgaggcgggagaatccggcttctcactggttgagactaattgttcatccaactgtggtgtgttgccttccattatcgtcgacgggccacgagagactacgttccgcttttgcagtttgcaagcagggtggattaagattgcgacgaattcttcacttgggaacgcctgcaggacagtcttccgagagatcctggcctcagttaccctcgacgactgccggcgccctggatgccgcggcgggctaaacaacactcgagctgagcaagcacacgaaactgaaaaaatgttcacatctggtcacttaagaacacccaagatgacatagggaagccgcgacggcaacgcgtcggtgatgggaaatcgaaatcaaagcagctgtcgacttcaccggggcggatcaacaagatgtcactggcgcagaaacgggcgggaaaactgccagggaaaggcgtgacgcggccgaggtccagccaacagcttgaaatgtgtgtaatatggctctcggcgctttccagttgaaggggaaaaacggaatgcgtgacagctgctctcaaaagtgtggtgcggacggctggtacgaataaacagcctgcctgtaacacatcaattgaacgcgggtgccagctgcagcctgtgcttcgagaaccggcgccgcacaccaggtaataaaaacacacaacatacgcaaacaaggcgttgccagtcgtgtgccgcagtcgggaaacgctttcgacgcgccgcggacggactgaaatgacttgcagtgtgccagtcacactgagacgagagacgcgcactcactcaatggtcacctggggtgtctttacaccgttgtgggaccagctgtccgcagtttctgttcttcacctcttgttgaagtcaccgcagtacgaatgacgcatcgccgatttccgtttttgtcacagcgctcgcacacccgtctgtttctaggccagaaaacaagcgtgcccaacaccgctgccgccgaaagacacgcacacctgcatgcctccgaaagtgaaacagcgctcgcgaagcaccgctgtcgtatcgggtacaactcatgccagttgtagctctggaattcagaaaacagagaccgtcaattgaatactggaaatgttccacgcggaactttggaaatggaacactaaaacgcgtctgatgtgacaaagaaaagaaacagtcaccagcccgatgacccgctccacacgagaaacgccgagagtgcgcgaaggtgggcagagtgggtgacgctctgacgagcaactgtgcagctttgccccgtcacagacgggtttcctcacggatacggctgctgtggagagccacttgactgacagcagagaagaagagcgaactgcctgttagtgcgaggctccgctcacgctttaaactgtggcagttctacctgagggggctgcattatcctgcaacaagaaaagaaagactgcagtgactggactgccatggaggagccacttttttggcattttttcgtggtcaacatcctccgtacgctccaacgtggtatcatgttcgcttgctgcgctgtgcagtgcgaaaggttcatcgaatgctacaacaaatatctagctactactgaaaaactcacccccggggggcatcctaattggtcccggccttgcgacaaccagctctgacatttaccgtggagaacgatgattgcgtgacacacgcatgagtcccgacaacgaatcgaaactgcaactccattttcggtacttccttcggcagtttatgcatcgtgtgaacgctactcctagttgtccgaaggcttctgtgccttgttcagcatttgctttttcctgactgcagccagaagcgtgtagtccgcgtcggattagcgcggctaggatgatacacaccagaaaactggaatgctttgcggttgccccgtttgcgagagttggagcagctgtctcgggggaagcttaaccaacataagtgtatccgcttgatctccggctaacgcggaagcgcagtgccgcagcccgtcaaaggcacaacgttgcctcattgacgatcagtggccaaacgagcttaaagtttgattgtggtacgatccgctatagactgtcatttcatccacaatttgcgcctacagaattttgaggaacgctttttcggggtgccctgacgtcggcattacctgcattcgggcacacctccggatttgaagttggtacaagcacacctctagcgtcattcgaagtagaggcacagagagcccgggatagtgttttgtcaagcctacgctccatgagtgaaaaacacttcgggcaaggctcggaaatgcattctatggcatccacccttctttcgtgcgtttgccccgtcagtatcgcgccaattctctgcatgccgaggagtcgctcaggctttccacagcgtctgaatgcgtgccacgtttcatgtgggatcttggaattcaagacgatttcccccctttttcaaattgtgtattttgctccctttcacatcacatcgtcaaacggtcacaccagtagtagccagcgataacggaagtagtggcttgctgttcttgtgcgtcactggtggcagcctgtttcaagatatgaactacaaagttgcctataacgcatatgaaactgttggtcaaaaaacagcttcattttgacggtgacaatcagagtctctcagacactggcgagttccattcggagaaagagaggattatcaggttcggcaagagacttctgtattcacacttttatccggcaagcagtgttaagactgtccacgcgtgcaaacagcacaagatgacgttggccattctagtacgccatgctgactcaccgccagctggcatatccagaaaacgctcctcgggtacatactttttgccgttgcaagaattatagaagttgccagccacagtcccgttcttctactcttggcaaatctggtttcaacttacggtggagactagtagcaacagtccagccgctcacactgatgccatcttcgaccctcagtatttttagtgaagtacaggtcccaaatgatttttcccatgcgatgaaagatctcgccttcatagagcaagaagaatatccccacatgaggttcggcagcaggtcgtagaagcaacagagacgtttttacgcttcactgtcagtatacgctgttcgacacagaatcttgtgtgcggaaaatgacaccgccttccgctgtgaaatcggtgcaagacgacactacataacggaagtttttcctctgtgtgttggtgggagagaagtaagcgcgttatacacgatgctggaagccaaacgcgaagacttcgcaagagcacggaaaccctaaacacttgtgttgggcagtagagaggaaaccttcaggaaaagacaaagatctcgacggactgcagcacgaaaacgccgcctctcggcggcgtgagccatttcctattctaaagattatgacaaaatttgcagattttcccattttagttcaacaaaccgcgcatgcagcagtcgcgtaacagcactgtgacttctaccgcatgcgccaagcttcccggaaattttctcgtgatacgccttacaacgatacgtttcccgtatcattctccgccttttgctcagttgtttactgtgtgtattcgtcgcattccccaaggtgctgcctgtgtcatggtcgccgaattgtttgcctcgtttgccgttggctgctgacaagtgattctcttccgtctggagctagcggcatgtcgtatctccccttcacatgaacacgtaaaagatctttttttcgcttcaacgcaggactgtacaccggcattctactctctgctaagccccggagtctttccccactgtccacaccggcacagtccaaccataattcctcttttctgtcgagtgcctcaactgctgttcacggtgttttttccgctttccttgcttcccttcttggaagacctcggaccggaaaggctgtagacctaaacgaactcgtgacaaataacgggaaggcgaggcacagatgtaagcggcggtcattcacgtgctctttgtgtatctgtgcgtgca

SEQ ID NO: 3735 - DNA, 2370 bp, Toxoplasma gondii
gagaggaacatcgctgtcatgctcacgccatgtacttgaattaaatgactttgttatcgagatcctccggtttctagatcttctcacttgttactaggacagactcacaggtaggaggtgcaaggttgccgcactggcagtgcgaaccggttgttcgatgttcgtaacacggtgagcagtcctgtgtgtatgtcgacaacgaggctgtagtcacagcgtcctgcatcagctgccagtgcttcgacagtgatataaaaaaatagtgttgatatgttaacatatgcaaggcttattcaattgtacctatacgcccaccccataccatcaagacatggaatcacacgtacaagaagcagcccatgtgcttctcttcgagacgtatggggtagtagaaatgcacatgcctggatccggcatacataaggatatcgagcttcggtgttaggggctgacatgagaatgattagcaaacacataccaatagcaaacgtacaacgtctctgagattacattatcgcgctgccgttagcgtacctttcgcaagcgcaccttaaatcgggtcatcgtcggttttacctggaactcctggtggcgatcagctctgacgaaccaatccacagtctcggatagtccagtctctgacccgtgaggcattaccggaaaaaactctgtctaggatatgtctgtgaatatcaaacggaactgagcgtttagcaacaccgcgtaccatttgtctcttttgaggctaccttttgtgcttccacctcacttgtcacgaagagtgatcttgctccccgcctgtagcggacgcgtaaatgggattagcgatgtcagaggaggtttgaggctcggggtgctcgtacacaaagaacgaccagcggtaagtcccatgctcaagaatatcagcattctatggatgcaatcagtgctagagccgtaggtcttaactgacttatgttaacgctaccattgaggtcaccgtgttttgctatgatgcatctgcacattatttttaaattgttgacgggtcttgtggcctgttgtagcttacacatcggaaaatagagggaccctcatagtgactttcgtgtgttaaagggcgctttgctgcagactgacgttgagtatacaactgaggtggcgggctaaatcgtgcgagtgttacactcgccgtccgcctcttaccgcgtatctgcgaacatacagtgttgtcgtaaaccaaaactcagaagtccttgcttcaaaagcgtcgacttgccagacaacactgcttaggattacatcacccatgcggtccgctgccgtcgggagcttgagtgccgtaattctgggctgcttatttcaactacagatacacgctatgccgaccgccagtacctctccaatttgagcctcttctgtggaattcgatgtggcgattattcgatggaagcggacagttcgtacctcctacagattccggttgtgacaaattgtctgcatcttcccggccccaggcagttagtttgaactctgaaggtacacgctgagaatccgattaccaaggcacccacagagttgtggcaggttgacatccgtcaaggccctgttttttccattgttcctctgcatcttctgtcttggatatatcactacttccctcattcaagccagttggagtgtcgctgtcttggtctcgcgcctgctgatctggatcaatttgagcctccgcgccgccgatgcacgactaactcccccctcatcgaacgcgaactgccgcaccgtttcggccgtcgggttgatacaaaattcacgaattgctacacgagtggccgacgtggaatggagcaggcgcacatccgctcgcaaattgcagacaaattcgcaaggcagttgcctcaaggctctcgacttcaatgcgtggatgtcgagctacaaactcgtatgtgttatccaaatgaacgggcaagtctgagaggtggcagatgtctttggtcgcagaggcggcgtttagcatgcccacaacgatcttgcgcaaggcataaaacgtaaatagttcgtggtgagtgagcgtcggcttcctttcttacgagttttgaaacagagattgtttctgaatctgctgtctaaaatttcgcgatgtgtagcacgttcggcggtggctgtcctcctttttaaaaggtgtattgtcggttcgctgagcgagctacgtcctctcgacagggtttctggactaacgcgcgtctcggtcatatgcactccatagttcacttctttcatcggtttctctgattcagtagcttcatgtagtcgcgcgaaaattctgtatctcacaacggaaaaccattcgacgcactccggtgtcaaggcgtccagtcacttcttcctcga

SEQ ID NO: 3736 - DNA, 2264 bp, Toxoplasma gondii
gtttctgcagatgggacaccgacatctgtagaaatagatactgcgcgagctgtcgagcagctgtagatggcatgtcgtcggtctatatggagcgcactcggggccgctgtttgagtttgagatctccaccagatgtttggggacgtgaaattgcgttgtgttggaactggatggcagtctaccgtgaggggttgcaggccataactttggttcctctgtgacatctcagcaggggctgattgccaaacttcctatcactggatttctaatatgagtgtagtttcgtgatggcggtgttgaaacaccagagacttgtcgcatggggatgtgccacctgatatttgctgagatgcagcctcatagatggtagaccgtcttaccatctaggcaacatgctcccactaactagagggcggttcagtcttttcgcaatttccttagacatacattctcgaactcgtctcagcgttaattccaacggttttagatgagccaaaatcaacaccagcaaacacggtgtgtccagtcatgcgtcagcgtctgataggcaaccagaagacttctcatctcacggtgtatgtggtacagaccctctcttaaaacctgatccaaagcgatgttttcatgtgacgtacaatgaatgacaccaggaggtagaagaagcgtaacaatagttttttttatggggaaaaagctgtacaccggcggaagagataagagcactgcgcggaagccttgtaaaatccttggggtatgctgtgcaattgatttcccgaacacgagtacctcttgttgaaacacgactgtggaagtagcttggttcaatcctgtattcagaggcatgccacgacagtgcagccgtggtctcagaggctgacgaatacgggagcttcactgtagattggcaaacagggatgtcctaatatagttatgctcaaaaggagtttggctccacctcttcacggagcctgctgctacagcactctaataaaacatgcttcatgtaggcctgtaacttcatagaaggtggtgtctgacatcgaaacgagtgcaagggccactcattttgaggggggcctacattaaatatacctgcgttccagactggagcgacgcctggctgcacatgtgcattcttgcttgtccatgaagtgaattttgagtttttttcttattaggatggacaggtgacgtgaaggatttcgttgtgaagtggaccaattactggcacaccacctttcagagactcggttacgttgatgcgtcttccccgagagtgcggtgggcccgtgaagcacaatgagctgagatacaaccacccttgagcgggcttctgcacagtgaatgacagaatatgtagtctgtcgaagcgggttcttccaccctgtcggcgccgtctgcagcgtttcctcgttggagctacagtcagcgtgtcggcagcaaagttccggttaaccaataatcgcccttcaattagcccttttctctgtggggccaatacagcgaccggagacgtgcgtaaacacaagaacgacgagaacgtgtttgttcctttcaaggaaattaggctcctggtgctttagagctttcccatctttcttttaaaactccgtcccgtcagtcgcgttgtaagtagaaacacccatacatattgatattcaacgtcgaaagggaccagagatcagtgcgatccttccgcaaccgcacgacgtgtttcggagacacactcttccatctgttgctgggtgactgtttctgctgtccctaggcggtcttttgctgtagtccggggcatttgctactctaattggttgaccgcttctccagtacgcctgtgttttcgtataggctggtgtacactcgacgtggcagtacactgtagagatagacgagcagctgctgcctcgttctgtaaagcatgtgtcgccatgatttcttcgaaaaatctgttatccccgatagggcttttcgcttcgttccgtggaactgaacgccacttatatcccgcggtgtaaaagactttcaagcgatgtcgaacactcagtgggaattacgaatagcagccgccactcggcgtgtgactgatgcgtgccgtcaagcagggcaccccgtacctgacatttacgcagcgtactgcctgtgtacaacaacatgtagtgaggaaaaagatttccttatagataaactgctttccaaagaagatctcgatgaaggtgacatactgagggtggctgatcgaattcagcaaaacgtgggccctggga

SEQ ID NO: 3737 - DNA, 2002 bp, Toxoplasma gondii
acaaatctggaaaacactgagtgggcagatccgcgcatctccttaacgtatccggcatttctttaggggctgagaaaacagaggatgaatcgaaaactttaagatctccacctgcagcagtaccacgagtcgttggtaacaaggaatccacgaacgcgaacagtctgcataactgctgaacacaacgccaccccacgagaatgctcaagacagctacaagtggtggacttcagttttccaacacaatacagttagttcatatcgaagcatgctctgctaaaacatcgcacttggacccggtgaacaaaggccagtctaaaccggtagtccaactagtagcaagacacacgcgacggcctccggccaacggcgaaagctgacaaatccaggggtgggcagcagacatggacagataggaaataatttctcgtcagttcgtcttcaagctcttggctatcgcagacgctgatagcatgtgctttcgagatgacacaaaagtaaccgactgctactgaacaggggaccaccgtgacttgtaggagggagagagtccgacagtggtaggtgacggccgacacgcataaagtggagaaggcaaaaacgaagagtgacacaggatacctggtggccgaagaaaaagaacattcatggtccccgcgacgacgtgcacatccgcggcgggagcgagttacaaagactcggcggattgaaaaaggagactgtcactgcacctagagaaacacagcctcgaggtgagtcttccgacctttgtgaaaggtgtggcgcgttagatcttgcgtgactggaagcccacaatgtgtgttttctacatcatctgtcccgataaaatcgcccgtatgttctatccagatgtgtcatcgagctagttgtccatgccagctctttccccgtggtcacccaccacgccttctcgaacaccagagatgcagtccgttgaaacttaccatctttcatggggaattagtcgagggaggcggtagaattcgaacacgcagagtaggtcttgttgctgtgcggagccacgagatggaggatgatgatggtgcaatcgttgatatcacacacaacgatgcgctcggcacgcagtgccaagatcgccgagtgctgttcaatacggtaaagatgctaggtcgcctttcgaaaaggggatgctaaagaaattattttgttgagcaccagtcactggagtgtgcatgcatcagtttcaggtgaaaacgcttcacgaacagttgttaggcgggtcgcattcgctgtttccgaccccactctactaccactgagcacgtgcctgtgcagcctaaaaagctggtggtaggaaagtgccatcctagaaaacaaattcggcgagtcttattcagagtagtttgtgaccggcagccccgcgtgtctggaaattgtttttgctctgtacagagtatcgatgtggccagcaaacggtgatactctccggttttcgcccccgcgtctctcgatgtcaccaggtctgcacagcgaaacgactacggaactggctctgctcttctcgtccacggcaacttgcggcgaatgccattacagaaggcaacgcaatgttgcttgcacagacttcagaagcatctgcgccatcaatcaccattgccgtggataacttttcttcggtaagtggcggggacatgagaattgtaactcagcaacgagcagaagcgcggattgcactagaagcaccagcagtacgcttttccctagctggggtcaccatctctcgggtcccgggtcacctccacatcccggcgactcaaagctgcgacacacccgaatcgaactttgctgagagccggctactgagtcattcggcgcgtctctagactgtccaccgcttcgagtagtcttcctgaatgatcaatggcgtcacagaaggccaagtgtaatggagcaaactaggcagttgtgagagtctgtttgttcgattcagttccacttacctcttcgtgagaaaaagaaa

SEQ ID NO: 3738 - DNA, 4647 bp, Toxoplasma gondii
aaatgtcagtagcgcatccaactgtgcccgaacagttgcctgctcttcctccagtgacgccacgtagtcttcttcttgtgacagcgtgccatctcggcgcgtgcttcctgttgatcttttttgtgcggaccctcgcgggggcgcagacgcttgagtgcgaacctgcggaagcggacaccgagagcagcaaaaataaggaaatgcgacggaacgaagcgggaatgtggaaccggaactgaaccgtttttcgcattttctcctctatggtgaaattcacccttcgcgccagaggttgagtgggagtgacaatgagccgacggcacttccaccacagaaagtgaacagagcaagcagaccacgatcagcccacagactaaactattacgaagccgtggttgcactccatacgccctagtgggacacttaagctgaaaagaacagccttacagatgggcgtgacaaccaactttgtcacacaaggcgtcactgtaggtatttcctcggggacaccacacggctgtattgcacacaaaacaccgtctttcttatcgaactcagggcggcgctctcgtcgttacacttgtcgtcacgagggagtaaatgacatacctccgcaccactaatgggggcatcagatgaagcagccgccaaagccgcactctgaagctctgcaagtctctcccttaactggcgtgctgatggccatgtatcccctttctgaaccatcggagagatgacctccgtgtatagacgctcgaactggcgccccccccatgcagatttcggaggagagaatcccgagaccccgcaagtactcgaagatccggaagaagacgaagcagatattccttgttgcccagatagtgcctgcgtagtgccgcttgcagcattggcaggcgcagccggagtagctgtgagcagagaggatcctggtgcagcatgtgcatttgtcatcgccggttttgcggacaagcttcctgttgttgccgagccccctccgaataaattcgaagaggtgggctggcttgaattgccaaacaacccgccaccggagcttgccatccttctgccgacggagcgagggagggcgtccgcccggaatgcgaaaagtgttgtccgaagagagtcagagaaacatatggatcgtgaatgctggaagcaggaaaaaagagtctgagatagagatgattttaaagagtgagaggtggagtgaacgcaagagacagattggaagccactggttttgatgcacacccgttggctgccaagtggggataaacgaaggatcaagatggcacgctgctactgtgtggtctctacctcaagtggcgtcagacgtttatcacggtaaacggttttcaggctgcagttagctataaatcaacgggcattttcgacaaagatcgagacgaaaaatgttgcccccagcccggctgtgcatgtcttggacctgcaagaccggccacgcgcgagggtagaacaggagtaaccgatccgacaagcagtccacttaccgcatacctctccagaaatacaaagaaatattttagggcgtttatttcccacaatgagatcgatggccgccactttactaactcagcatgcacgacctacattcacgacctattttctctccgcagctgcatgcagcagtttcaggcagacctcctactcctgaatcaatccagccccgaaggttactgtcgccaaaagcatctgtgaagaagagtatatttctacagtgtattcgtacacatctacaggcagagtttgtgatgctggcacacgcgcggaggtcgtgctggatattcatgtagggacggcccacgcctagcacaggcctgccacatcggcgagctcaggacactttttcactagtcggtcacttctggaaatggattttggctggtcgcttgtgaatctaccgccgttaatgcttctcctgaagtagcgctcttcgacacaaggtagcgtgtttgctagtcatggcactatagaggcgtcagaacgtcccccggcgcacacgggaggacaggcatcagccgcgacaaagagcgcaaatcgcgttgttctgataggtcctccgtcgatgaaatttatcaaagcaaacgagatgcaactgcggagagcccaggtgtttcctccatgcacacgcccgtatcttccgctgtgcactacagcttcgtgtacacagttccggggctcggccacaatcgcttttggaggaggcccgctctacgtcgactaagtgatcgggagccgcaggtgtatatccagtgaaagcagttatggcgtaaataggccaaacgtccaaagccagctaccaggaatcctctggtgttcacagtgtgacgtcatctgtgttacgttgtgttttgtcgttggctccagtcgagtgatggaaatatctgtgtagccaaaacactaggaacaggcgctgccgcagacgtggcccttttcgcatggttccagtagcctctctgcacgatgccagaaatgaacaagttgaatggcagccacggcgacggtgccggtaggaagactcgaacagccatgctttcacgctttacttccttttacccttttcagcaacctctggtcacaaggctcgagctatacaagacgactttgataacgctgcggcaattttgaaacggaaacttgcagaagagcttgcagatttgcgggcagcgacaaagcaagtgagcttctctctgcgcttgcactttttgtttcaagtgtagtcctggtgtagctgagtactgaggagagtcggaaagctgcattagatgaacgttttgcttcgcttatgctggagaaagatgctttgactattgacatcaccgagctacaaagaagacgctcgattgtaagcttgttcccctgagagcacctagtctgatgatattgaaaagaattataggtggcatcggacactaaggagcgcgagcatgtaatgcgggaaatcgttgtgcacctagataaacttcctgacagaaccgaggatgcctctgtgaaatgtgccaaccgaaaggcgataggaacatgaagaacttcaggtaccgtgataccagtagctggcttcagtttcaatggaactctccgtattaactgttgcacacattcgctgccagcaaaccgcttatgtggtggtttcctatcccactatgccaagaatatctgtgtagataacggtggaaaaccggagtgggaacgaatgttccggaatacgtcttgcttttgtcctgtccagggagtcacgggcgtagaccatccatgatatccggtttgggctgcaccgattctgaactccgcgcacgctgttactttaagtggaagtgtgcaacgagcccttcgtcccgcaattggcaagcagtttttgccctggactggggcgatgtttttccttgaagttcttcagtgctcgtatctctcacaacgaagttgtatttcagctcaagtatttcagctcagcgcacaaacagaaaaaggcagcaaacggtgcagccatatccgaaaatgagacttcagcacgtttacaaccttatatggttattttctgcgtgaacatcttgccctccgggcattcaaaattttgctcactacgttctgtacgcagaggcatattttgctctaacataagttagaacagttgtcggacaactattgcggcgacggatccgatgcctcggtagaaaacaaacagattcttcaactctcttataccgaaagtaagctctaatggtttccctcaccaataatagtctttcctgacgacactctagagaggtcacgggagtgtagcagttccccttcacactgtgaagaagcatctcacggttattatcagtccaacggttgttggaggaacccgggtgttttaaccctgcatcagagtcaccttttttggtgttccatatgcctgctgtgctatgtggctcggaggtggccgtcttcatattcgcagacttagtgcccaagaggacaatatgtctgcgcggggaaagatcttcggttctaatcctgttcataacaaagcaagtatgtgataggatgtgataacgccaatttaactttctggctgcccttcaggtgacaccagcaaagcgcggcacgagcctgactagtcctttcgcgtactggcaagacgcaccagagctgtggtatctctcggaaggctggcggcactgatcagccccaccgtcagggctgcggatcattatccgtgggggcccagggtcggctaacgtgccagcattgtcgaccaactacgaccggctgaactactcgacactgcagcggaagtgagcagcacaccgttcacttggttctcattagagtactttttatgacagaatcaaaacgcatgatattcgtggatatgcctttcctgttttagaccgtttaagtctcgcgtcgttcgacctggcaccttctaaagacaaaatcagcatgcttggcactttcccgggaaggacatggcgtggaaacaacttgtatcggtggtgctaaccctcttttcaagcaatcctacgttagggttctaatctctagagtctgagccacgtctagaatcgtgtgggaagcctgagaactctgcatcccggagttctgagccacggggcaatactgcagtgattggcgaca

SEQ ID NO: 3739 - DNA, 2353 bp, Toxoplasma gondii
cctgaaggtgacgctccagatcttcctgaaggtgacgctccagatctccagggctgggaagctctctccggcgccggaggaatggaggcttcaggctgagaggcctcgcccccctctgacgcacctggaagttccatgcgtccgctggagtcttgcaagcctgcggtgggcttcgccagactgtctccggagactctccccggcaccgccgcagatttagcggctccggaggcatgcgccggtgtctcttccagcgcaacaggacgtgtgaccgccaccagcggagggctcttgccttctggtttttgcgctctctcttggtcgacgttgccgagaccgcggcactcagaacggctcgtcgcttctcgccctctgaggccgctcgattcgccagcgttctctttctctgcggcgcccaggagcccccctgcccccgtctccgcagagtcaggcgcgggggaaggcgctgcggcttgcggcgcagcgaaatccttggctgctgtcgtctttcgcgctgcccggtcgtccagcgtccacgccccgacctctgcgcctgccccagagggattgggctgctcgtctcgctgcatcgagagaacaagacgaggtccgcttcggaagcttcggaaggactggcggcatcggcggagctcccgcaagctggagagggtcgcggtctttcaggaggccgaagacgaaagcgtctggcgagagacgcacggaaagagccgagcgcggagtccagaaaagtggagagagaaaaacaaggacggtgtcgagacggcgcgcagcagcaggagcggcgctctgtcgaaagagcggagaaggcgagtgaggacgcaaagccgagtcctcaggggcctcgaaggtgacagagggtggcttcgagaaagccgccgtttcgtcgagctgagttaaaaccaaagcatcgacgcgcgcatgcgtgtgtccaacttggaaaaatctccaaagtgtacaaggtgaatccgagagcctatcgctcctttttgggagtgtatctacagcgtgggacgcgggagcagaacgaagggagcagccaagagaaagcgcgagcgaatctctgtggcttctgagggcgctccttgttgtcgccaccgagaagcgcgtccacctccgctggagatgctggagacaacgagaggaatcttagtcgaaaagacgacctgcggcatgggagcgcctcgtgatgcgaagagtggcatttcgtcgaacggagaaatctttgcggcagcaaagtggaggggcttcgcggccctcgcccggaggactcttcgagagaaaaagagcggagaaagacggaacgagaaagccggggcgaagaatcgagccgggacgaggcagcagaatgtcgcggttccttgaaacaacgcgaggtgacgaggaacagaagttcgagcctgcgctggcgaaaagagccgcggaactccgcgatggccccctgatacaaagctcggagcgtccctcgttctcgcgttcgcgctgcgtctgacaagcgactcgagcggaggcaacgacgttcggcgcgccttcgggcaaatctttttcgcagagacaggacaaacactgagaacggctggacgttctcattggcagagagggagggcgtcggcttatggacggagagagggtaggcgccagatgcacgcgcgggaaaagacaagtgtttccgctcgcttttgcggcacgagcggccgcgaggaaaaagcagagagcttgacaacgacacagctggcacactggaagacaaactgcagaaacgcagccgccggaaacttcaggaacgtcgaaagttgtcgagagggatcgtttccacatacattttcgcggtggacgcacacaacacccgcgagtctttgtgccctcctgcctcgcgctggcgggcttgatcgcatgaaaatcgcgcatgttctgtggagagatgtgatattttgcgcggagcgactctcgccgcgtgaccagactctctttgccgcgcctccatttcgcattcatcgcgttgaaaggttctctccaccttcttgttttccgtcctcgaaaacgctttgagcggaaacatgtcgaagggggctgtcaaacgagacagcgtccgacgcagtgtgtcaccctttgtctctttttgcaagtcctttcgcacaagttcaagtttccttctttcttccgcttctccttgcctccccttcacctgcttttctgtctgtctcacactttcgaggcaggcgctcgccttttcatctggaccgctctctctgtcagtttccagaggagctcacgtttctttttcgcagtgaacgcgcagagatgatttttcagtgaatcggcacccttgacagaa

SEQ ID NO: 3740 - DNA, 1248 bp, Toxoplasma gondii
gagacaggtggaaaaggcgacagtgtcgaccacggagacaaagacgaggaagcgactggggaaggaggaagcgccggagaagatccataaaggagaccggcaaggaagagaggcgcgctggaggcccccttctgcccgcgacagcaggagccgtctggtggtctccgtccgcgggagaagaaagatgccgaggtggagagacacctcagcgtgtgaaagtgaggaaacgcaagacaggcggacgccgagagagaagaggccagaggaagcaagcggaaagaaggagaagagagaaatggagagcgcgaaacgccggagacaggagacagagacacagagggtggagagacaggagacagagacacagagggtggagagacagagggtggagagacagagggtggagagacaggagactctgcgaggtcgtcttttcgccgttttcggctccttccctgggatgcactccctggacgcgcatccccctggaagtctccgtctgttctttcctcgcgctgtctcgctcctccgcgctcttccctccttctgctgctgcctccttgaagaagaaagtctggcctctgcagcgaagcgcccgcgcctcgcctggcggatccgttgcggatcctggagggactggcgaggagcaggcgcattgcggtaagtcgagcgacaccgtggaagagggtgaaaagtcgagacgcgaagcagagaaaagacagacacctcaggtctctcttggagaagaaggcgaactctgaagcgcctctttcttctcggcaacgagacgagacacgaagagagaaacgagcaaaaagacagagaaaggaaagagagaggatagagagcccagggaggaaacgaagggaaaagagagagagagaaaacaggacagaggatcaacagcagaagaaggacgtcaaaggtctgttcctgcgactaaaaaatgtgaatgctcgttcattttcctggaaaacgcgtttgaacgcgcgagaaaagcagacttctccagctgtatgtccactgtgcaacgtttcgccctcgctgtctcgcgctgtgtccgctgctttgaagagccccacacagtttcttcttagtatcttttcggggatctttgagaaacgaatgaaacaagagaatctcgtctttgacttcctctcaagtttttccttcaccgcgatcgcacttcctctcgtcttcaaggagctggtcgtcgctgcctttcgctgtatatatacgcacagcgta

SEQ ID NO: 3741 - DNA, 1983 bp, Toxoplasma gondii
cttcgattctcttctttccgatacaagctcaccagtcctcgtccacgtcgtgccatgattcctttccacggtgtttcggttttgccacaaaaacggtctccattctggaagtaaacgtaccattgattttacacctaccttttccaacctagatcattttgtaggagtctttcttgttgcgaaaaacagattttgaggacgaatcagacctctatgatccagggggtttttcggtgcaagaagcagaggcgcaagcgaagcagggttctgtaaagagagttagaggaaatattccaccgtatgatgcggcggcagctgtggatgtttactggacaaagaggcattttgaaacacaacttctcgtgcagtttccgtgattttcgcaactaactttccagcggaacattagaagcacttcctaggtttatataaagtacctttctgagagtgtgtactgcgaaggggagtagtggtctcgatctcgaaggactaaaattaaaacaaaggaagtgctggtctcttcgtggtaatggatcaggagatgactcagacaccccctcctgaagcctggctgtatgcttgcacagtcacgacgtgggcatcctccgtcgccggtacgattccttttcgcacgtcagtgttgtgtagccattttttccgctgggtatgagtagcaagacagggagaggtaacagaaaaagacgcaaaaaatacgaggacgaaccgcgagtcggggcgcaattgagtggcaaatgtgcagtggtgtcaagtgtgcgtggtttggtccgaggtttcgggtgctgaaaactgttcggcatgcagccgtcgcccatgcctttattttaataccgaagaggtttctatgaagtgctacttgtctaaacaacgaccgttacttccacatgaagcttcagatcggtttctgtgaacctcacgttccaggtacaggatcccggcctgcgtttatccagtgtatgtgcatgcagaagaccagaaaaaagggtatgtcttaggtgacaggcgggatatcaaagtcttctatcgcagccgacatacacgcgtcgtggcaagtctgacttgaagcctcaacgccttcgaaaaagttagatttagttgctgccgcaattcactggatgtcctctgacggaagggtttagagcgaccccaaaaacacagagttggatgagcaggacatcttttgcttccgggtgactcaaacaaatcttataagaatgtaatttatcgaagtcccggtgtgtacatgcaggctgcgagatatggtcgtacccagtccgagacgtctgcggtgcatgcatgcacactcgagtagctagcagccatgtgtggaacgactgtggtggctttcagcctctttcttgtgtccggaaattgcctgaacaatgcttttctgagcgaaggcccaaggttgtttcagattcgagaactgctcgagtattgttgagtgacatgtcagtatccctgcaactgcggaattcccttgctccacctgccgtttttgtcggaaaaccgtcattcgacagtttcgcattgcacaccatggtcccacccttaattattgcctgttgtcggtgacctcttccacgcgatgcccatttcatccctgggagatgggcgcgtttttttctctacagtctcacagagtctgttttccacccaacgcatgtgtgcgacaagacactcgcgggtcgcaaagggtggaaaccacgctttgatgtttttgccggtcgccgaactccgtctcttgctgaaaatcgtgtcctgagacaagcgtttcctaaccgcggaagctgttggtctgttcgaggaagttttcgcccgtttttacgtagtccacagacggcgtgcactctgaaagtcttcaggtgaatgtacggcgcggcttcgagcagcggccgcccccgagcgcgagctttcccctcaatttttagattacatcgtgccacgagttgcttctcttatgaa

SEQ ID NO: 3742 - DNA, 3127 bp, Toxoplasma gondii
catccaggttgtacgtacaggtcgggacgcagctgtgcggtagatttgcgaggcgtcgcgagaagacgaggccgacgcttgcatctgggtcccggcgctggaccgcggctgaaggcgacgtgcttcgtacgaacggcgagtactggctgacgaggagcatgaggcgaatcagttcgcgatgttggagatagcaatagaatcctggcgggaagtccttttcgaggcgccgcgcgagcgtcgtcagcttcctgcgcaactcgggctggccgatctcaacgctctcctcaaaggactgcagttcgccgagcacgttgtacagcatgtccttctcaggtcggacgatctcgcgctccagccccgcccgcaggagcaggcgacaaaagtgcaggacgccggtgatgctgagctccgcctcgcgcgcagcagccatgatcatcggcagcaatccgcactcgcgcgaatgcacccggacgttgcgcatcaggcactcccaggagcagaagacgaagggacatgtgtggggtgagacaggacaggagaacccacggttggagactggccgctcgcggagacagtggaagcatgtcgtgaagacttggccgccctcgagcgtcagcggggtacacacgtaaggcaattctcggaagatcagctggccaggctcgagtggaacctccgcgatgcacaccgtttgcttgtcctgcttcacgacgaggaacggcggccgctgcagcgcgccgcgtcggccgatctccgtggcgagagccttgggactcgagagctgcggaaggctctcgcacgttgtccagaccgacgcgcccggatgcgagaagtacaagtctccctccgcgtacggccgcggggtggtgtgacaagaggcgaagcgcgaagagtcaaagagagcggccttgtacaggtggggaatgcatgagacctcggcgaggagtcgctcttcggcgtctcgcagagaccggataagcatgcggttttcaggcacacaaaacagcgcggtccagtaaaactcaatggcctgggagaactttttctgctcgaggttgaggtccgccgccagaatgtacagctctgcgcgactcggaaacgcatcaaggtagtactcaagaagagactcggcgtcgctaaattgctgcctgctcaagagctttggaatcgtcgaacgcaccaaatccagttctctctcgtcttgttgcctgttactttcatccaccgcctccatgcgccttaccaactcgctccgcaacgcgctcccctttcgccgccgagccgaaccggctgctagaggtgcatcctcgccgaccgctcgcaggaccccatggcgcctttccgccgtaaggtccttcactggatctgccgcacgcgctgctgcgacgtcctcccccggcgcgacgcttcggggacgccccttgcctgcgtcgagctgcactcctcctctcccgtctgaggaaacagtattgttctctctgcgctcttctccggtaccgtctagaggaccaccgggcaggacctgctttcccctatgagaaggcgcgcgcctgcgccggagcagttcgtccctcgtcgccgcgtctgcagaggccagcgagaaagttgcgtcgtcgacatgcgaggccttgaaggcccccacgagcattttctcgaacatcttgcagctcgggaagcgtgagaacaatcaagacgatcagtggggaaggcgccgaacgacgagtgggggagcagagaagagggcaagtcgacacagaaaaagagaggggaaatggggatgcagagcgcgcaggcgacgcaggatctgcgcatctctgtactcggttgtcgagggaggcgctccagatgaaaagtggaaggcgcacaagagaaacgggaagagaagtcacatggtggagactcgcaggacagacgggggtgggtgaactgcgtttgaggtcgctcctacattttggacagcagagacgtcgtcttacgcagctcacaaaggagtccggatggagtcgccctctttgataaggcggggacgacagaagaaaaggccatgaaaaaacaagacaagcttccttccgtcccaaaactgccttcgagaagcgtcaggaggatagaggcgccgaaaccgagccgctctcggaaattgtcaaaacgcgataatggggtcacgacccgccgcctagaggcagaaagttgaaagcagcccagagaaacgacttggcgactcgaaaaactaagtctcggcagctcacgaaggaaagaggcaagaaacaagactaagaaacaagacagtgtaggcgctcgagcatcgaagagaatgccggacaagaagcccgactcactggacacggcgggtaaccgaggcgatgtgtgaacaggttcgagctagaaggaaaggtgaagagtaagttgaactggagaagcaaatgcgtgtatcgaggacatacagactcacgaagaagacataaccgataagaactcgagactcggaagaacgacgcggaccgtcaagccgaggtcagctgcgaaaagggattgtgtccttgaagacagccccgctttacagacttattttctccctagactcccttccccagtatcttgttggttgtgaaggagagaattgccttgcgaggaagttacaaaagcgcggaaatcgctgaagttcggcaatagagcggttgcgagatatcgagcaatgcgagtgtgcagactgttccaaacgcggggaaagagtgtacggaggagaaccaaccagtcccagagggtaggcgaacgcgctgtcttcttgatcctttctcttggaaacaccgaaagaaattcagttttcatgcttcaacaaaagacaacaagaaacgaatccttttctccgtaataaaatacttccacgcaaggctcccagatcgccccccctgtcctgattccgatccagccactatcgctgctgccgtcactcattccagccgagcgtgtgctggcgtcatctcactatccaatgaaatttcagacttttgatttttctgacacaaccacaccactctttaccgtcccttccatcttgctctgaaagggaaacgcttccctcccaatttggagcaacttcagataccggggggaaatgcggtgttctcca

SEQ ID NO: 3743 - DNA, 3684 bp, Toxoplasma gondii
aaagggaactgttcagatgtaggaacagacaagttcacgtgtacgtggaagcatctcaacatcgacatccaaatcaccgcacaaatctcaatgtaagaatacgattgtttttggagagaagcgggcatgaacgtgcatagagagatattcgcgtgcgagtatccacctactggtgaacctgcgaggactcttccgtgttgtctagatgactggttcagttaggcaggaccggcggtgctgttgacttaccaccaaaggacaagagaccttcacccctcctcaaccgctctacgcggcggctcatctttctttggtggacgtggagagggaagaatcgaaaaagcctgaagattcgggagatctttataaaaaatctttcgcgaaaatgcagtgtgatatcttgacaagatccaaggcaaaccctgaaattgagagggagaggcgatgaaatggtaccaaatgcgtagcgactggtgaggcaattagagcaacgtaagatcgaagaaaagacgtggatgaagaagaaaacgcagggcccgacgagtcagggctggccgcaacaggatgtccttcatcgaaaaaaacgagagaggctacaatggaaacgaaacagacaggagcaatatgcagaattggtgcacaaatctgaaaccctccggcaacaacggaagcagaggcgcttccttatttgtgcgtcgggattgttccaacaccactccgggtcgaccttgtggatcgccagcaagccgggcaagtcgctgcggagccttcacaatatcgtgtttgcactactatgaaaccacaactaacaagacgggagaaacggaaggaaatacggtgcagcggacgcaagccgcgcccgggaccagcagaatcgtggtgggcaaaagacaccgcaaagagacctgtagaatcccggtcacacgaaattcaccgcagacacggtaggtcatttaataaaaaaaagagcccatagtgtgtttccctctgaagactacactccaagaagatagtgacgaaatgtagatataagattgtaaatggttaagatgccaccagaaacggaactcgatttgttacgagagcacgtggaccggctgcgaggccgctttgccgcctattcctttgcgaagaagtccacagagtctcgcacctttatccgtgcacacaggcacacaacaagtgaaagggacaggtatgtgtcctaaagctgttatgggaactgttcgctgaaaatgcagaaacaatgatagtacttttccgcgcttcagcaagttaccgtgcatgctagccagccgcacaccagccgcgcatgggggttcgttagccaggaaaaaagactggtagcgtagaacgttaaggaagagtggtaaggacttttttgtccaaagatcactttacgtggcggatcacatatatatttcactagagatgcccttgctgacgcagtttctgaacacaaaaaccgatctgggcaaaaggctgccaagaaacttcccaccagcggcaaggcacagctctcgtagctgtcaatggtgtctgtttgtgggggggtcgaggggatgggctcttcaagattatgacaagctattgactgctgcgacaaagtttctaaatgcgttttcttgcaagcgtactcgaacaattcaaagcttccgcaagagatggcgagatccccccaaaattcggctgtccagccatgctgtgtgacgtcaagactttcgattgctgaacagccgaagataggtacctgctacggtactgcagggacgatatacaagcagttatctatcgggatgcacgccgcagtttttaagtgcggattttgaggagccttcgaaagatacacagaaaactgcactggaaagctgcgtgtgtatgtcgatttggcctatccttctcaccacggtgaaacagtgtttcaatgttcaccgacgagcaaaaaatagaaggcactagttgaggaatatggcaagggagaagctcttatatatcagacaaggagcagatcatggtataacgcctctatcctgggtgtgaaggatggcctgcttgaggatcgtcccctcggagagagctaggaagacagcaggaagaacagaagtgtatggagttttcccgggcctctccgtgttgctgtgactgtagtcaggctctattccaattcaatcaagcaacagtggtgcacacgctcctagcagcaacaaaaacgcacaggcacgttcgcttcttgagttccgcattccgaaagagagacgcgacagagctcggcgttattctcccttcactattcgaattggggagagctcttctcatatgtttgtgtgctggagtacctatgaccgcccttgtacttaggctctccccacacagcagcttacagcaattctcatggtcctctccttcagtgcttttctgctgcctgcttctcctcagtagaaaatctgttgaaaagcgccttctattgtcacccttgtccctctccacctctgtgcatactgtttcctcctttctcctgtttatccttcggtctggaatgaacgttccccttcttttcttcttcgttacgttcatgtctcctgtggattctccttcccttgacttgcgaactcttcctcgactgtcagcgttttgatggtgatttacggcgcatatgctgggtttctgctactgcaagttgtccactgacgtcttcgaattaccgccgtttactatgaagcgccagaagtacttgtttcttgcgccagtatcacgattcccgcctcatcccattcgctacatacaaaagtaggcagtgcagctgttccatggaaccaccgatattgtgctcttcacgtgaaaaggaaatcgtatcttgaactgtctgactttccctgagccactgttcttcggcagacgtctccatcattcgtgtaattctatagttgcgccatggagacaaacgaaacacaaagtccctcgaaaggggcgacctcactgcaaatgtccgacggctagagacgcccatgtcatcaagtgtctgattttacgaaatttcctctccccagacactggtcaagacctttttggtttcgaagagtcggcaagtatcgcgtgtcaccctgtccgtcccaatgcggactcccctttccagcgtggggacgacaaacgacatctttgactcgatgaacccctctgttcgcgcatctctgtggaaatccactacacagtttctcttgtacaggattttgatgtatcagaattttttccataaaaacaaagacatcggtaaccccgagttctccatgtcgctgttgtcatctccaacgatccggacctattgcatggtacacccgctgccctgcgccccggttctcttccctttccctgttgcatgcactttcaaacattttcaccgcccagtttcctcgttttcttctagtttccttgtttatttttcggactttcactactcttccgcgtatgcgtgttgttctcccaacttttccgctccgtgacatcttgccgcagctccacctgttgcatctggttgccgaacacaacaggcgctgggttcaagcgcttcgtcgagtagtctcaagaaggccggtggtgtctgtttgttgctcaagtagatgcgaacagtttcggtgggtctcttccctgctgaattcttttgggctccgtaacttctgcttccccaaa

SEQ ID NO: 3744 - DNA, 3752 bp, Toxoplasma gondii
ggcgtggcgctacgttttgacacagagtcacaaaaacagaagaagtctgcatctccctcatccaagataaacagacacagggagtagccctttttgctctctgcaatccgtgagtttctttcgacgtagcagtaaaacaacatcccccaccggcgaatacgggacctccctgctctcagaaaaaaggttcttctgtaacttccgttctcaacactcgcgccagcccccgtgcatgaagaaggaaaattcttacttatgtctagtcaataccccaccagcctgtttccgctttcctgtgctcgattcttctgtgtttcgtttatctttggcatctggtgcgctacatgtttttgatgactctgtacccattgtacacactcggaatacatgcgccaaacgagcatatacataagagcaaccacaccgccgagagaactggtaaaatcaaaaagtaccccaaattccaaatcgagcatgccgtggctgtttggagcatagcacacattttgacggtttcattaggatcagaaaaatcgaatttacccttttcaccccgctgctgcgcggcaagtgcagcctcgtagcgactcgcatggctctgggagccgataaatttctctgggtcgtcaccaaagccacaatccgttgcgcagtcgacaggccatcgttggaattcaaagatgctgaggtgcgagaacgtgcaaaagagaccagctcgtgccatcgcctggctagcgatgttgaccccctttctgtacgtggtcgtcgtgtcccagtagtcgttgtggcaagtgtttttgatacccgcgtgacgttgtccagtaaactcatgaccggcgagccagtcattggcggttggtgttgcgcgaaggcctgcaattatacccggcaccacgagaggcccagctgttgaacgtgcctgtctcccaattcctgggtgaagctccgactcattttccgcatcaatactttcagaagcagcatcattcgctgcaaatccgagagcagctagcccgtgtacagagaggagcgcatcctggtagtcggcaacttcagacgaactgccggcatcgattgatgctgtgtgggcggacttgagtacgccgtccgcgttggcagcaggagttccagtaatctgtcttccctttaagaaatcttctatatttcccccctggcctattgcattgttaagttgcttcttgatgtccccgacgtcgggcatgatattcgtattgctgttcgcgtacacggtataaatctcgcctataccctggccaacgctccagctcagagcgctgccactgcggatgaggatgaagagattgtaggcgcatgcaaacagaacagcgacacatgcaaggcaggcagtgacaacggcaacaataactggtctcttctttcgtgtacacactgccgtcactgtcgcaagcagcaaaagaacaccggcggacccaacgacaatcgtggcgaggaggctcaacttgccgagttcgaagaagatcatgactgcgagaaggttgaccataacgacgtaaaaaatcaaaccacacttcattcctgaaaaggaaatggccaactttgcccgttgatcaaccagcttctcatcgaccacctgaatcacttggaccacaggagcaggagcgaccggagcctcactacttggctctagtaagggagccatcacattgttggcttcctcattagagaccttttcgtttgttgcttcctgacccgtctctgctgtgtctagaagagacaggaagtcgtcgctcccacctctggcggttccacctccggcggctccgcctctgatcgcttgatccttgaatgcatcctccaccgacggcaagcggataacgcgcttgcgttccatgagaagtcaaatacggcgagagatgtacatgaaaacttttttctaactctgaaatgacccggcccgcaaaaaaaaacttgctttgaggcaggcctcaccaagtgtttaaggttttattaaacactgtcgccatctgcgacccacaagccttcgaagtcatctactgatctaagcccatcataattcctcttactgggcgtcggagggaaattagcgaaacctacacgaaagaggtacgacgaagacgaacagccggtcactcccggcagcgcagtgaattagagcgctgggccacagaactgtgtacaccgtcagaaactgcttttttgttgtctgagccacacgataatttctatcacaggtcgcccctctgcgatgccacgcttcgcagcacactaatgaaggctcggagaaaatagaacaaagtccgcgccgctaataccccggttaggaaaagctctccgggtccatttcacgctgcaccacaaaccctccagaccgccttgcaacacgccaccctaacctaactcgaacgccacttttttcacgtcaagaattgccgcatagtctgcaaaactgccgctctatttccacaccgtggtaattcaaccagtggaattccgcgtgcagcctgactcaccgctcaatcgagtgcacgaactcgaagactctgcaggggcagtagctgctctatgtcagcgaagggggggggggaggggaacagctagctgcaaatttttgactccaagacgacaccttgttggtatgggcccagaaaacttccctccaggtctccctttttcgctgtcacaaccaccaaaaagggtcgcacgcgaatcgactcgcctcacgcatgcagccgcctgcgctctggaagagccttccatctcaacaacacttccgaggcgacctggaccacgcaagagcggctacggatctctcaggtcagcacgtagtgtgcaagcgacaggtccatcgtttcttgtttgtgaaacaagcaaactgccattccggactggagtcagaaatttggttttcttgacgtactcgatcggactgtcctgggaggggcgttatcgagggcatgcttaagcacggaagaacgcctgcggacgtggcgacggcttgtgccgcagtttcagggcacacccctgacttttcggttttaatggacttctggatccacgacacaggttctgtcccgttccttcgacttctctgctgattattactaaaggtgtgtcacgaggcggtagaggcctccgctgctgtggtggacgggtaaaacccaggtcgattttgcgcaaaccgtgcataagcagccgcgcgtgccgctgcagagaaacttcgctcccttggcagacatcttcccttttcctaggatttctctgtccagagacctctcttcctcgtaggtgttatcttgcggttgatctcggtcgattttcccttgaacgctgttgcatgcggtgttgtcgacaaggcacttataggaggagaaaggagaggaaagcgacgagttccgcgctggggcatttcttctgtcgcatctttgttggtcgctttcctgcatccgatgcagacgtttactgcgtgacttcttccccttttccctgcctctactcactgccaccctcacgcacacagccatctggagactgtctacttgtgtcttccgccctcaatgctccctttcttttaggttccgtcgctctcgagcgggatccccaacagccgtgttttctgcaacaaacagagtgtggtcggacaaggaagatggcctgtggtggatgcgcacttaggggacaagcctcccggtccccttcgtggttttcgttttccgctgctctcttttaacagagttaacagagtcataaca

SEQ ID NO: 3745 - DNA, 2826 bp, Toxoplasma gondii
cctcttctctccctattctccgacctcaccataccacaggcactcataccacatagagatacatacatacatacatacaaacataactatatctatggaaatatacacatatacatatatatatatatatatatatatatataagtatatgtatgtatatatgtgtgtgtacatggcgagccctgtgtatacatggatgtccctaagtatgcatgcttcactctgcataagcctgtgcgagcgtttccttgtcgttgttgctcttcggtagacgccgcatgcgtgtctgtttgagctttctttctcgcgtgcctcgtctccctctctctgtccttagcgcctcttgcccgcctcctcctcctctcgccgcgcgctgttcggtctcccgttgcctaaatccttcttgttttctgacctgtgtcgacgccagtgaagccggcgaggagtgcctgcctgacgagttgcgccgtgttgtctttcttccacgcagtgccgtaaaggagtctcggaagctcgacgccttcgcgagacgctgtctcccgctccggcgcgtcgtcgccactgtcctcgcgccgtggtagccgctgcgcctccagggaggttctgcggcggccgagggcggagggcggcgacccgggaggtgtacgtacacccgaaagttcgagggctcccggcgagggccgggcgtaggcggggaggaagaccgcgcgtgagagaggcggcagacgcgacatttccacaggattgatcgcgcgacccagcgagacgacgacgcccgcggccaggaaggccgagagacttaggcacacgaggaacttgaaggacggcgccgaagcgactgcctccagcgccgactgatgcagcggcgcgcgcgtctcctccgcgccgagggcgagaggaagaagagagagacacagacacgcaaacgagagagacaacggacccagacaagaagaaaagcgcacagacgacgcgcggtgaggcacagcagaagaaggaggggaggaagaggaagaagagcaagaagacgaggaggaggaagaagaggaagaagaagaggaagaagaaggagagaagtcgagacggagggtgcggagcggtggagtcgatcgttgttcgtcgagaagaaaggaggttgttgtgtgtaaaaagagaaactcgaaggcaggcgagaagcggcgccagctgagaggaacggcaggctgttgtcgccgggcggcgacttgcctcagtgtgtgtgtcatgccaggcaccttggagactcgccaggtggagtcccgctctgcagttcctcgcggactgacttgtttcgtctcgcgccggttttgaaacgagacaagcaaatcaaagacgccgcaacacagtttgcagaaaatccgacggtccttgcatggcggaaaggagctgcccgacaagaacaacagagctggcgagacgaggagggaagactgcgcgcagtgtgtgtctcgcgcgtcgggcgtacccagcgagacagacagagagagggcgaagagcgaaaaaaggtaaaaactcgagttcttcacgcagcgcgagaaaagtttgcgttcttcgaaagacaaaagtgagaaacacgcgcatcttctggccaaaaagggtgagaaaaaaccgtgcctgggcagccgggtcgacagggaggcgccagcgagagattttgagtgggcgtcgatcgaagctgtcgcggaaaagggggatttctctgtgcacaccggaagaatgccagtgaaaaagcatttttccctctacaccttaatgtgcatttaagcaaccgtccaacgtcgtccagagatttcgcttcctccgaggagttcctctcttttgctgaggaaacagcccctctcattacggtccgcggacacaaggtctgcagcctcgtccggcagtcgtcccaccgggcgagttccgtacttcgcgcagagtccgaggagacaagttttagacttttcacaagaaaataaagaaggaaggctgaatctcccgtgtgcccgttgcattctcggcagggagggctgtcgagtttcacggatatttggaggcacaggcaaccacgtagattacgtgtgtaaagaagcgatgatgtgcgcgtcaacttcactgtctgcacctatatatatttatatatataaacgtatatatgtattatgtgtatttatgtagccccagttggattcagcaacttgtcttaccgtgcattggtcttttgaggagcgcgagcagtcgattcactttcgaaacgcgaagaaaggcctgtttccgcttggctcgaaacgtttttgcggcagcggacgcgccgcatgcgcggtgctcgaggctgctggttgaacggtgcctttttggtgagcaaaggaggggtgtctcgtagagtccagaaaagcaggcttgcttggctctctcgtcgtttttttctctttagagaggagacatttccaggacatccgacagcttgagcgggcagacggtgcgcatgacaaaggctcccttctttctctcaacgtctctccctgcattcgttcgagagacacgcagatacaagaaaacacacacaaaacgacgagtcgttgtgcactcaagtccatcttactgcatgcagcaaatgcgactcaacatattcgcagacatgcgccagtttgtgtgtgtctgagcttggatctgttacctcgctgcctgagaagctcgggagagcacctgaacgcaagctgctgcggtagaacgcgccagagctctgtttgcaaaagtagcgactgtgtctcgtgctcacctgtgtgttcattcgtggtgtcttgtgccactagagccgttcttcgcgca

SEQ ID NO: 3746 - DNA, 4348 bp, Toxoplasma gondii
tccaaaagtttgataaaatgctagtctgcatacgcacacggtgactctaaatttccatcctggctagcgcctcctgcgtgcgaaaggcttgaaaggcgtcactataccccgattaatcggaactgatatcgtctaatgctgcaggcgtcgaatgcccctaaagttatttgagcagaagcgaaacacctaccgcatcgttgtcaggttcagattctgactcatcagacagttcactcatgcttgacatctccgtgtcactcttcttcgccttcaagctgtacgtttgacgccgtctcatagggcgctcaggtacgggagcagcggctccaggagacgctgccgctccctgacacagggcacaccaaaggacacaccatatgcatgttggaataaggaaactgtccataaccatcaaccacgggataggcgtgtcatctcaagtcgtactgtttataccaccgctgccacttccagtatgaacagtctaactgaatcaccaaaatcgggaacggtactcatgttcgtcccgtaacttccccagtggtacaggaagctacgctaatccagtggctgagattttagccacgtcgcaatcagtaccgtcacgtcgagtctagagaaaaacttcacttgtttaactcagacggggatccctgcagttttgtgtgtgcgagctcttacggccgctgcaggtgcaggtgctgtgcttgccgccgcggtggacgcagtagaggcggcttgaataatatcgcttcctcctccagcggttttcgctttgatgtgcagaagcggtccatctggagcccgcttcccccacctgtcaaagcagctcatagtgttccccatggtgactctagggtagcgaaaaaatgcaatcgaaagtaacaaccgtactgcgggttcagcgacgcccgtagacgagcaacggcgaccttgaatcgctcctgcttccactcaaagttgtgaaaatgataagtggaagcaaaataatgcgcagtggggaacgaacggaacgacgattccccgagaaaagtgtcagtttagacagtggagacggaggacacgcacgggaggaccgtacccgacaagcgactagccaaaagtattagcgaagaaagtttcgaacgagtgggccaccagtttacagagtacgcatcccacttggaaagcgtttatttgcttgcagcacggactgcgcaacaaaaacatgcgaacgaccgtgttcgctgggtaaaaaataaaggctccccagcgaagaagcgtacacgcaaggccgtctgaagcgtcgatgttggctgcaacacagggttccgcccgaattatccagcatgcggtgtgcgcaagaggagcgccttgccgtgggactcaagaggctgccactctcagcggttaaattccgcgatcaagtgtgctgctgaggttgcctcctgttgcttctgttaatcaccatgaataaagttgtttttttcggtaccagcgcaaaggtgcatgcacagtctgcggaaaaggatatctcgaaggcggtccagagatggtgttaaaatagtcggaacaagtcccaccaaaccccctagtgaatgggataaagaggaggtcagtcggagcttccacagtggttgtgtctgtgagtccgcttcactacttcgtggaagacaacagaacgaaggagcgactgctgcctagcaacgttacgccagcaaaaagggagcggcgcctcgcaacgaggcttaaacatacgaacacacggttgatgcatctctcgttggtaagcagcaagcttcggtttttgacaacgctatgcaccttgctacgcttcctttaccacagagttctaccaaagaagaagtcttccgctgatcgaagtgtggcctccgtactttggagggcatttggatttgaagaacgttgatctgagtgtggcgacatcgaggcgtttctgcgcacgtgaaaactgcgagcacaatcgttgagcactgtaaagctggtggaggtcatgaacgcgaaaaaatgtctaaaatgcccatccgacctgaccgcttatgtttttgaagtattgagcttgactgagcctagagacggtgcgcaacaccactgatgcacgatggatctcccaagatcggaaaaccaacgcgcgtgtgagttgtctcagctgtcaggcagacagatacccatgaaagtctcatgccgaccgcactcgcgatactctgtttcagctcatgaaagccaaccagggactgcgatgtagagcgtagcttccagcacatgttgtagacgaaagtgacagcactcactgtagggtgtgacagagaggaccatgtgccaaacaacgagataaagcgaagcaaccgtatctgcgagttcaggaacaaagaataccgctacataacataaatgtgtaagaagcggacaaagaatactggcatgcactgcgagcatgtaggccgtccgagagcaacagcagcctgtttcttgctgcttgcaaacaccaccaaaaccgccgcttgagtaaaacgttccatctcaaatgagttcttagagaaacactatcaaattccgtcaaaatgtagcttatcctcatcccaagtgtttggtcaatcttcctttgttcagaagtcacatgcgctcgctgggctaggccgacatccacagtctggcttcttcgacaggcctgctgggcccatattgtttacggatcctgaggtgccagtgctattgttgttgttctcatattgaagattgctcttcccgaagaatgcattttccagaacacccgtccatatgacggggaagttaacagttttgaaaagatgtcgagctttcctcgtacaaaagaagtgctacatgaggcctgtcaggttcacaccgcgtccttttttagttctggaccaacacagtcagagacatgtctttccaccgcgatagagatcttaactattcgtgcaatcaatggaataccagcgatgccgcagcagaatgccggttggttatccaacactcggattcctaagaaacagtgtgcacaactctgcagttacatgactggataattctttgaggactaaccagaacaaaaccacaaaatcttctccacaatctagacaagtaaagagtgtaacacaggcggacgatggaccctcgccaacaagacggaatcctggtggctggtacttgcggcaatctgacatcataggccgccccctttgctgtgagattggcacgttgttgacctattgcatcggtactcgtgcgttcgtgcttggttcatttaatggatatcgaatcacctactggcttgtcccagaaaaacggtggctgttgtccaagcagtattccaagaaaacgatgctggtggcatccttcttttccatccatgaatcgtgcgtgcgaaagagtggcttccatgtgttttaactcgttgtgcattagatttaatcccagtgagtgaaatcagagctgcctgctatcgaacgaggcattgccacaagacatgcacaacgagaaaaaacaggtcaacgtccactccaattgacgccagcactagcgccgccaactgaaggagacaaaacagtcatttcgtacaaagataaagaagcgtgacgccgctaggaagctgtctctggaagaacaacaacattagcactgaagtacatatcgcaaagagggctctctacccagaatgcgcgtgaaatgtatctgcaatgaacgcaacagctgacattgggaaatcccgggatgaaagacagaaatcaaggctgacctgtcagttcttcatcacatggaaacatataggccacactgttgacgacaaagagtgttccacgaaaaagatttcaaacgggaaaggccaatatcgaggcctcactttaccggcagacggtcaggggcgagaagtcttttttccagaacgtgatcgatgaatttgctgtcgccctgcatgtgaacaacatacagaaacgtgcctttacaattgagaatcctaacgtgggtttcgtttagacgctaccaaagctgcagaggcccttttttagcgttggaaaggctgtgtgtgccttacgtgtgtcggccgctctctgcgcgcacgcgcaaaataccgccgaaaatagataaggtcctttagacgatctgagaggtgaaagacagcaggcgagtgaaactcaacggtgctcggatagagactttttttgtggggactctgaaggccaatcgggcgtacacatccatagtgctgtcgctggcagcattaactcctttttgcgaacggccgaccggggagaagcgtttctttcgcctccgttttctgtctaatgccttcatgtatccaacatctgtaaacggcggtaccctcaaa

SEQ ID NO: 3747 - DNA, 2073 bp, Toxoplasma gondii
tctttccttcatgttggagaaaagcggtttcctctgtccctttcgttcggataaaaaaacgtaaccgagaaacaggacacaaaagaccaagacttggacgcagagtcgcgtcgatgctttcgcgaacacaatctgacacgggtatagacgaggcgatgtataagcacaggggggaagattcgcgtttccttgttctgcacagaggctgatgaggaagcagaagtgcacatgtagggaagacagagaggcacggatgagatttaaggaagagacggggaaaaggtgcaaaaaagcaggaaatgcccacttcgaacacgtagattcaaacgagtaggtctacaagcagaaacgcaaaaaaaaaaatagaaagaaagcgcgtttcaacgaatggtacgaaagtgaatcgactctgggggctctgcttccaggtgaacaagtcaaaggggaaggtgcttgagaggaggcattctcagcagccggaggcaagaaacacaccttccgggtattcgtggtggcgagaaacgaataaagcgaaaccggaggggaacgaaaaatcaacgtcagagacggagagagtctgagaacaggcagagcccctcttgcaaagtgcacatagtccgaaggccgccgaactgtttctgtaggactctcggcgaaattagtttacagatcatttataaaagaagcgtggcacatctggcagcttcaaaacgagaaagatttgggaggcggtccaacgtttatccaggtttgctctgcgacaagtgtttcagcactggcgaagcgccgcaacgcagacggggctctttccgactcgaaattttcctttttaggcagcatcaacatacatgtttacggccggcggcctgtgtgagacgtcaatgcgtttaaacaagaaagagggaaattcgcggagacaaacgacaaacggtcgaaaccacagccacgaaaagtcacggcagtcccgcccaggtgagtccgcgctcaagaaacaagcagagccaaattcgttttccttctcctgggaaacggataatgaagtttccacaagtctgtgtcacccgcattgcctgttatgcaagaagactagagaaaaggcagacacacccgaacaagtcacctgccgctcccgtgtgcaaagttggaaagaattgcatgttgctgcaccgcaagaaaccgttatgcgcccccctttcatctctgtctcgtgcggtcacttcgtctgggaacttcagacggcaggggagggtgtttctctatcgaatggtccattttccagtacttctggtttcatcttcaacgagtttggtcctctttttttctcctcggtctgcagagccgcgtccgcggttaagctaaatagttgaacgccgtgcctgagcagaacaggagaaaagtttcagcgcttgggtttgtgggttgcggctatctattccgcaggcatcatcctgtggttccggacaaatttgttcgttttcaacaattggctctgaagaatgacttgacgggtctgtgatgcagcaagcgatgaatcgaaggtgccggtttccaattacccgacttcttgccgtctgtagacagatctgagaaaagtttactgggcatgcaggcggtcgtcttcgggaccagcaggcaaggcacgcgagtggtgaggagggtggtatgcaaagtgttcgtggttagagaggaggtgtatgtcgaccattggctcctcgaaccagagacaggcggtattgttgttgaccgtacagtgtagttgtagttttgacctggctttttggtgacgtggtttcctctcaattcagcaagccggcacattcggatcgtgcccatttagtgtgacgaggtccaaaaacaagctgtggtcgtcagcctgtatttttgcgtagggttcccgccccatctgcgtcctcagcatcgactgtccattttttccgcgtctttctccgatctttcgatgctctcgctgcgaataacaagggtgcgttgtatgagtatttgctgggacgcaaagaggtggttatgtcttcgttctcgcccgccgtcccttcacgcgcgtatgtgttttatcga

SEQ ID NO: 3748 - DNA, 2303 bp, Toxoplasma gondii
tgttgcttccattcgtactgaacaacctcgacctccttcacgacttctgtcaccttggggatgatcttttccttgacatcgacgacaacttctttttcaacgtaagtgtccttgtactcgatttccggaacctcaacctcaatcacctcttgctcgccctcgtacttgggcaccggtcgcggcacctcgcggacatcccactttgggacaaactgaggtgcgtagcccaccagcacgggcacctcgacgtctctgagagtccacacgaagggacagccggaaagaaatggcgaactgaggaaaagactgcggggaatgaacgtagcagggcctcacacggaagaatctgccgcaagcgggctgtatgcggatctaaaaaccaggttgagcattgcgtcatcgcttggcatggacgtaggtgacgctcaagacttgccgtgcgtttccacagacaactgcctgatggagtatttttgacgaagaacactagaatgaatcactgctcacctgtccactagtttctcggtgtgcacagcgacctccttctcctgaaaagcgatgtccattttcggcacctcgtgcacggcgctctggttgtagacttttggaatgatggtgtcgttgagttccacagtggggacctcaatgtacttgtctcgcttgtacacatcctggtacacgggaacggggacgacgggctggtcagcttgcaggcgaacgttcaccctttcgacttcggcattttccgttgtgccggtaatgaacatcgagcctcccgcaggagactgtggctgttgaaactgagacattgtgtgtgtgcgaaaagggaatcgaggatagcgttaggacgagaacacgtgcccactcctattatcagaggtcctgcgtgagtaggaaaagccactggaaggtttgtttggcgattcctgaacaacgagcacctgcaagcatacacaggccacagacacactgacaggcctgatggacatcaagtacgttagatttctgcggtcagacgaagaggatcccaccaccgagtcctgccaaaaaaactgtcgctggcagctgtgatggaactgtttgtcgcgtcagaaaaaaaagtatagctcaatgcgcaaaagcccgtttctgccttcccaaggttcccggggtacacacgaacctcgagaatcgaagcacagcgagcttgctcaacagcgcgaagtgcgcttaacccgaagcggctgcgacacggtacagttaaatgaagcgtaaaagactagtcaggaagggagtaaaagaagatgtgccaaatctgaaacttagcagaaatctttccgacagcggcgaagaaccatttcacaagacgttaccctgtagctacaatgaggttgcgagcctacttgagcgctgccaagctttgccctctgacggagtggacggcgtgagctgcgcgccaggacggcggcacgagctgggcagtgcggaagaggggttttcgcaaagaaagagcgcagacaaaagaccgtcgaaatccctgaaacgttggcagaagaggtagcggcaattgcaggcaattcccttggaagaaacaccgaacgaggccacgctaacgctgagcggagtttctttctcgcgctcggggtagatctgccgtgcaagccggactacgtaaaatgactcacgtccttgcactaggttggctgccttgtcagagaggctcgattacctgacggaagaacaaagcgagcaactctgtgaatgccaagtactgcgtgtcagacaacaaaattcctggacgtggaagaactgtgtggaaaaacaactgggagaaaagaccgaaaaaagagacctcaaaagtgccaggctcttgatacgaacaggaaaatgtgatgacatggcacaggactagcgaaccagccgcagcaaggcaccacgcgcacgcgcgggcctggcaagtcgcgtgtccgtgtccatcccaggcgacccgcgctgggacctctctacagagtcgaacctcgtgacagcgatcgatccaactcgtctggtcccggtgttcctgcttcgagctcgagataagatgtcactagcaggccaccccacgaatgcccaatggcactcggaacacgttccagaaatcgccggctgtgcgcacgaccggggtttggctgagacagttgctctgctaacctcgttcgctcacttgctttcgcacgcggaataacacggacccacaccttctgggatccggaaagcagcgtaaaaagctcgctgtcgcccggttgctataggaaacagtattactttgatcagaaagagacaga

SEQ ID NO: 3749 - DNA, 1190 bp, Toxoplasma gondii
tttcccgcgttcgattgctgtgctaatcgttcatgcactgctgttctggtcactcggttgaaacctgagacagactcgacggtgaagggcccgttcgtcatcccttgaaaaaggccagcattcacccaacggcatcctccttgagaagggagggttcaaagctgaagcacatttgtgtgagcacttttcgcagacatagcatatagagcccgagttggtttctctgcgatgtattagccagtgcacttcgagtcactcacctggtttcctccacctctgggagaattcacaggcattcggcgcggttgcgttcccaggattctagccaaatgtgatctagtagctccctcgaggaaaagacaaccggagagtgcgtggtcaactggatgtggctaattctttaaaacacccctcgttccacctgcgtttcctgcaaaagtagaatttacgatggcttgaagccttgcatcgtcaatgacgacttcctgcttcaaagcgctcgcaaagcagaggttgctcagcagggtcgttttttgttttacagtggaagggactggtgatctgtgcattcccgtagtgcgggattcactgcttttctcaacggcggctacgaatctgttggaaccccacagacaatgtgtttgtttgttgacagatccctgaaggcgcccaagaacagcgctggatatatattcttatgtgtgtttgaaatagacacaagtgaagccactccgagagtggttttgaagtagctttgcgccaattcaagtctacctttttttggctggtgtacgccatgactcactgaatatgcgctgttgatcctggggactcgaaaccggagcggattcagcttccgtttgggatgcttgcagctgtaaggaatatggaatttcgtcatccacgttttcaacaaccgatcttgattcttttatatcactgaggctctacgaaaagccgatgacctcgatttccttcggcatcgagttgcatgcgcatgcaactgcgaaaagagagacgcatcgtcggtacgctgtggcactgatttgtgtcattttttcgcgacacagtattttgtcgccgttcccttttcgacacgaaaacactaccacgtcggctccaattctcattttcgagtggccagttgtcaccgagaaattggagtcttcttccctttcctgtgttcgcga

SEQ ID NO: 3750 - DNA, 818 bp, Toxoplasma gondii
catttccactgaaaaggcttccaggaggactcggaaaacgcagtgtgagacaagccccgaaatcctcgcagaaaagacgctattcacccgcagagggagcaccacatgctcacgtctaaaaatcgatgtaaatatatatatatatataggtatacaaagttataagcatgtatatacgtaaatgctctttagacatatatatacatacatatatatgtatatatgtatatatatgcaggtctgtatacaggttgctgcacgtacgtgtacctacatcttaatgcgaggcagttctcagaaagtgggcatgggaactaaacatagatggacgtatatttacaggaggatagacttgattatgcatgcgtgttgatctgaatgagttcatccaagagggaagaaggaattggagctaattgcaaagggagaaggcggagagacgaaccttgatctcctttctttgtttctgaagaagttttcttcgactgcctcctccctcttcgctctcgctctccgaaggttctgccccaggtccccacgaactcgcagcgctgttttccatctcgcttttctctcttcactccgttatcttcctcgtcctagtttccttctccttcctctccgctcttcacttctgtgcctccttcctgtttttcgccgtccttttcttcgccttcctcctcttcttccctgtccttcttttcatccgtcttgctggtcctctttttccttctctcttcttctttctgtctcgtttcgctactcaagacgagcgtcctctctgtctcctgtctcgcctgtgcttcgtgcgtgtttga

SEQ ID NO: 3751 - DNA, 2831 bp, Toxoplasma gondii
acatactgctttctgaaatctcctcgggtgcctacaactgtgtcgcttcgctccgttcgttacttttttccgaggatgctatccagccatattatatatatatatatatgcgcaggggtgttgacgaagtgaaacgtgaagccaccttctggtttttgtgttttttttcagtcagaagtttttgaactagttgacgacgaggcatgcagcggctcgtgcagtggtctgcgggatccgtggggaggagtgaagcctttgggcgggcattccgcggtcgcgaagggaatgaggaaaacaatgagtcgcggcgaagtgaagaatttggacaatcgaaataaagacgattctctgcagcatgcatcagcagcgaacaaggacgcgactgacgcgctagaagaagcctatcgacatgtcgtatctaaagcatagggacgaagcgcgaattgaatccacgagcttttcaaagacaaaccttctgcttgcatgcgcggttttgggattggaaagactgggagagtctgggtggaactccgggatgcgtggcgccgaaatctgcagtttcgacgcgattcgatgtgtgtttctcgtgtgagcgaaattgtgaggcgtatgtggagaaactttggtctgtcctgtgggaagcagtggtgcaatgacgtgcatacactggaaaaagaaaccagaaagagaacgcagtctcccagaggcttcatcctagagacttgctcccgcttaggggctggactgccgatcctttgaacaggaacaaaatatcagaccacaattcttagactgctgcgacagaatattaaacctaagactaattaactgagttaaataatacaggaatgaagggtaggtttgtttcaacgtaccaggccagtgcgaattgctgttctgtagaagccacacaacaggcactttcttctgatgctggcagcggcaagtgccttgagaaccagttggtagcaagcattcagaaaaataatcctgtcgcatttgttcgaagatgacagctttccttcacttttacctgcagcggcgtgacagttaacgcagaggccctcattctctctgtagctgtataagtgtacatgcgaattgtgtacgccagaacagtagaacacgcagaaatcgacataaaagtgcacatatgaatagcgtggcttccaggagagttaagcgcatgtctgcaggtgcaaaaagaggcatttcttacctgtgcgtttcgtgtgtcatcttcctgagtcaggtagagaacgtgtgaaaattggaaattgacgattttctgacagcctgctggtgtctagcgaagaagcggggccacagcagaatgtacgtgacgatccttttccaattagattcctttctgccgcttccagaaatgccgtcgaccacatttttgacatgctaaaaccattgccacaccggcctgtccctaaaaccgtgtaaccaccgaaggtcagatttgcttagaaggcagagcttctcagaaagtgaaccccgatgagtgaccaggaaagagttcagagaggcttgaaatgagagacatgttcgtgtgaacgaaatgtcggtgcgttgggagtggatgaccgtctcaaagctccgcatctgtgtattcaccttgtattcacctgttctaacagctagactagagtacaacggccaaaagaagccctcacgcgaggacgcgtacctcagtacaacgctgtctttaccaaatacagacatgcaacacaagacaatgctggcactggccgtgtttcaccttctgtcttgaagtcttctgtcgtcaaaacagagaacagcagactgaactggatgcctctacagtataaagacaggcgtcctctacacgccctccctcccccctctccgcggccgtcctatcggcattccgatgagatctagagctgtccacatggtcctgaagcaaaggtgcagtcatcggctgtacattgtcctatctgtgtgtggttttttgtgtggatcctttttctcgtctcagagacggcaggcttaccacgtttctccgtctccccacacttactctttgcacttttctatgtctctcctgattgggtcaattcccttttatccaatcacgagaaactcgtgacatgcgggacggcaaaaacgcagagtgttgagcgcgcgtcagggacttcaatcgggcgacagaatgatgacatagaggccgggtggtttgggtttcccgcatgaccctgaggcagcgaggtggttgtccctcattgcttggggttgctgtttctgtcccttgctcggacttgcggggggtcgaaatcgtggaaaatgtggctgtgtgggtgttttttccgggtgtcagcaatttgcagtctggcagaacgtgctggaatgcaaaaacacactttaacgggtaaaaggctgggtggaaatgcagacggtggccttgcaacggatgtagtggtgtctcttgaagtagagccgtctccagaaagcgcgtgtgtttccccaacccctcacctctcgcggcagttctgtcgtcttctgtgttgttcctccgcaccgccagcaggggggacgcgggcgaggaaacgcgtggaggatcggtctgcactttttgctcgtggggtgtcgtacctgtcgtttctctctcgaagatagtgactcgcttcaaagcggacactcgtctcagaaatttttctcccgccgtcttttttaggcagagaaagctctacaccgtacgtttgttcttccccaccagtcccgacgtcgcgttcctcggttgccgttgtctgctgtcgcgagcaatcccactttgttcgtttgagttctcccccgcaacaaaa

SEQ ID NO: 3752 - DNA, 2097 bp, Toxoplasma gondii
tacgttcacagagtttgtcgcatcatttgcgtccatatgtgttactgagcccgtgtgtccgtcccgcttgacgcatccaccatctaccagttccggcgttgaccgcgaggcaatcgccgctagagatacagcgggaacggccgagaaggttgctcgttcagtcgcgagtctcgagcgcgtcggagctaacggcgattggagccgagtacatcgacagaggaaagcgtcccaattagcgcatgcctcaggagccgccactgctgaattttgctgcctcctccaacctatgctctgcttaacaccggtgtctgtgttataccgcttctcggtgaaggtgcgtccagaacgaggaatctcggcaccacctcgacaacgcctgtcaacagacatgcagatgaaagttcgtggcaggcaccgctccggtggtccagcaacagactcccccgggaagtacgacggcgaacgactaaccgcccctcgccgcgcggctacgtccagcgcccgtggtctcatattgaaacggacagaggaaaaagcctgatgtgccgagatattgagtgtgtgtcgcacggaaaagcgcagaagtgttgaacatctctcgtctccccttacccaagcctacggggcagcgattacacccctcgtagacgggcagaatgatggcattttcggtttccgattgcaatccccgagtttccccctttttggacgagcacctacaaacggagaagagatcaaacgaaatgattctcgtgtgtctacccaatgacgagcgggtgtaagcccgtcaaaagcgatctgactgtgcgggtccctctcagttcctccggaaaacgctcacatggagagaacggtcctttcgaggatggtgtacggaacaatggagaggaagtgacgttggtttgacttggttggatgcaaaactgcgcaaagagccataagggaagcgtgtgagaaatcactcaacgcagcagaagtaatcaattcactggagccgccccggagagtcaccctcgtatcggagagcaagaggagcacacgagtttttcgagatgaaacaaggagcatcaacagagatcagagaaggctgatcagcaggtctacacttatcagaaggctcaggactgtcttctcaagaaaaaacgggactcagcaaaggccccagggtggcccgcctctctcaaaactcatatccccctgctgcattaaatccgcagcgggaaggaaccaccgttgcttcctccattacagtcatggcaagattctcttccatgatgctgacatggcctacatcgcggtccccgatggaagcgatttttctggcgatgcaacaaggaaaagatgcaaaaattgcatgtacgctgtcgtcgcctcaggccggcgtgcatgcttcagagtccaatagtgtgaaaagggaatatcgaggcccgaggccagtgtaagaatccagtgtaagattgtgaagaaaggcgaatgagcatgtcaacaatttctctgttacatttcttaagacgcctctattggataaatgatactgctgttcctctttcagagtctgaaatggtggagctgacgtgtcgctttccgttgttgaagaggtcagcaccgttcagggtcacctccaagcgcacacagaacaagaaaacgattaactaaaagtcgtggtgttttgagctggtagatcgtgttctgtcaaaatgagtatcatttgaagagtcctgaatttttttcatcttccaaggactttgacgcccaacgggacggcgccattgcgtatctagcggttcacggcctctcttcttctgttcccgtctgtttcattccctcatttcagttcggcctttcatgtttgcttgaagtaatcatccataaccgcacccaagatagtagccctcattccagtgaaactagcggattctaaaagcgagagatgttattctttcaaagtgtgcgtatgatgttcactctctctagtgcgtctttaattcgtcctcgttcgtggtacgttgtcatcgtttcttcttttgcaaccctctgttgcgcgcttggctttttgatgctcgataaacacgtaaagggataacttcagccagtgga

SEQ ID NO: 3753 - DNA, 3845 bp, Toxoplasma gondii
acactctgactaatgttggaatccaccaaaacgcgtgcgctctcttactcctgcggcctgggcctcattgcgggggaagccatcgagaatgaatcctcggcggcactcaggtgtcttcagcttctcgtcgatcaaaccaagaacgatttcgtcgctgacgagctcgccagcgtccagcttggcctttgcctaaaacagcaaggaacatgaaaaggacagacaacgaaattaaacgtggccccctcatttctcgtcagtgacccgaacgggcactgacacattcgattagccgagcaacgcaccctctcatgcaatacgagttccgtcggtttccactgttcgcggtgtggaagccacacatcgccagcacaactccatgaaaacaaacaacggttggtaacgggaagacacaacctcgaacctcgacggctgagaagcgaagtagtcgggatctgccttctctacatgcgcctatcacatgttctgcctgtagacgagcacaattacgtccatgaccagatacactggtaaaaaccgacccactcacaagtgtctcttgcctgcacgagcacatgcataacccgtctacaactaggtatgcacatcatctacagaagtgcatctgagaagatcaagtacaactttatgttcttagaatgtgaggagcgtgtgggtctcgatcagcgtcaccatcatgttaaatcagtccagttttccatcctgtggatctttagttcttcctcggccattcccagttggaccccgacgatcgctctgagcccgtctggcttctgcctacctgcttgccatattcggttcccgtagcgacagcatgacgaagcatatcaccggtgctaaggtggcagaggcagtggctcttcttcagtttcacactctgcgtgcccttcccagaaccaggagctccgatgaagatatagcggccttcgggtttcgcgaggcatgcatagcgtctcttcagttcctcgagcagctcgaccgtcgccacgttttcgaggtcaacgccctcgcgtttccctgacggagctgccatagtggtcgtggtaagttttgactgggagagcaatagagaaaaaacgaagacacaaacgaagccccgagcaagcacgacgcagccgcaggcctaacggaatccgtttttggtacggaaaaaacgtgcttccgatggtgaagcacaaatgcgttcgggttgaaagattcgattatgcgttgactacgtagtactgaacaaagacagcgtaggaaaaaacgaaaagccaagataggcccagcggtggtgtcgaagaagagaacctgtcgcatgcgacgagctgtgcccgcggatccccacatagatcatctgcattgcaaggcgaacggtcttgcacagccttccacacagaaaaaataccggggcgattttaagaaaaacccggtttttctcgacactgagagttctacagtaaacggcgacgcacaaaccaggctgttcctgtcgtcaactcacacagacagggattgtgaggcgggtgagacggaacaggcaagttgctcggtgtcactgcaacgataatgtcgaacagtggcagcacactcgtcgccacgaacctcgtttgaacgattgtgtcctgcaatttcaacactacatacacacaaaagaatagctgttctcgtctagtacaaatccgaactggcatgtagaatcgcgaatctacggaggtgtcctctgacgcactcttcagaaaatcccattcatttggagcaagggagtttacgtgagaatagacgccagttgctcttgcagtctaccctgtgtcgttcacaggaccgaaaaggtgggttttttaatttcggaatgtttcagttctttaatgcttccaaacctgccggcggtcaattttggtgcgatattacagtggagaccaggtgcggcaaacctacacccccaagctcgtttactgcgtactggactgtttgcccccaacaggtagaaaccgagcaaagggctcgacagtcaaatagtaaatccttgaataataaggaatagagcataatatcaagattcttgcctagaggtcacaaatgtaagatttccaaatacgcgttggaaatagctacttcagctgtactaccggattgattagatttggtattctgtaccacctggtctaaagctacggtgacacgctacggccggatataccttgctgtgaaggtgtgggcgcttgagtattggattacttgacggacggcagtatcatccagtcaaaagcgaatgagcagctgcagaatggtacggcatgtcatatcctgcataaatagatctgtcttgaaagtcgtttacgggacctcggtcaccgcgagaggcgatctcaggcgctgccatctcacagcgttcacttgtcggtgacaaatgtttcgatcgtagactttattccctgttccatttgccccatgctattctaccaccactcggagaagtgttcaagtgcatgcgcagtcttttggcgaatgtatttaagctcctcgagtaacagatctaccaaggattgcatccagacgctctgaacaacagtggccactcaacacccgtgaacagatcgtctgtaaatgatctgttggtctgcgatttctctccaagtgtgtaggtcaaccaaaacaagaccaagtgcgagcgactgcactcttttagttcagttttttgttggcgtcacatgcgttcggctctctctcctacctgctgctctagaaggtcgacaatgatgatgatgattggaggttctttttttgtgtctcggaaaaaagggtttacttcaggtcgaaattttcctggtgtcatctgctttcccgtgcactcggaaggtttcaccgcttgtccatccggtgtttcggaattgccagttttagaatctttgctacatacacgtccgaggccccttttcgctgttcccgtgccgcatatgcagcaggatgactcaatcgcttggcgactcaggccatcgacagagctcgtgtagttttcaacttcatgagtgtcatcaaaacaaaccgatttcggggccccacgttttatacgtactgccccatttcaaaagaatccggacacgcatgcgcattgatacagcgcgcacgttgtttgcggcttggaggagaaattagagaaacagatgctttcagaagagccaaattagctgtcaaggatacacaaggaggacacgagcgcttgctgttggatgcatgcatgatacctttagatacgcttcacggagcggaatcggaaacagacgattacgctcagttgccattcatgcctcctgtattgctctgaacaaacgtacaggccgacgctagataagcatagtttaagttacattgagtcgaatcaatgttgtcgtgagatcctgatggggagcttggttgagttcaagcgtagggcaacaatcgctgcatccgtctggcaaaggtcactggtatctagtatctccacgtatgcctcttctcgtctcttcattcttctccgtctgtacccttctgcgtccttctctatcttttaatcgtatacttactctctcttactctcggggctcccctcccttggctcctgtgagcaacaaatcggtttccattctccgcgagaagaaatttgacatttcttggtatcgtggacgaggaaattgctggctctgtttcatacctctggatccttcataaatatttccagaagagatgttttgtcactagatatccgggcttccgcctaccttcacgactttttgtctttgcatgcgccctgaaggaaacaagaaatcgtttctgagttccacggtttattatcaacgaaacagcaa

SEQ ID NO: 3754 - DNA, 5045 bp, Toxoplasma gondii
agaggaatgcaaagtcgaagtgcagtttacacgttttcgttcaaaaagaccggaagagaggaaagatccattagacacgacgactacgaggggtgggacgccacagtcgaatttacaactgtgaactatatgtgtacactgtatggacatcgacgctctttgtggccgacagcgagtgctgtaaacctgcctccccccctggcatcatccgcggaccgtctttcgtgatgtatgcgagaaaacgcgagcggcctgtagtagtcgtgttaggttcagagcgggaattaaggcagatggcccagccttccacggatggtctttgcacgtttgtttgctcaatagtacagcaactctgacgacctctaccgagaaaaggctgtgacgatgtatcagaagaggcactcagccattttcattaatagaagatctatcagcgacatcgcctcgatgtcgaccgccatacgatacaagtgagtaaggctttcagtttgggtcgccttcagggtgcgagtgctccaaatgtctcgcgaagttcaggcttcagcagtcccgtctccctacattgggaccagtggaaacgattctcagcgctgaacttcttgatctgaggaaattgactcacgagagaaggatcttaagacatttctcgatgcaggtgtggtcacctcggccagcgtgctgcaccagttggaacatatctggcagacctgaattgagttcagttgtccccagtttgtttattagcaaagaaagggaaaacaaaagaggcgaatctacctttttgcagttgctgaagaatcaatctggggaaacgaacagaaagaaatgaagcctggctccgcgcttcggtacgagagctccggaaaagagcgagggaacaatcggagaagttcgggctcagctggtaaatagcggcaccaacgcgcgcgttagcactcaacagaacgcaacagaacgtcaaaaaacgaaaaggtcggacagaagaaacggggaaaagattgctgaactggcctttttcggccggggaaagggccacccttggaactcagagagacaaacgttacagaaccgaacaagtgggcgctgcagctccgccttcaactagaaggaaatttcgcctcaagtttggatagaacgacacagattgctttcttcccagaaatgataacacagaagtcaaagttgggagtggaatacctaggccctgtacgacgcctctgcatgcttcgacgactatgcagcccgacttcctcctcagcgcttttctcctgcacctccgctcatcacattcagcgcagcatctccgctgactgcagcgacaaactcttctcttcgaaacgccgtgccgaagtgaataacgcggtattttccaacaagatccagtctttaaaattttccagtgccgaaaagcaaacgaccaaacatgaagcgctcgggagaaaaaaatcgatttccaagaagcgggcctacgcgtcgtcgttcaccttcgtcataggtacccgaggaagcgaaggcccggccgcgttaagcagcgggtggtaccagaccgcaccagcttagctgcccagcctggttacaagcacgctcttctgattccgccatctaatgagaggcagaaaatgcggcacacggaaggacggaagagtgtctggaaattgtgcttgatattctccgcacgatggattcgtccggaaacccttccaacgccagctgcgaaaatcggacagcgacctccggtgagggaatctagggtggacaaatctggcatagactcgcgcaggcggaacggcagacagcaggaagaactattgcagaaccgaaaatgaatcctacctcgaagaagaaccatgggcaagaccctatgagagacgaaggtaagtgtagggaagcgccgaaccttcacttcgattgtctttgcagaccaagccgccttggtaacagtcaaaaacgattcgagcaatgtctaccggacgtggggtatccaccacacgggagccaggctgtcgaaaacggagacagaacactatagctttctgtcagaaagtgccagtgcgggtgcctagggaccgtaccgttcccgaagatggagactcgagaaaggcaaacgacgtattctcgacaggacactaaggcagaactgccttctccagttacgtagcacagcctgccactccaaaccaatgccagcgtgagcagtagtggctgtcgctggtgccaacggtgggatattccagcctctacacgtatatatctttatgtatttacagtggagtcgtgttaaaacggtcgactcagctcaaccagaatatgggcttccctacccacgacgtttacagacgtcagcaactaatagatctttagctggactctgtcagctttgacgtaccccatcttcgcccgcccgtagtttctattttatattcatcagcttctaggcgtggtgtcgttctgtgcaatcccagactaaatcggttcgtcactcgttgggtgctcgacatcatttgctcttctcacatacgtggaaaaagtgtagccagtcactttgtcttcgctccatcgcccccacaacggtctgggagtcaagagacagtcgaggtactgccattatgcaaaaggcaaaatgtgtccgtatcttctaacaacgcaattcgaaccagctggtgacgtatggattcccactctgcgcacaacccacggagcaattgagcaaatcagtttatcaaaaggaatagaatgggtgaatcactgaaggcgtcatctgtcggacgatggaatttgtcacacagttcggcatacttgtacttcgttgtctctgatcttcttggaattggggtgctttagctgtatctgggtgatggcgctgtggagcggcaattcaccctagttcttttcgtgcgtgtgcttcaagctcgcttaaaccgtgtaaaacacaatacactagctgaagtctgtgcgttttgtggttatggaaacccagagtccatcgaggcttggttggtcaatatagcactcttccatggaaacatgctatgcgtacgtatggtattaagtgcagccaaggtagaggattatgcaggatgaaacgtaacctaacagagttttctgtatggaagagaagcatcaaactcatcggcacccccttcccgtcctgtctttgggtgaacttgaaaccatgcttagtccatccctgtggtcctctaaatttcttcggccctcgagcgactagttcgctccatctgccctacacggatagtgaccgctccttgtgagagccacacccctccacgcgataatgctggagctttcccgatgtcacagtgatagtatagccgctccagtatcatacataacacccggctgtacacagcaggtacgcgggagcaatcgatcatagttgcatgccgccaggaaaataccgagacgcttaccaattacctccgagggtgtctagcggatgaaaatagtgcccctggcttacctctatgacaacaagggcgcagtgacacaaccagtcacgccaacagaaacaaccctataacttggggggagagggggagaacgcaaaaatgtgtacgatggcaagacgcaccatgaggtagacaaaacgttggttgcggtattaagtaatctttcacacaccaggcccttcagcttcccttgccagagagcaatctggtgaagtgttctggtttttacgaccttgacctggatataaggcgtttcccgaaccttgctgtagcctgcgagtgcatcctactccgttagttgggaaacacaagtacgcatacctctttcaaggttctgcgcttcaggactgcgtgacaagtcgagcgtttccgccggtggctgcatttctgttgtgatggctgcgcgacagaggcaacagtctactcgctggtcagaagctgacagtcactctatggccgacgtggtctagattcaagaagggctgccattcaccgagcaaaatgcacgcgtgtgaagcagatattgccgtttgctgtcgatcaggtatgccgcagggaaggcgcaagaaacgagatggtgatccaccgacatgccgttattagacagtatcttaagctctcattcgcctggcatccgccggacaccccttagtatcgaggcatttgtcaacatgaccgtccagatacctcccggggttctgcaacagaagcacagtgtcttagcagaggattcatcttcgttatagtcttgtggaagaacaggagagaacagaatgcaaacaaatagttttggtgttctcagtgtgtctgaagtctaggacttactgactcaaaccaacacctctacctctgggctaccccgagtaaacgcgaaaccgactgacgaaaagatggcgaggcagcagacccgatttcgatcctcgattccaaacagctgggcgtggggttcacaggttcactacgcgaagagagactaaccttcgggtttgaaggtttctatttctcgtcctgtgtcttctaggccgcttgtgcatcctcttgaagcctcgctacacatcacaaacttagcgttatttaggtttgttgccacagtcggccctcctcccggcaggatgcccgcgggtttcttcacgacccactacgcttcaggttgcagatgttggacgaaacacatacttttcagaccgttgctttgttttgcctgctatctccagcatattttcgtgctataaagttcttctcctgtctgctcctttttttgtcccctggacacgccgtcccctgaggtacgtggcggcgcaaaagaccagaggggcccgcccccccgtctccgtactcttcgatcttcttccttgcggctgtcaccagagcgcggcaaagagagtctttctgcttttctcttcgcaaaaaatcgtctacgttcatggaaggcatttctcttgtctcacattttttcccgtcgtggtcaaacgcgcagacgagaagaatccgcgcacgatgacgccgcgctcagacggttgccgtctgccggcgggagggaatccagactcttagttgtatctttgcagggcgtgacga

SEQ ID NO: 3755 - DNA, 1843 bp, Toxoplasma gondii
atacattgaagatctccgataaaggatgactattccaccgcagaagaagcccatcaatatgcttgtctcagagatggtggctccctgtacgatggtactggtcactctagcatctgagtagtcgtgttcagacgatttccattctccttatgtcataaggagcctggttgtctgtatcccgtaaatgggtcaaaatcagtgatgtagatgctttacctatgtggaataagcttcatgtgggaagagaccgaaatccagcgcttttaccggtcttaagcaatccagtgaagttgtggtgtgcagcactcgtaaagaacttggttgtctgcacttcataactggagtgtggctccgaagaaatgacaacaaaggaaatccgtacgttacactcagatcacatctattcgcaaatgcactgccgcacgctaagagagaggaccgcaacgcaggaactgctgggtcttcacggattttcagacgttcgtttccctttttcgcttcagtggtcgcgaaataaccaccagcaaagacaattccatatcgcaattccctttcccgtataagatcgaggaccatttcggtaaaagcggacgtgcctttctatttgtttgcgtcactggcatataatcgcgggagctctgtggatcgcgcttcatgcaagatggaacgaaagaaatctctctttctctgcgcctttcttgtcaggcggagcccggtcttgtgttgttccgtttcctagagggtcgcctctggactgctcccgtttttctagagccaacaagactgataagcgtgtctagcgctgggcgaagcgacatgtttcctacccacttcacttagagatccccgaaaggaagaaatcagtctcgaaaccgacctcaaatgagcaagcaccggagcacctctttgaaacgagcaagggaagaaactccgtcctttaagacacataaacaacgtgacaaacacgcgccggactccagcgaccgaataagccactgtctcgttgttcatttacctcgatcaccccccactgaacttgtgctccatgcggttttgaccctccatttttctgattgctgaaggcttgctcagctgttgtttacgagacggcattgtggcaagacgaagggagccttgttgtcacttgcacccatttcactgggtttcagatgagtctaccaacttccaaggattttgtcacttcctgttgcagccccagtcgcctcttttgccgaccctccactccacagaaggcaaacaaactccttcacttttaaacgaatctcttcagcttaatcttcaccgttactacacctttctgaggaactcccagtccgcgtccccgccgcatgctgccatgtccaacctgatcacgtcctctttgccgagcgatacgggactttccttcagagggccaaggctgcagaaaaagaacagtaatacgattgctggctttctttctcgtaatctttcttgttcctctgctgtgtcttttctcagtcttcttcggtttctcggcttctgaaggcgtctttctcgcgtcgcgcggtcgcccgcaaagtctcaaccaggcgctgcaaacgcgtcgattcacagcgtttcttctgtgggtcgttcgccaggcagacgctatctccgttttcagtcgtctgctccacactgcctcttttctcgctccgctccactggcttttctgtccggatcgaacgaagttctcttcacagaagaaccaacgacgaaactcttgtctcttccccgtggatacctcgcgcctcccgcctggcacatcgactgtgctcacaagaacaagcggtgtctccgcatctccctttcctctccacca

SEQ ID NO: 3756 - DNA, 4906 bp, Toxoplasma gondii
taggttcgcggacttacctcctcctcttttctttgcatcttaactgtgacaaaaagccagtagcattcagttgctgcggtgaatacttgttgagttttctcacctgcgggactatctacaccttgcaaaatgtcctcgatgccctggttggaaaacaactgcgtcattttccttaagtcacccgtgagacacttcgttgttttcacagtataaaagatgtcgtactgcatttcagcagagggcttaggtgcattcactacatacacgcctgctccctttatagcatctaaaacgttagcactatccactaaagactggcagatacaagcccgaggcctcttaccggggttcgtgagagcaagttctctaatttgcatcgacagacccgtaagctggaaaaacgggttcgcctgtatggcatccgcgaggcctgtgcaaaccgtgaggatgagctccatcgaccttgtgtttattttagtaagcacaccttttgtcaaagactcaaggcgttccgctaagataatccgttgaggtaaggttcgatcaacaacaatggcaaaggtcatgtacctgctgcattcttcagtggattactggggttaactgaagcgtgcaataagcgcatatacggcactctcctacgaagaagtagaaacattgttaccggcttggttcgcaacggcagcgctggctggaacaggtgctgcctgcatcgctggtggcgataccggcatttgagcagcagcaggggcgccgacagcggctagcaacataagagttgaagcaacagcgttcctcatcctgtaatgcggaggacgacaaatgtagcaatcgtggtcgagaacctgtgcaaagtaatgtcggatcaggggtgggcgtgagcaaccggcacctgccgtgtgccgctgtacctacagctgacaccgaactgggttgcaccagtacaacagagtaattaatagtggataccaatatgtaccgtggtgtctgtgtataattttcaccgctatgcagtggaaactttggtcacaagaacggagcgttcgtatcagtggcagttgcacaggacccgaactggactgtggttgacggcacgctcctgctgttgtagagataccaggacgcttactcatcatactgcacattataatgacaagacggggttccaagccgccacacgtcagcttgaagatgtgccgatctaaataaccgggacgttagcaaaatctagttgtcatttactatattgtgagtcgtcgcggtcctggaagaccctgtacaccggtccccctttgtgagcagctaccgccccatgtggtacattattttctctgctcggaactattgccccatcactcttcagcaacggcgtatactgtacggcatgtccaccgatggacactttagacgtcagagaaggggagccggagtcgtagtagcttctgccagtgtgcacgattcccaggcaaggcacgtgccatcgtcgctgcccgccgtacaccgcgacacccttgtcactgaatattgtcgctaaaaatgacactttaccaaggaaacaagtgagcatcctgcatccagggcggcacttgagtccgtcatttaaactttccagttcacttctggaaacagtggaaaaagtcatgagagtcattgtcgcgtaagactcacggggtaaagaggggaggtgcaggtgtgtgtttttccactgaatgttttgtctgacaattccgcagtctttcccgctagggctgcccagccaatcgtaacactgtctcgattgggcaaagcagttgaactgtcgttcgagagtcccaccaccagtcaagacgcgtcttaaccgcacaccgccatgaaagcggcgacctagtctcaatctgaagtcacctgctgtttctgatgaatcccgcccgacgccactgataccttctgcgtttgaaaaaaccaaggattacaatacgataaatttccattcatgctcagaagcgtttatgtctgccggcaagttagctgagaagcaaagaggctcaaccgcctccctgtcacgccactgtcgcaacgaaagataaaccagccattgaacgtgcagagctagaagccgtatcagaaacgccaaccgatagcctgacgcagccgctaccgccgcgcgggtggtattcgaacagctgtgtcaagtaaactgtcgacgccgttcatgcatgccggaaacgtcagagtatggtacctgggtcagtcacactttggcacaaattccccttttatgtgaaatgcctgctgctgcgaagccctgcagttccattgcttctttggcgtgcaggtggtccagcccaattgaggactctggatatgcaggtgtgtacagaacgcagcacattttgtcatctttccattcccacacagaacactgttggcatacatcaaagcgatgaagttcatcccctcgtccaaccacagcccgatagagctaaccgcgaagtcatcaagtgccttgcacatgattgaagctcatgtccgcgtcaggtccttgtcctccatcgttttgtcaacgtctgcgcgttcggaaactgcgttgttatcctcaacgacgtttccccgcgctgcgttgactgtttaactcctcgtcgccattcgtgccttccgcaccagcgatgcagtcgcttccccccttgtgctcagcgctcgcgcccgtttcttcttcacctccatttgacgcatgtgcctccgtcgctggcagccctttcttcatttccgtcccattcccaggagttatgttgtcttgacagttccctcggccgtgctcattgccaggggcgattcagtgggagcccatgcgtcaccaaacaaagcagatgatgtaaatgccctttgcaaaaccgaatcaccgagtccaacagcgctgtctcccccataaccggcccagagacacttggctccgagttccctgcgcaaaatcttggcgtcaccgctttcggtggatgaaagaacgaccatgtcgtgcctccgtatagaaacaaaacttgatagcagatcgagcagtttggtcacagcgtacgaagcattaattatgtaagctcgtgaccagcttttgcccgcggcatttttcagtgtggtgttcgcaagtttgaacattcgtgataggccactccacaggaagaagattctggaggcagacaagcctttcatatccacaataaacactacgctgtcttctgagtcaatctgtttcacaacttttctccagaacgtctccagcatgaatctcaagaacaacataaattctgtgactctctcttctgatgtcaactcctccaacttccactgccctagaggcaggacaatctgtatgcttcctgtagattctgtgccacaagttcgacggtatacgtgcaccgggcattcttgtatgtatttcgtgaacttcggcctgaagaagtcgaacagatcatcttcccaaaagtcttctgtatcaacatcctcgatatcggccttgacaaatgtgggtcgcgctggaaggtccgttttggagccccaatcctgccgtccgacggcacagcatgctagtagtgccacaactagaaccgcctcagcgacccatcctcctaaaacgcggactcccgtcctctcccgtcggacgactccataaaacgggcaaggtaaatccattgcagaggcgacgataggaaacaacgtaggacgtaaacagtcgagagttgtcgcctctgcggattcgggccgcccttcttggaggttatcctacgaagcacgatgtaccccctttctgccacggtttcgccggtgcttgtgttgcactgcatttacgacggccgctggggggccaaaatcgcttatgtcagagacggatgcatcaagcgctcaaataatccccaaacggtctaccatttcgcctatactgtggcagcgacagtacggagagtgagaatcgaggagcgttggttgaaagaaacgcctctaacatccttctcaagggcggtcgaaacagtccgttgtcgccgctcgcttccagaccgttgtctgcacgcgccggagacgcgatgcttcgcgccttacgacagcttcttcctgtatctgctttgcatgcacagtcggggctgtctgtcattgcatctgatttgcctcagtgacaaaataccaactcaagagcctagatgacaaggaattgatccgtctcattctaaccttttggtacttccatccaatcataacacattgaacttcgcatataagagtccactgccagttagctcctacggtctgacactgtccacgcgcagccacgctcaagcacaagattgacggtgtctcctgctctcctgcatgctgtgcgttccatgggtcgcgtgatgtttttcccgaaatagagtgtgaaagctcgttttccagctggagtgacagaattgtttcttcatcgaagctgtggccgctggtcacatgtctcctgtttcttatgaacagcgtctgattcttaccctgattgcagcgcggcaggaccatcacccttcttgttacttttctagatgttgtggtgtctcctttctgactgactgtatgatatcattgtttctacgggcatcagaccagttgatgagtgtggaagaaggggctattcttcgcgtgtgctgatataaacgtagaaaattgcgactctagttgctctaactcgcaatgtgtagaactggtgggtgacttccagcgaggacgcagtaccatcatggtgctgtaaatcaagcgaattcacaccatgaatcaagcttcctgcacagatatcaacaatgttttgccacgctgggggaggaaatcagtcctcaccacgaacagctgacagttacgcggaatgaagtcgttctgcgactgaggccctttgtcacctatactactgcctcgaggaaaa

SEQ ID NO: 3757 - DNA, 2126 bp, Toxoplasma gondii
tacaggtaattcggctccgaatgttatgtgttttatgcagcccgaatgctggcagtccgaaaaagaccgtcgcgctggacctcctaagtgaaggcaactactgccccatcagtggagaattactaggtgtcgcgaggctgaagaggcgccacatgaaaattctcggttggaaatacgtagatgtgcgaaggaagacatggcttaagcttcgcacaagggaagaaaggtgcaacgcgctccgcgatgccattgccactcagattctttgttagatactgcctggctggagttaaacattcagtgacgggtgttgatgcaggagcgtacacagggattcctttaaggaaacactcatactttcctttttgggggtcacgtattatactgccaagtctcgaaaacgatatcttcacgattaagtaagggacaacaagtggaaagatatttggtttatcacgcgagtgagggcggctgcccttccaccatggctgttcccgtattatcgaatgtcttgataaaacaatagcttccgtaatggttgaaattcagtgaaatgacacactcacttttagggtcgctgttgaaggggcatgagtcgagaattcgacgcgcactggtctgtgcagacgaggatggtcatccggtactggatcatcaacgagaaaaactagttgcgtaccctctggcgttattaattagaacgttcttgttcgcgtttgtgccaaagttgcgcacggtcgtgttcggcgaattcacgatgacgtactctgcgtagtcattgtgggaatctggcaggtattgctcccctacgggaaaaattttcaatagctttacggtacccgcggcagaggtcagcacaaaagcgcacctggttgattcacaggaaagacatctgaattgtatacacgtggttcccgagctctgagactgacacttagcacgactgttacccgggacgccttcttcatacatgatttgccgcgcctagaaaaacagtttatgcgtgagcacgagggggagcggtcctgcaagggctcacacaaatctaccttaggagctttaacgtcgagagtgttgacgggatactcctcgtctagaggatgtgccggtggttcacggtccagatttcctctaacaacagagtacgcgcaacattcgctatcaagagaagcggcaagtgccgctgtcacgaaagccaccttcatttttggtgcaaaggctctgtccattgcttgaaggttgtaccactttcggttatgctatgcgccagggacacaacttaactgaagtgagtgtgaaatgtgtcactcaacgttgagctgtatgtaccgagcacggcttgccgttgctgctttgcctcacgcctcatccaccacagcggagtctgcgagactgggccgatccgcgatgcacgaaaagaactgtgaaactgggtagaattgcattaacgaacattcatgagaatctgccgaagagaggcatgcttctatgaggcgaagttatggcaacatgcgtgaagttagcgcctaacatggaaaaccgacgttattgagtgactagaggaacacaacccggctcagcttgggacaggactatttaaaagctttttctgggacattgacagtgctagtttggcacaaccacagaaccggcaacttattttatgattcttattaactggagttggagcacagtgtgttgctagtgctaacatttcaagacaatgtagatcgggagtatcaaaaagcggtgccgatgctacagtgtgccatgccatccgcacccggggattctggctggtaatcttcatcttgttgacaccttgagaaaacaatgatctcttcgacggcattgcttagacagatgtgtcaagcatgaggcacttgtgtgctgcgtccgcggctggcgtggatcgtacatgcgccatggttccatgtggagtgcatgcagcagacggggctaccaaattcctttccgaactcgggtgttcgaatgttctaggatacgcggaattgacatacatgtttgcctgtttgtttcatgtgttgtccgaggatacccactggtgtactggatgcctctagagatgtagtgctaaccgtgcgcaagacatcacggatagcaaa

SEQ ID NO: 3758 - DNA, 2384 bp, Toxoplasma gondii
acacatgcaccaaggaattcaggagaactcaaagactgttgtcgccgccctctgcaagtccttcagtccagtcatcagtcgcaaagactcagaatcgaagcaggtgtcgccccggcgtctcatctctcgctctggcgagacgcgcaccgaccggagcttactcgctcgatggcgtccatcaccttcgggctctggaactgcgtgcaccgctgaacggtcgctgcatgcagaaagaacccacagagcacttggccgcatgcaggcgagggcagaaacggaaaaggcgtcctgtggaagtcagagacgaagaggagagtcacagacaggcgctgaagggattgagggaaggaagaagttggcggacagagagcagcgagagcaggactgctcgaaaggtgcagccaagagtcctgacgcgagcttcatgaccgtcacagccgacgaaggcgcgacagagaagacagaaggcagcgagaaggagggagcagcaaacaacacgaaaagtgacgaagggacgagaacctgccgagagggagaacaggtggcgtcagacagaacgcacagctcaaaaaaaaagttaccgacagagcgccactgttggacagagcgccactgttggacagagagacctgtagcacgcaattcgtctgcttccttcgtggttctctacatacacgcgataacctgattgtagagggcgctgatgttgtgaggagagccgagacgctgcaggagcacctgagactcagcaaggtctccggcctctcctccacgcccttggcgccccctcttgagcgcggccggctgcatgctggcgaagaagcgcagcggcagagggcgagaacaggtcgagcgcgcgacaggaagtacggagagaagaaatccgcagcggcagtggaagagagaaggcgagaccgaggaaacgaaaggcgagcagagagcagaagccgagtcgtggcgaggtttggactcgagaattcgcgtctggaaaaggaggacgctctctcgcagaagagggaggacaacagggaaacgcaactcggaggcggagaagtgaagagctgctgcataagaaaatgcgaaaaaatggggatggtttccgttgtgtctctcaaaaaccgaagaagaccgagtcgaaagacaccctgtctctgggagtgcgcgctcgcagctctccctgccccttccgcagacgacagaacgaccgactcgcgctgcacagactctctctggggacgggcagctgaaaagagagggtggaaagaaggagacagcggagatagagagacacaccgagagacgaaggggagagacagcggagaaggcggtcacgagacatctgagcgcatcagcgtgcacggcgcggtgagtctgcgcgcgaaaaccggcgaggcgggaaaaagacacgcactgcagcgcagaaaagaagcgagcaaagagaagcaaacgagtcgaagtgaaaggagaagtccgaatgaaaaagaaagcagctgaacgggacacagaagtgaggcagacaaaaatacgcgaaagtcacacgcagccgttcgctgtgttccggcaacaacgcgcgcgcgttcggaaaagctgtctctgcttcttccatcttgttcagcgacctctccattgcacccttttatttacatgtgtgttgtctatgtgagtttctctccttgctttctgtgtccaacagctctcctgcttctcgccgggtcgcgcttccactcggagtggcagatcgggtgtacatacacacctgcctctgagttctgcgggcgactctcaggaacgagagccctcggagtcgcttcgtcctctttcctccagtttcctcattcccttgactcgagccaggacaccgttttctggtgcttttcagtgtcgaacgcggactcctccgctgtagcgcggctcggcggaagcgacggcggcgcgcgaggaggctgccgagcggaagaggacagccgctacgtggaggaggagaagagccagtggagaggagaagaaggctgagcaccgagggggcgaggccccccgtgtggagagaagaagcggaaacggggagaagagacagaaaagaagaaacgtcactgtcagggcgcagacggcatggcgagggaactgtctgtcgccgacgccagacactgagaagagagagaagacttggatgagtgccctaggcctttgtcgagcgacctcaacgagaaagattggggcggagttcaggaagtagacatcagccaccacgcattttccttctctgtgtctctctccgctgtcctgaggaccagcaagaccagcaagagaccctcttcttctcccatgcgcactctctgcctcttttctcgcagctaagagagcagtactgctcgaaaagagcgaaa

SEQ ID NO: 3759 - DNA, 2832 bp, Toxoplasma gondii
gttcatgattcaagagatgtgaagattctcagtgtctatccgtcgggccatcccgatcctcacatgcgaggattctttttgtcaaccagaacagttgtcttggcagctcggttgacttcgcgggagctgcacatagaagactccgtttgtttttcgaagcgggacaaccaagtcaaaacgcgtgctgtcacagctggcgaacccgtttcgttgaaaacgagaatcggaaacacaagtcaaggctggagcgtttcgatccacaccaggttcacccttgtagccaggaaacaaacacacgccacgacttcacaagaccacaacaacacaccttcctagtcttgctttctgatcagtttggtcccctcgtgaacaagcattcagagtcctaacttcatgtggacagacatcactattttagctcggtacgtgcagcatatcaagacgaaaatacaaatcaactgagttaactaatacatgtttaaaggggtgtactcacttgcccatcaacgcgtgacggcgaactctttttccccactcagtttttgttattttcaaaaactgaaatggcgtgaacttgaggccaaggctgtgtggaggcaaaccataggcgaggaggggcatacatgcacacggctatacgcctacagggtctaccgtcagaggaaagaacttccatgtatgcttatatattcatttatgcatatatatgtagcaaatgtgtgtatctatataccgtcggccacagacagtccccctatgtggcggggatattgtatgaaacacgttcagctcaagagagtagaatgttacagaatcatgtcggtgagacggagacactcgcagctgcacaccgcccctgagaaagtcgatatctgtcagaagtgtagttctacgtcatctacgtcaaaggatagatacagctgcgggcgtggaagatgctacgcacgccggggcttctgtcctgtccttgtaaaggcaagtttgccttggttgagctgagctatcgtttgcgttcatcgttctgaaaccgttgcatgtgctcggatttacgcttttccagccagaaggatccccgattatcaacaactaaggtatggggcataagggagcctcgctggtatggcggcggctcaagtttcatgtagtgcgggtgacgattctggcaggctgttgaatctaaaaatgtattagcatacctcgggcgtgtctttgcgaggacaatttagtattacacttgccaaaaagtgccatgggactgttcagccgttctcttcgctttgtccagagccattccaccagcgagatacacggaagcgccagcgcgttgtctctagggtggacttcgattatatatgaactgcgtggattcctctaaatacagacacatcggatacacagagaaacagacttgtaaactccctctccgtgcaaggaaacctatgcacggattcttcgccgagtgtattgagtctgcatgcacacgtccatgttgcgggttttgactctagacacacacagccttttgtgccaggatgtagccaccgagtaacatctgttttcactgggcttgtctttgctcatatttcatctggtctcagctggtgacggactggctttccgctttcttaattggaccatccaagcatctcgaggcggcggtacaagccggcacacgctgtcggtaaagagtctatggcttgcaagcgtgcgttggggcacaactgtcacttttctgcgtgttttttgccacgtgtctctcagttttgccttctttgttgcttgctgtctcaacctcgcgaatgctgagagtgtccggctcaatgctgtgaagcgacctcgcatgattactgtggcaagcgacagttcccgccgtgtgtctcgttttcgtgcgacgtcgttctgaatcgcttcccgtttggtgtgcccgcctcagctttttagctggcttatttgacttttcctttccttcaccagttgtagttacggccgtataattgtagaagcgccataaaatccgaacctgacgcaacgacagcgtttgacttggcgcggtacggactttgccttctatcggtgtgttgactaaaatgcccaaaacacaagcctccagaaggacggagacggaaacgaaggtggatccgggaatgttctgcacctcacagaccgtacaaaaagccacactgaaggaaatagcggaatgaacgggagggtatctgctcacgaggcgctaatgcgttgagtcacgcgcacacaaatacataggtagttctgtgtatgtcaagtatataaatacaccttcacgaagttggctaacgggtgtggcaacgccgacatcattagtgctgtctggagtgaatcgacctatcgtttgcagcctatcgttcagcatcgtctacccaatcacctcaacacctgcttccacatttctgttcttgtactgcagtatctgctttttgacccggtctccctgcttcgtatgaaggttgtttcgcagtgcctccacgtgtaatgctgttcccttgcagttctgcctctgagatgcatgcttttccaaatactgctcgtcatttttctcactttcacatggccgtgtttcctacacgtctgtgctctcgccttaattttttgtgacccttccacactttttagctttttccactgccatgccatgccgtacatctagcagtctatcgacagtatcggccgcacgcatttttgccgtccgcgtttctcccctctgcctccgtgccgtttgcccctttgccccccctccgcgtatcttcgcttattccccctccactctccccgtccctaccctatagtcgatcagga

SEQ ID NO: 3760 - DNA, 2624 bp, Toxoplasma gondii
ctcatcctcattggaggtgttttcatcgtcttgagcacattgctctcttttctccgccggtgttttccgttggcccgtgaaaaagtcttgtttcgtggtgtgtcctgcgccggtgatgctcgtcagtgcccgctcgagtgaaggcgtgctggcgagtctcgcgagcatgtcgcgtacacgatctgaggcatcgctctgcgcgagagaattggttcgttgcgcgtcttccccaccttccgtctgagacggagacactggagagctgtcaccactgctacccccgcccaaactctggttgtctcctgtgtctgtccgtttcaccggcaaacctttttcatcagcagaggacgaagacaactcattcctcaccgaggtgccagcgccactgctttcgtccttggatgcggatggagctgctctgtcctcgaaagtcttgtccgttgctgtcgcactgcaggcgaccccgctttgtttgaccgcggaactagactccttcccaacattttctttctgtgcctccccgccttcgctagtgttttcagtctgtgtaccttctattttagcggcattcgcgctggggttgtcagctgaggaagcgacttccacagctttctccgctgtttcgtcttgccacggtaaccaagtctgcgtagcggtatcgaagtaccaccactgatccgcggacgaatcatagtaatattgaacgttgtcctgctccatctttcctgatcagtttcaagagagccgtcaaacgccaaaaaagaaacacggggctcgttttccctttactcacgttcgcactgagctcaccatcttgaggcaccgatagcgcgacagaactacctgcaggcgtacaactcgtttgttgcttggacgcgcgctccagatactggtaccggcgcgtactttccaacaactccaaaacgaatcggctactacagtgaaacacttgatcttgttcggcgccacgaagtggcttagaagttgagttccctccgctggcaggctgcgtccaattgcgtaggggggaaggggacaaatattgtctaggtctgtactatgctttaactggacacgcataggttgcttttaatggcatattctggatataaggtccctatccatgaaaaagaaaaatcgttcgacacaacttcccctgcgggacacgcatgcgatggagctagaatgaagaaggcctctcaatgtttcgcgatcgaagcgccacactaaccgtcagccattaaaggagttgaggaagtcatactcaaagaagaagtgtattttgaaaaaaggacgttcccccggatgaattaaagaatgccgcagcagtgaatgcgccacctacacttggaaccgcagggcgcagtgctcttccgccgccacggcagcttcgtcgaagcacttagggaacaagatgccgtttggaaggagtttctccgcaaaacattgtaattgccgtgcaatatctattgaattgagtcgctggttgcgcagcacgccccataagaaatggaaaaagtgtctttcaggatttaaaacatccaaagcacacacataaaacagcggccgggtaccgtggtacgtgccaaaggtcggtggtggctagacaagttgcatgtatggttcttctttggcatcggacagggaatgcgactagaacagccaaccaagaaaacattttacagaaggatcggtgatggatataattacggtgagggagagttcgacagggccagtgcctctctttgcgcgttcgaccagcgagcggcacggtcacgggcttgcttgcctgctagtgcggggttcaaatggatgttggcactttttgctcagcatactacagtagataaccccgaattcgacacagagccacaatacatttctctgctttgtagtttttgtactaacgtattaattgtagccgtatggggaaggaagacaggtcgtgtttcctgctgcagtggacgaactctgcgaatgggagcagtgctctactacactcaggttgttcaacactacgtagaaaatgtcccttgtctctcgtgatgcacggatgtctcgttacggaatgccgagtcattgggaaatggagagctcttatgtcaagattaaaaaccatgagacgacggcgcccctcgtagctcttcgacccaaaggacactgtctacaggacagagaggtggcttttcgttgtagctccgcggatttgtagctgcagtagtcgagtagaacatcagacagatgaagctggtgatctgcacaaaggaaggcgacttcatattcggcacaccaacttttcttccgatctactttttgtggagagctgacacgggaggtggggggagccactgaaacgcagctacggtaaacaattcatttattcgggtgcgttcctttttggctttttttctcgtatcacattactctgaagtataagcctttgccaattggtgtggaatatgtatcacttacatctgcacagaaaattttgaatatccggatctcctcaccagggattcctcccctaactgcctctcctggctctcgagcagaaccactgaacgactgcctgtaacggctctgcgtttcttaccgctttgttctttgattttatacaacagtaa

SEQ ID NO: 3761 - DNA, 1772 bp, Toxoplasma gondii
gagacgcctggtcaactcgtttctctctccagccaacagaaagcgacatcccggagcacgagagagccgtcagatgaagcgcccgagacgtgaatagccacgcatgttccccgaagagaacagaaagcctcacctcagaggcaccgccagctgtgtgccgagaagattgtcttgatggtcacagaactgaatcaccacctccttgttgaccccagagcctgggctcgcgacctcgcccccctgttgcttggcgcgcttcgcaggcggcgccgagacctcctcggcgagatgcatggtgaacagaatgaaggtaaagagagagaactgccgaggaaggagagagctgctgaaaagagggaacgccagtggagacctcagcgcaaaggccgaaactgcgttggcgttcctcagcaacgaaaaaggaacagtagaagaagaagcacaagaagaagagcaagcagtacaagcgggagagcagggagaagaacaagcaagagagcacgagagagaagaagaaacaaaagaagaagaagaagaaggacgagcgagagactaggagagagaacaagagaaagaagaacaagagaaagaagaacaaaggaaggggtggcctagatcttggttcttcagctgtttagacggggcaggttttcacggcttttcaggctaggagagatcgaagtatttcaacagacacaccaccgacggtcaccagaaaacagatggacgaaaaggaaaggagaaacaaagatcggggagacgaggaaaaacaattcgcgaacggaaataagcgaagacaagtcgagcagttccggggcctctccgacttggtgccgtagatggaaacgccctcaaagcatagcgaaatgggagagggcggggcgtcttctttcttaatggacaaaaagcttttttcttaaactggggaaaacagactccctgcgggtctttcgcgagttgagtcgcccgtgggatggcgcgagggacatgcgcagcagagacggccgacaaaggagaggatgtcttcaatctcctcgacaggagacagaaagacttttttttgacatctggtcgtttccagaatggttcgttggcgttcttcctttttcgcgagaggcaaatcgcgctatatggacgtcgtagtttcccgtgcatgcagatttctttttcagccgcatgcaatgaatactcgcgacgaactcgagaagcacaaaaaagaagaatgtggattaagacgtctttttcgggatttcagtgactcgcttccatagctggtatttgttgtgccgtttgtgcatgttctgtcttggagacaggttctttaactcctcgggcatttgtgcagccgcggattctcctcgacaccgttctctctataacgaggcgtttcgtctcccttttttccaacaccacttgcatgtactgtccttttcttttgtctccgtcacctcgttcatgtttcccccctgtcctttctcttttgagtccggtttttcactcttctcgccaccacccgttcgtcgagtatgccgctgccccggcctccaagcctagactcttctgcccttttctccagcagtcgcgcgccctcgcctttcgccttgccttccatcttctgccgatattcagtccagaccctgcgtccatgttgacaaaggtggtgttcagtctctcctctcctcttgctgtctgtttctcttcgaaaccctctgacgttcgtgcatgcggagaaacctgttagcttcgtctacaaaaagcttcgcatccaataa

SEQ ID NO: 3762 - DNA, 1700 bp, Toxoplasma gondii
tgagttgaggtatccgacccagactttgacctggaaagggtctctctgcagctcttgttcgtagacaatgtctgtctcctttgtgacgaaattgaattcgtcgagagacaccgaagcctctccacctgcaacggcctcgctggaggatgcgtggtgagacgaggcgccttcgtcaggcgccgtcgcgacggctggcggcatcctgctttcgggggatctctgtgaatgttcaacgtcaagttgcagaagacttgcgcgaaaagcgctcgcgcctttcttcgaggttcttctgccgtcagtccgagaacagagacagacacgaggagaggaaaaggagaagaagaagaagacgcagcagagaagaagaacgaaggagaccacagaggggagaagagagcaagacctcgtggaaggacgactgcgttttctccacaagacagcaggcgaggcaggccaagcaagaaaagagacgaaagaaagacttctgcgagtacaaagccgaggaaactgcagaaaacgaaactttgtcaaagaggattgaaggctttacagagagagacagctttccgctgcactccaggagaggcgaaggggtgcaacgaggataaaatgcgaagcagaaaggaggaagcagcgaaacaagaggaactgagggagcaaggagacgaaaagcgagaagcaaagaacgagggaaaacgaaggcgagcacagacgaaaagaagaacgaagagacgaccacgacgttaaagccgcagcagtgtttctcctcgctcgcctgttttcttccgaagaaaaaggcgagaggtttgttttaaaccttatgaagaaaaaggagagagttttgttttaaaagggagaaaaattcacaagttcctactaaatcccccactcgtcagtttgtggtcctccagagatgaggagggaaagcagtccgacaccgtcgaagaagaaatcgctttcgccaattttcttccgtcgacctccgacatgtctcgtctccccctcatcgcattgctgcttctcgctagaagagcagcagaaagagaaagtaaatcttttctccaaaaagagctgcattcgtatcgggttcgttttttctcgacaaggcatgcgcgcttgtgtccgccgccctcgcgcggcctcgcgcgccctcgcgcagatgcgagaaaagtggaaaaagtcctgtgtttcagaaagatacagtcttcctctgttcttccgttcaccgcgcattcagctctctttcttctgagacgttctgtcctccgtcttttctgccttctgcttgcttgccatggccgtacctctcacacgacaagctcctgtctctcctcaacctgctctttctgggtcgtagaaagacatacatgcatatacagtcaaaacaggatacacactatggagacttgtggatactttctatgtgaaaatgcgcacttgtgcggaggtgtatcggtcaatcgacaaaatgacctacacaagacggtgtcaacagatacgtagtgaatcgacagacagacataacgccatacatgcttttgttgcctgcatcgttatgcacaatttatccagatttatccatatttatatgtatttatccataattttccacatttatccataattatacatatgtatatatgtatatgtgtatacatttacatacataaataaataaatatatatatatatatacacta

SEQ ID NO: 3763 - DNA, 3545 bp, Toxoplasma gondii
ttcgcagacacgacagcggaacgttcttttcgaatggtgctctcgggggctgcgttcactctaaaactcttcacagtgtctcctctctctccacactaatgctttctgttcatgcaagcttgttttccagttcgcggtttgtgattttctcttgtttttcttctttctcggttcagacacgtgtctctgacgccggttcaaaaaagtttccgaggtgcgtgggaccaagaaaaacagcaaaaaagcctaattaggctgcttgacaatatgtttctctcgtcatcacttcgagtgccatgagacctgcatgtttctacacggaagatagaatcggtttggaaagcctgaacatgcgtggtaagagaagtccgcattaccacgcctagaacctatgcttaaagtgcatgaagttgactgtccactgcgtttacttgtttacttccctaataactggttgtcggtgaggataactcgccgatcatttcttgtagtttagagatttttattgcaggagcttgcgctttggtgtgttatttttcgagttacttcttgtcgctttcgaagaatcacacggagcgaagcgtgagaaccatgtagcaaaccaacagatgtgagcagcaacgaaaagggaagaactgttcagatcagagggatttccggaactgataatagagcgcatttcccgagggattttacggcgtgcggatgtccttctcgagaagcaagcgccttgtttgactagcgtcgtttccttttactcactgaaagtttgcgagtgccgttttctcttgttcagcatttctctcggtcctctctctgtgaaagcgcctggaggcgtcggagaaactttctcctccgagcatccaccgctaccacaaacgcaccgcgaaagatcggaagcacaggaaaccgagagagcagccggtcgtgtgtttcctatctcgcacgttaaagaagaaatgcggagccgagtttatccagatcagagttttgcttcgcaggggacatgtgggcagcagcgggaacaaaccctacagagcacacctatcgacgacacctcattgttaatcgaagatttagaaggtgtagaggattccgacgcatttcagaaacctcaagaactctttcgggactcaggcggcactgggaatgcctttgtatcagacgcgcaaattttatcttgtcgttctgtttcaactagcgatggtgatcgggaaagaaactcacgggaaagcgcactgacatgcaaaacgaccttttctggcatggcgtctgcgacagatggagcagaaaaaggtgcctctcttcgcgaaagagagtcgaactcggagggttcggtttcctctgtctccgttagaaaatgtagtcgaggagagactggcatagatgcgggtggggaaggcactgacctcttttccagagacgacggcgaagaaaatggggtggcattttttgaggaactgagcaaagcagaacgtcaagcgcttgggccgccaacgccagccgaaattgcggacagagaagcgcacgctgatgcgcgggacagaaccgtcggtggagaatcggatatccgagcaagtgtcgacactgcgactttctcttcaactgcacacctggacgatttgctagatattctcttagaagaaccagacgccgatgggtcgtaatttgtgttttgatagagccggagtcattcccccccccaaaagtgatggcgcctgaaggtgtaaaacctaatgtggctgctggggtgcgtttggaaaatgcagttctgtccaggtccgagtgcctgggcatcaaatgtgtctcagttcatctcttgtttctagaaactgctctaaaccgcgtcaggaacttcccttttcttctggaaaggtactttttctcttgcaaatgtcgaagagactgagagccgatgcggccagactgtaagagcattcacgcacttaacaactgtgactgctgctcctacaggccccgagatcgttgcttgttttccgagaactcaaggacgccaggttgccgtaccctcttgggttcgctgcattcgcttgcttcggaatcctctcacttacaagggaagcacataacgaaaaatctgagtgaaagtagtccagcttttaccgaaagtctgtcacgttgaatgtgagatgaatcgaaatgctaacttcagtgagaggtgaacaaagactttcaagatctaaacccagggtctagcttcacgtgtcgcttaggtggcatcgagaacatcgagcatcacgacagagacatcatgttgcactgtccgccagcaacctgtgcagcttagttgacacgaaaatatgctccttcgatgcaaactcgtcggctgacttttctgactcgtcaaattggaccaggttcggtagtccgtactggtcaagtggaacgttcgcggaacgctgagagcatgcagacgaaaactgctccgactgcgcaacaaccaagtttcagatatcttctctagtccttgctgaatgtaacactgaagatctgtgtgcaaatttgtgcttctgcggaagaagagaaatttccggaaagtcagtacgggtatcacttaaaccagctctgaggatcggtttctgccacccttcactatgggcgttactcggttcagcagcaagcatgagacttcctccgagacaggaaacacatccttccatcaaactctgaaataaaaaatctcccgatttccaccaaaacgtgtctcgcgacgcgtggcgcggattccgactccgcgaaacacgcaagagggtcgagtaaagttcgttacaggtaaaaaggaaattacaatcctggaaaacgcctttccaactattcaaagctatattggagacattctgaagaaagtaggaggctcactttcttttctggttggccagtttctagaaaaccaccacccacgccgattctgtcttcaaatgtcccagtgtccgttggctaggcggcgtggcgacagctgccaggtgcttcatttgctattcgttccctgtctttgaatttgagagaaccttccgcacaaacttttccactctctacggagaagacatgcactggtgctattcgcaggctcttgagtgtgtcgcagattctcgtttttcagctcctgaacggccctcccgcagaaccctacgtcgtgcatcgactagcttcagcgtgtggaactcggactcgagagattgtctttcgcaaagctgcaacggaaaagcccttcctgcagcgaagtaaagtgaaaagtgatgccttaatccagttctggtcttcgttttgggattgtttctcgatttgcggtgaatgtcgcatctctggccacattcttgcttacgtttcgcgtatatacgcaaacactccgggattcgagcaatcttttctcccgatggggtcgaggcgtgtcttgcactttcctttgatgtgcgcaccgccagtttccgacaagatttgttaaaagcgaccgctttccacccgcgaatctccttcctttctccatttttgtctttcttaccagcaaaagaggatctcacgggaga

SEQ ID NO: 3764 - DNA, 2034 bp, Toxoplasma gondii
aagactgtagcaaactgcagtcacgatcctggcacttgccaaagcttctcctgccctccgtcccacacgattgaaaacgtgtgcagtgagagtgcaaaggatagcgcgtgtgtgttgactaagacttctcacagctttcttgcgttgagatacggaaaaagctttctttattcctgcgttaagtgtgtgctgttgtccagggcaaaggcgatggtgtgtgtctatctgtatttcgatggactggagatgccactaaataacacgtagagtgcggcacgtgtcctgtcggctcctactcagttcaagatccgaaacaccttatgtgctctatctcggccacccagaaagcttacttcaaaatctctctgtgcccccagagacgcaccgtcccgatgctgcacaggcagatggaaactggcgacacatcctactgtacgcggatgacgtcaaagacttcgagacagtgagaaaaagtcattttacgtcacgtcgaggagaaatctctgaacctgtgtggactggtgacgccaggctcctgacgtttgcttcatcgagctgttctggcagtagcaaagaccgaataccggaagggtgcacgcacccacatttaaaggttgccagcgttgtgacggagcatgacctgtatacacagcagatgagtgataagaatgtccgcgcaccgcctggacagggttccagaggatgaaggtggtgaatcagttttggccgtggctacgggatggttacgccacagaactaattatgctctacgaagcactgcgttatttagaggcgcctggttcctaatacaaaaacaacacacagataagacgcactgcaaccgtctaagatggatcgaaactcgaagatggcaagacaccttttttttcacgagttggaagcgctcctctgactcaccgcaccgcagtcttaacggacaagattttcgcagaatggccaaactttaacttccaccgactccagtccagcctgttccgttgttgctacacgaaaatgcaaagcaagaacttgggggacttcctcgacgagggaggaacctctaattcgccttccgcaaagatccgttcaagcagcgagacaggcgcatgcaaagtttgtgcgactcaccgtccagcgtgttcacatttccaccagcagctacagctgctagtgtgataaagaagacttaacttgccatacaacaatgctggaaacataaacagttccgctatggctaagggaaaacaatccgcgatgtggacccgccgaaagctgtgttctgtaggttggacagaaaatttaacggcgatgcatgcgttcgagaccccaagaggacgtcaagaactgtagttcttagaaccgttcttgcacgttctacaattctatcttctttcttttccctgtaacccctcctggctgtgagcagccgcttttctcagcagtttctcccagaaatggaggaaaactgtttggttaacggagtcacggcgtagttttccagtctcgtcggcgggtctgtgttttcgggaacttttcgtttttggcagatttaggggattctctgtttttttttcgtgagtcattcacctgagaacttcattcgcctggaagatctgtacatgtcctccagtatcggctcctgtaccgtaaaaatccctagcaacgctagctcgcgttcgattttcccccgccacccaaacggggttggaatcctacttccttcgcccatttatagttcccccgtttttttgagggccttcaagtgaccgtacattattgggcggttgactgcagttctgcagacctaggccaccgacaccggcgtatcggatctgtgcgcgtacattccttccgcgtatccgcgttctctttggaaagactcagcgctaccttttgtctgagcgtcgactcgtgagagaaggctgcacttcttcattccggcgccacgaccagaccgtgcacagttgccggtttccttttcacttttcacttgccgagagattgtttgttttctatctgagagcttcccagtca

SEQ ID NO: 3765 - DNA, 5036 bp, Toxoplasma gondii
ttcgattttgcatgtgtctctcctttgcagagcgaagcggcgcaagcccctgcacaggtgtcctcggatgccgccaaaggtgccccgacgaactgaacgggtgtgtggagactggggaaagtgggccgcatataagccgaaagcaacacatagagtcgtctgtggaagagactgttcgtccacgtggattcgcgcgaggtggttttcgcggcggaacgtagtgtcgagcattttaaattgggtagacttcgactctgttctgcgctcctgaagcaaatgtagtgtttgagtggggcggtcctgcgccaggcacacgacaaaagtccgtttaacagtctgtttgctgccgtagtcacagattgctctcaaacacgcagacataatgtgtgagtgtacactacagaagtgcacacacacacctatgtgcagttgtatagaataggcatgtacgcataggtgtacacatcagaaaaaccttgcccgaggcggcgctgtccagaaagacagacaggatgcagaaaaggtcaggcggtggtaacaattatctagtatcctctcttgtctcaagcgaacttttgattcgtttcctgttgagacccaaacaaggcgagtacggaaatgtgcgcgtttctgaaagaacgggaaccggcggtcatcgcgtgcgtccggttttttgagatttcgcgaaatgtgccaggcaaacagagctagcccgtgaagccgttgttggaactttaaactgtcaacttgctgtcgagtgcgcattgtgtgagcatcgatacttcctagctggaacggaacgctatcgcgtacggcatgccgggacatcagaacatccgagaaacgaggtgtcgctgcaggacggttgcatacttgattcagtttttctattcgaaagaaaccctgtcgaacaaaacttgcaaaattttccgtcccaccgaaacagcacgcgaactgcacacaggaaataaccttcgtctttaaaacgtgcgccgaaaatcgcagttcctcttaaaaactgacacggattatgcacacagaaaagctcaaactgcccatactcagacaagttccgtgagacgaactcggtcactggtcaacccgaaacaaatgccgagtgtagtaaaggagttcgtcgatgctttcatgtatgtcttcgagtgcgcggtggttggccgccttcttgaccagtggcaactcgggtttccaccgcatcgcgagttcctttatggtggacacatcgattattcggtagctgagatgtgctatgagtcggggcatctgtttcacgagaaactgcctgtctacgtgcacgctgttcccacctagcggggcgacgcgcgtcgtcgcgacgtgtttctgtacgaattccagaatttgctcctcagcatctgcgagagtcagagtcgacttccggcaggctgcagttagccctgactccccgtgggtctttttgcaccattcatccattccatctagaagttcgtcactggcgtgcacaattaggttcggtccaacgatgcgttttttgcactggccgtccgtcacaatgaccgcgatttcgattatttggtctgtttccacgtccagtccagtcatctcacagtcaacccaaacgatgggagcctgcagggtctcctcatcttcagttatcgtaacagctgttcggatgggggctatgcggtttgcatcctcgctcgagacgctcttgaagcgcgcgggtgcctccatcatgccctccatctctgctgaagcgaactgtgaatgaagtgagtgaaagtggaggtcgcacccggtcaacaaggaaagccccaatttgtcgactcttcgtgaatgggcgccgctgctcgcagtgaggagtgcgggagtgttttggtgatagttcactcgtctcccgtggcagggatcgtgaaactctgttctggtggaaacgctcttgagcgacgcttggtagagaacaggcttttcctcgaaggtggtaaaaaacacaccgccgcagcgtttgctccactgcgaccaattcacttgaaacgaattcgtcctacgcggtccagacaagcagcgccctaactcacccgcgacgcagtcttgtgagcggatgctccgactgtcccacgcacacaatggatgctttaacagcaccgttgatgtcttgctcaaaggtgggtgggaaaatctggggaacaaacgcattccaagctatctcggggaagaccagtgactgcgaagcactgtgtgcaagtctcccccaagcaacttgcatggaaagctgaagccagtggaagtttcagcctttgctggggctcttttttgggacaatatccgatccttacgggtgaaccgtgttttagccgcccgcgaggtcggacacactgcgagaaacaacacccactttcaggacatgatgcaagaactgtagctgcccttagcgtgttttcatcccttctgaaaaccacaccagtccacgacaggagagatgcgacgctacacacggacaagtggcgacgcacacactcgacaagttccaaatgcgaagaatcgtgtgcgcggacaaagagccgaaagttgactgctgtttctgctgcagttagcacgaagtcgaaaacagaagcaagggatacacacacttgaactcgagaagacctgtcaaattttctcggagtttctcaaccctgcaaacttgcgtggggccgggtcgttagattcccccgctgtgcaacactgcgtgcacccgcagtcgacaaaattccagaacgcgcagaaatccagtttcactatcactctccctccaaacggcaaatacgacaatgtccattcatggtgacaatcgaggggaggagagtggtcgtcgagtgccaccgttgattcaacagccggcgctgcatgcgtattccttgaatccctggaaattgagatacacccggggtgacctggcctcggtgaattcccaattcggcttggtcacacgtggctcctaaaatttttcgctacccttcgcttcatagcataagtcagctcttctctgcgggatactgcatccttgtgtttgcactagcataactgctgatgtcctctgcacgacgattcgaagttggaatcattcctgaatgtgtcgagaattcccgcctatgcagaccctgtttgtaatttcctaaagcgaagtaaagtgtagacgaacggactccgttgttttgtgatttgtatccttgagaaactgtcaagagcggagagagtcggggagacggtgacacttgttcccaagtttccgttccagcatgacaactctgtggaaagtgcttttcaactaccgcatcctttacttggggtgcagccggtgcaattgataaaggtactccgcatttgctgaggaagcatctgtagttcctgtcgatctcagaatatggcgtgctgcacagcggtgtgtcttctcattacattgttttcttgggggttgggaaacgcgtcttcatgtgtttagagggaaccccccccccagcaatcaactagcgagtggcacatacccaagcgatcgatccgaacacgggaccgcgtctgcttcttagcaaagacggcccaccatgcctgttacaagtaccaatctgtcggccacgtttatgaagctgtcggggcgtctccatatgaactgccacatttctggcaccccgaatgtcgccaacgagtctcaccgacctcccgccgctcagggaaagatagcttatctcccttatggacgaaagtatgaagattttactctgtgagccggtaaaaagccaaagttttctagggggaatgacgtgcaataaagtagtgacatccggatccgtgttctctcttgtcacgcctccggtgcgtcatgtgcacgcgacacctgaacttgacaaacaatagattcaggaacattgttccgaatatatctgagcaaccttagtggctgaaaatgcacgattcagaaggtaccgggcaatcccctcgtctgtgtgatgaggtcggacgccggcgtccgagacaccgtgtgggtgtttcggcttttcctgtgccgtagtgaacaagcacgaacaggcgttttgcctccaccacttgcgatctcgattgatgaatgtcacaagggtactgaagcttcttgcatacacgtccctaaacagagcaaccgcaactccttcacttgcacgatccgaagcatggcaagttccaattttcttctacaggattttgcctggcacatgtttcgtcgttaagcagaaagtggattggacatgctcttcgttgcctcggatgaacacgtgagttgcgggaacgcggaagggagctcaaaatggtgagacgtgacgtgtgccgaaatatcgcgagcgtactagcgagaaagccacgccgagccgacctccctgttcggcaggaggcactgcctcccccgggcgcatgcagagataaagaaaatagccgcaacgccgagaggagaaacggatttgcctggaaagacgtggttcttgtccgttgaaaggtagcggagacactaccacaatttttgtgacgcgtgtttctgttgaggtgtccttgtctttcacgtgaattcctatctgttgcgcgccgaccttttcgcgcgtgcgtcccgcctctcttttcgtcctggctcttggctctggcacagcgtccgttctgcgtctcctgtctcgtgaattcgtcttcggtttccccgaaaaagttccgttcctcactcctgtttgtttccagagttcgcggtccacagacagcctgaaatcgttcgactatttgctcctgctcctccccaccacgcgtctcccaacttgcgccctgctcgtctggtgttttcgagttcctgttcccaccaccgcaaaactttttcccatctacagaactctgtgcttactcgtcgcctcacggttcactctgtgtctgagcccccccctttagctggcgcgccgtgcctaaccacagcggttctcatacggctttcttgccgcagaactaacgattgagcgggagctccattcgcttttcacctcaccatttcgccgcaa

SEQ ID NO: 3766 - DNA, 1788 bp, Toxoplasma gondii
tccgtatgcttcgattttcagaagaataggcttaccgcctttccctgcaccacccaggagacctaccaagaccactcttttgatcaagaactcggcagcgtccatagatctgatgatttatgttgacgtatttgatgacgacggcttcatcgactgttgtgaaagtaagcaatgcgttcatgccatcttccgtctggacgtatttctgtcgccctaatattccgatgccttgaactgctcacacacatgctgcagggttctacgacaggaacgtcgcggtcttcgagattgccggtgtgaacgtcaaatttgggctattctctactttgcggaaggatgtgggggatgactcaaagatctccgaacaaattgttattcgtgcaaacagaataacaactgaggaggtcttttcaggcgtcccagccgttattgctagggaggacgccatcatggtaagatggatcaaggcgaactagagatctggccagtccgcacggggacgcccagaaaactacgtaaacaagctcaaggttatggtgtaccgcgcctttgttttgaattagaaatctaaaacgtgattctgtcgaaaacaatatgtttttgatgatgcaggcacagtttttgacacggaagacgattgattttaacatagacttgggcaggcacatggcgataaagcgctgttccgatatgctgaaaggagatcggagcgctcgatcacctgtgttagccagctgcgtccgatttaaatatcatagacaagattttgtgttctaggcagtatgaaacaacgtatgttttaccacacttcttgagttgattaatcatgtagttaccaacatgacgacgtttgctgctaaggtcaaactgtgaagacggtcgaagctcgtgcctttctgtggacttgaacgaatttcgaatcttctttctccggtatatgccctgtgtgaaacagacaaactcagaaacggtggcgaagcaggctgggacagccagagacattgtgtatttccagtgcctggacgagtgccgcgtcagcaaccagatcttcaagaacacaaaagggtacaaatatgtccaggtgactcgcgagctccctcctaacagaaacatgtcttgaagaaaacggagcgaaatgtcgttgccgcccctgacctagaagcttgtggctgttgaccactctgtagtctgtgtgattcggttcctttgcatgcatgcaacgttggcaacaaattcaacttccttgtccgttgccaccgtgggttcgttcacggcgtgtttagatggttcagtgaaataccagaggtgacgcagtgtaatttgtttccccgtccgcagtggcgtgtcattctcgtggtgaaacaatatctcaacagacccatttcccgttatcgcgagcaactgcaatgcacatctgcatgcatggcaatcttctaaggacggaacatcgcggtcatcgaagcccccaatgtcgttctagtcgcatttcatgcaacaccacaaagcgaagcgtctcagaaacttgttagaaaagcgggactgtatcctgaacagaggaccgccctatggctccgtcgtcattgtccagctttcaagtcgtaatgaacagctagaccgtctccaaggaatctccaacaagagatctcgaagaaagttgcacgttgaggtgcttgacacctattttttgtcaagaaactcggaggatgtagcagagcagatcgaaaccggtcttccggattaacgccgtggggtcttccgcattggtcttgtttgacactattcagcgca

SEQ ID NO: 3767 - DNA, 3278 bp, Toxoplasma gondii
tgtgacgaaacggttgcaaattcagcggctgaagtagttggaaaccgctgagtgtacgtcccggctcatttccccagatgacttcgcgcgtcgtcccctgcttgtcgtggcgtcatacccgcgaaatgccctgggacctccgtagtagcccatgtcgccgtacatgttgtagggaggcggaccgttgaatcgtccgccatagcccccgtagtagcccccgccgcctctgcctctatacatccctccgccatagtagccgcctgcccacatcgggccaccccctctagccccgtaacctcccctgcttccatacccgcctccgcggccgccgctgaacttctgtccgtcttcacgatcttcgcggacgaaaatcaaccgatctgaaaacacaagaaacgcgaaccacgctgcttacacggtcacacaagtccatcgcggcagcgctgtcccagggtaccagaaattccatcactcggcaaaacgcggatttgcaccaaagtcagtgtcgcctgatgaacacctcttaaagagtaaggcctctagaatggcaccagctgcgtcccgctgcctgaccaaaccgcccgccgcgcctcagcagaaaaggcaatccccagctcgtgcttaccaaatagctccgtatccgtgagttccttgatggccttctgggcatcctcaacgtttgtgtactcgacaataccacaccccttgctgcggccttgaaagtcctcgaacacatccgctcgcaaaacttcgccagcctgcttcatatgatccttcaagtgctgccacctaactttccacgagaggttacccacgtacaccctgcaggtgggttcctgaacaaacacgcagagtccaggcaaaagcggcgcactgacccctgttggcagctgaatgtgttcactggcaagtccagtccacacccgagctgagcgcgctgcgcagtggcgttaactcaccgtgctggcggtcccctcccgcgggagttgctgttgctgttcgtcctgatgcaccacaaacaaaagagcaagcacaagaaatctcgtccacccgtcgtctgcggactagaaacgcatcggtgcacggcaaaacaagaccggtccacgcgccgcgctgttcccccccgaacgccctcatccctccccgtgagaaaggcgaggcgccgaccactcgagtccgtgttgaaacatctaaaccatcgcagaaagtgtgcggtggcctgttcaatatgcaaaagacggccgccatggacgacgtgcgcggcaggcagggtaccgcaactctcagggaagcgcgggcactgcgagcaccggacagaaaaaagcaccacgaagcggcagcgtgtgttgctagtgaaaaccgacagaaactcgacaaaaattcatgtcgcctcgtcattgatgtctagtgccgcatgcaccccggcaaagaaaattgaaatcactccatctctgagatatgggcaagaggcaaggggatcgggattgtacagacacctgctccaaaaaccggaaaggggttaacgtaccgctggcatcctgtccacaggtatgaaaagtttcctttagcgaacgtcgccaatcctcaaacctcacgattcctgaccgaaatcccaacttcacaaccactgaaagccgccttctcttcctcgacctcactcaaactatcgactatcttctcaccgtacaactccctcgctacaccagcccacagagggcggggcgtggggcacactgtggagaacggagccacgcagaaaaagcggcgtccccccttcggtcgcccacctcgatgacggttgcgcgtccagtcccgaccactttttctcccagggggggggaacattggttttccaccatccataaaagtgcgcgaaacagtatacgacggcgaaggtgcgttaacactgaactccgtccccaagtcgaaacgcatataacgcaccggaagtgcgtcctcaatttcgactcctatagaagcgaaaacgcattaactctccagcttcacacattcattcctgctgaacgctcgacaacacggagacacagattggccaatgacgccttccgctgcgacggtgcacaggccggtggacagtcagtctctgttcgtcgtctcctcgggcacatgtctgcttaattcggcacacctcccggagttcactggttaattctagtgtgatgcgggtgcagagaacagttgcacagagtcgaggtcaatcttgaatttctagggcagtgcagcagtgtggacagggacgttgtagtagagacagaggcgaaatctaacgagaaaagcgtcattggtttcaccatggagccgctcggtcccacgtcggtttcacagttgggtacacgtatgctaaaggaatttgagtccgtgcccagaggaagggaagcacgtatgttttcagttacacttcagttcctatgttctaatggtgcaagtgccacgggacacggcgttgtttgatcagaggagacagatcagccgataaagaagaaatagggaagtgtcaggcagcgcttccctcaccttaaaaaaaatggcagcagctactggtctcagtatgcggtacacaggatccgcactacacgtttgatgcagatgtgctgtgtagcgtatcaaaagaaaatgaagccgaatcacagactcaaagtcactacatctcaacaaaactgtcgcttcttaagttgcgaagtgtcatttgggtaaacaaggcaggactgcaaagctgagagataaggtagccgacattgcgttttgaaggggtgatcagcagggtacgttagaggttcgtggcctgcataaagtctggaggcgggggacgtcgccgcactttagtggttattcgtgggctagtcttcacaaaggatcgaaatcgagtgtctgtgtaccatgggagctcgcttcaagcgattcgactagccacaccctcccagtttacgaggacaccgaatcactttgtgttccagatagacaacctctaagcccgctcgagaagtgaagaggaattgagttttttttcgcatttgtcacgtttggttggtatagtcaaaataagtgttgggtcaatcccgcgttcttgaagaaggcgccattgtcagaagaacaacctgtgcgtggaggatcattgcacggggcaatgttcgggtgcaacactggcatcacgagccatgagaaggtcatgcttgtttccaccttcggactgctcattatgtcttgtgctggaagaagctttttcgggcaaggcttcaggaacacgaatgaaccgccga

SEQ ID NO: 3768 - DNA, 2618 bp, Toxoplasma gondii
aatgataacacactgttgcagtgaggctcgcacgtagacttctgaagttatgctgatcttaggtaacaccccctatgagttgcgatttaaagctgttttcctgggtagatctttccagagttgccgttgttgccgattttcctgatattgctacgacacgcacgcaaaactgttcttgagcagaaggatcgctttcccgaatttttcgtgtctgcttctcactgttccctgtcgaagatcaaactagcggagcggtcaaccgatgctaacatgttaatatttccagtattcggttacactggagcaagaatacctaattcacatattctctgttcagttgtttgtcccattaatgtaaaggatggagggagaaacgggtatgtaagtgttcagtgcacagtttagcctctgtgcatggagcgattcaggcgcacgtgggataagtgaaaagccgaccgtggttgagggtctgcaagtaacaggaatactgacacttgtctcctcaggagagctgctggagacgaaaacgagaaacagaacccgtttgactgtggttgttactcagcgaagcgcgtggctgatctgatggtgtggtatgctgcatgttgtggtgtcgcgcacagcctgtgacctggtgctgcagacgtccgcgagaagcagtatggtactgaacactctggctatattcaagagtactatagacttcaagacttgcagcagacgagggaaactcttcaagagtagagacctaacgccagccgattattatatcctgattttacaggattcgattcagttttgtggttgctgtacctcagcaaagggaaagactgtccactaagttttagatgggaaagccggagttttccttcccgtttcggtggtccgttgttcttctctctagtgttgaatctgcatctgttttctgtgtctcggttccaatactgagatgcgagcactctgttcttctgtcgaagggattaacagcggaggcgattgccactactgagcgaaaatgcaaggcaaacgctaatagttgaagcgtgcctttaccctgcccagatctgctgatcaagactatcttgctgtagatgttctgtgaaggttaacggcgactgctttgtgccactttcgatgatttcgttcctaggatttcaccactggaccgcaacatgacatccggggcgtcgttttgaggctcacaaacgggttctctccagacacttcctgaaaccacccttctcttggttcaaatttgcatttttccttttatcagtaacgatgctgcagtagtgggcatgggtggaccccgcccgatttctccgcacggctatgcggcgttgctacccttgtctctgttggtttccacttcctctcggacccgtgttggagtcttgtaccgtgtaacgcacactaaatgatgaaacggggaaggggaatttacagtattcactttagtcctgtgctcgtcagcccagacgtcgcttctccctgtggcacgggctattccgtgccccagcgtaccccgtctccttggctcgcgtcgaaatccagctcacgcgttgacttaacaaagtgggtttgcgtgcaactcacctctacgcgattcctccataaagttaaatggatgtatattgattcgtcagagacttacaaagtatcgttgttcggtaacgctgtttgcattttctgtcttgctctgggtgcgttcgtcgatggtaggaaaaggcttggagacgcagactgcccaacgaagttgctagtttgcgactggtgtccgaagaagcgcggtggtatcgatctgccgtttgttacctcacatggggaaatgcagcagtttgccggggattttttgacttccctgcgactccagggcacaccggtcgtttggccgcttcacgtgttcccgcaatttccttctggagcaagtcgttggcaaggagcggtgcgttttggctgcctctaccactgcgctctttgccgagactacaaagatctcaacgcttctaaacgccgtgtcacctcgtgtttttcatttgattctggttaggtggaacgcgaatattggcagctttgcccttttccctgttcctttgttgtggtgcaaactcacgcatcaaaagagctcgacccatggactttctgtctgtagactaggagaacccaaagcttacagatgtccccattgacggttccctgttacacattttcctgttcaatcaacatactctcatcaacgttcatgtgcgtctggtccttgaacactctgactgggtgcgtgttaattcgtttccggtaagccttctaaacggttctactgtgcagcggcaacgcgctctgggcaggctgcaaaaaacgcggaaacatcctcgacggtatgactgtgtttctgtctgccttctgtcgacttcaacaactctgtacctctcgctgtgcctctctgcagcatcgccggtgccatgcgtcgccttttcccgctctctgtcttgcccgaaatttgaaaccgtatctgttgattcactgtggaggccgagtgtctacggataccgaggtgtgcataggggtttgcatgtggaagtagtaatttcggattcctttcgaccctcctgtacacgcca

SEQ ID NO: 3769 - DNA, 2002 bp, Toxoplasma gondii
ctattaagcagcagtcacaggcttttgtcactaacacagccgcggactccagcgggcaacgttaaagacatcactttacgtagcgtgtgtcctgttgtttcaccagtggtgaacccctgcttttgattaagttcaattaagttcaccgttgcgtagctgcagctctgtgcacactgcaactgttacactccatttccagaatcacgttctttcggaacggattcgtatctgtttgttagtcttcttgattttcgttcacatgtcgatgtgtctggggtcattcccatttcggctcctgcagcgaattgctcaaaactgaaattagcttcacctctatcatgttcatgccctcaaaaaacaacttgtttattgggtggtcaccctgcaccatctgcgtagctttgtatctgtgattcgcagctttgtctgtgctccatgtggtctccgacatcgacaacagagtgttcagtgcgtccaagtgctgaacccaccttgaggtgggttgcctcgaggattagtgacagagcagtcgtcactagtctgccgtgcacaactaacacacaagaaatggcagcctcttgttagccgagctcattcatcttgttggaatctttaaccgttacatgactttggggggaggcaagtctctgtccatgcgaattttttcagacgccaattgagacaggagccggagagacacgaacgagacacagaagcaacagctgcgaatgaacacctctttatcgtttattcatctgtttctacatagatcaatagagctgcttatgggatgatagaaaacaatcaatctggccatacgagctgacgtggcgcgtttgcaaatgcagttgtcaaaccaccgtgctttttggtttcctgactcttgattaaacaacttcgaagagttcatgaggcaaatgtgcacttgaatttgattggccgccatccgttccagacgaagcgtcctctgtttgtacctgatcagctatatttcggctgctgggcgacatttcacgtagatcggtttccttcgacgtaacgctttccacccccagtagaagatacaggtagcgttgctgctcgtcagatgagggcatccgtgccgccttcagatcccattcgggagaagccagagagtgaagaactgcctgtccgttctgagctagtaaaattgggaggacgaccacgagtctcttggctcttatcggtgcttctgcatgctacttctgcaaggcgcatgcgctaccgcgagggtgcatgtctcatatgttacctctcttcactgtttaccgccgcgaatgcactgcgttatgaagcggcataaaacccatgtatcaggtacatataaacatcttgagtctactttcctggtgtttctgtttatagtggttctcacttttaaagttagcccaccagtccgcaaacgaggtgcgtgttcgccggcgaacggcgttcacggtacgcgggatcccttccgaaacggctaaccggtaggatccaaaaggctgcctcgtttccaggagaaaaagttgaagctttcagcggcgaactgtcgtcgtctcagtagcgatgagttttccagttccctcttttgtggtgaggttgtaccaacaagaagcttttcccgagtgtccggcccgtgctacgcaaggccgtctgcctgattgattgtcccgacatcactggaattaagggatcgagtccccaccagttttttttcactgtcgcaagttattgtatagctgaacaagtgtttttgccacgaaaaacggggtatttatcgctggtgaaatatacgctgcttgctccctcgtgtcaattctgctccgtgtagaaacgtcgcatctcgaccgtttcgcgccgaatcgtcttgcgatttgcggtctgcccctcatatagcaactgtatgtcgactttctggtactcatgatgtgggattgctaggattccacgaactgcatatagctgattctgaggctttacgtcgctgccgtgtccctta

SEQ ID NO: 3770 - DNA, 1584 bp, Toxoplasma gondii
cagtggtgagagtgtacgtcgtgtggtcggtcgcggtccacgcatttgtgccttgcgagagacagcgattcgcgaggaagtccagaacgccctgaacagacagaataggaaacgagggagaagggtgtcgctgtcgccggagagagagaggaacagcgagaaggaaaacggaacagaaagatcgcggacaggtggtttgcgcggccgcagacgaaacggcgcagagggaggcgacggagcaaaggagaagagatcaagcaggacgcaagaagagaggaaacgaacgcacaggaggaacgcagaagaggcatagaaagacgaatgagaggaagacggaaagagatggccgccaggagcgagaagaaagaagagagagcagaggtgggattaccttgtaggggaagcgtcgacttccgaggaagacgagatgttcgagtgtgtgaggaagaccttcatccgtatgagcttccgtgggtagtgtggcgtagagattgcagaggggagaagcgatgcgacagaggaggacgcgcacacccgtctgcatgcatttccactcgcgaatgcaaatcgttttcaaagaaaagtgctgaaccaactggaagccgagcgcctccgccgagttgcccccttctccctcggccttcgcagacccccggcacacgcaacacggtgtacatacactcggagtcgcgggacgcagcgcggcatcttcgccggctccagagacagccgctggagagacaacagctgagaggtcgacgacctcggaggaggtcggcgactcttgcggagacagtgccatcttggagatgcagacggaaagtgtgcggcgcaggaagggaggaaaagtgaaagacgggagggaggagcgggaagaagaggcgggagagatcggaagattcaccggagacgcgaaagaactcccgagtgtgtcctgagtctgttcacaggagacgggttcgaccgattttgcgcgagacaggctagagggaggacaatgacgaagccgagggtgtctcgacagcagactatgtctcgagtttcttgcagaaagtcaaaactggcgaaggaagaaggcgaaggagatgcggggaagcaggagaggcctcaaaacttgaggacgctccagacctttttgccgtgcatgcacatacagagactctggacgaagtgcgcatgcataacagaaaaattctctgagaaggcaacgcaggcgagaacgaagaaaagtgaaacagacacgcttatttcttagctaatattcgaccatctggcggcactatgtctctcctccctccggattcgcaacctccgagcggcgacggcggccgtcgatgcgttgtctgcttcctcgttccttcttagagagtctgttcttctgaagcgggaggaaaaattctttcaagtttcacagagaaagcctgtttctcttctctctccgtttcttggcctcaggttcgcaactggtccccgagacagaagtttttgtatcacgtagcctcgtcttcgtttcatcgccttatcgtttcttcgtatgttgccgtctcgcccgggacttttcttccactggtcttctctcccaaa

SEQ ID NO: 3771 - DNA, 3834 bp, Toxoplasma gondii
aagaaacaggaacgctggttgtgctgctgggcacatctgcccagtttttttttgttgagcgccacctagcggcatcttgtgcaaccgttcgcagtggaagatgcctgctgccttcaagcaaaagctgcgcgttttacactggctgcattcaaattgttggagaagtgcttttgattgtgcatgagaattcatgcccgatcatcaggttttctcctgagtaaaattggcctggtgctgacatccagcaaggctcgtacagggacaagtgctttgttacatccaggatgtatgtgcagcatctgcttttcactcgttaatttgaaagctagagctggatcagaaatgatcctcaccggaaggaagccacacagtgcatgaaacagtagttcttttcagttatttctgcgtctgcacagacagaatgtggctgctcagttcacctgagaaggctgttcgattgatctgcaagaatgccgcttggtgaaaccaccctgtaggtctggttatgtagcgttcgtatcatttgttgtcttcctgatgttctaccacatgcgttcctttccgtgtagccttctcgcttcgacacacattaagttgaacagtgaattgtacttgccgttcctgaccgcgtacgcaacggtggaggactactgctctcacgaagtggatccgatgtgggtggaagctgagcagcctcaaatcatggcgttgacagcgatgacacagatgcctgtagagattgtctatttcgatcagtcgcccggcgaggtgccaggtaagcgacaacgtcatgtcaatcgcacacttccatcgattcgtcccaaccgtcgagcccgtcatcctccagcaagagatcggggcacaaatgatgcggtacagtggcgcgtatgctaggagagcagtttttatgtgtgaaagaagcatcgagccataaaaaacggcgagaccagattgtgcaacgcccgactgtgtatttatacgcatatcggcgtatttatctctgtatctatcccctttccgtcttgaggagaagacgagagaaacgcgaaggtttgtgattcagctgcgcggtaactccgttttccgcgatgaaatctttcctatctcaggaattggatagaggagagcgctcggctttctcatgcgtttttgttattgaacggttctctgacgcttgcccactcgcggctctgtgtggatgctgctcacagttcgtcatattttcccgcactcggacgacgcccagatccatttgatttatcggccgggacactacgactttttcttttattcccctcgacaggccggtgctcaccagagcacgtaggatgccgtcgagtatcaacactgtttcgagccacgcagtgtgaaggacgtgtagaccttgactatgtggaccaaaacgtcttcacaattgcatcactttttgcaaagtatgctgcgcagtggcttacggtggaaagcggaagatgacatgcagccatggttgtcagtgtctctacgtgctaaatgctagtctaaaacaacagcgtactcggtgctctccaatgcatcaacttattattttctattcggcccggctacttcggccgtacgtcacttagcttgagaaacgcggctacgttggttttcactttgtgttcatttgacggtgacgaacatttcctcagtgctcgttgttcagcgaatgtggtcacgacgtacgtatttgctcccgaaagccactgaccgtgttggcgtgttggaaagcggccgacgcttcgtcacgaacgccctcattacatgcgttgtacccggcgaagcaatcgagcgcagaatgcctggtttgcgcacataactccgagacctgagtgaaacaggtgtaccagaaaagcattcatagacccctcagcaacggttttgttacgcgtacgacttccgggatacccaccatcaaaaggcttttcgtccgtctcaagaaatctcgttttcggtgttctacaggcccgcactcatcctatgtgaacgtgcctaatcgtgaattctcagaagcaagctgcggtaagatcgcggactaagtcgccctagtagaacagtggttagctgctgtggtcgggcagagcagaccatgtgcgtgaaaaggtgatgcacacgatgaggatcactcaatactgcagatcctgcgtccgtaccagcattgtattccggtagttttcgtcggcgcagtctatcgacgctgtttgtgcaacgaggctcaccaccacgttgacagttacgccattggggggcaacacaaattgcgctagtcacttggcggatcacaaacacgaagttgacgcttcacgacggcggtcgcagccattggcctattggaggatatagcagctagaagatacggctaaaagaaatagcactttgaatgccatcgaaattcataatcagtagcacggttttagacttcgcagctagacatggaaacggccccgccaggatgcgaataacaaaaacacggcggcgcagacactctgagcgatgcccaacatactaccaactccacaaatggatctgacgcatggcattgccaactcctaacgctcttccacagtctctttgtgaagtccgatatgcctcacgtaactgtactatgaggcagccacaagtctcgccttcgctttggcctcttctaccacttacaggggatggactttgtgctttgccgtagtggcacattcatggaggacgaatgcgctttcacgttctgaggcaattatgcaactgctggttgccgtctcacgtcatttgtgtgctgcggttccctcacgatccctggttatctgtcagcccctttttcttttatctgttttcaccctcgaaactctacagggatggatgctcacaccacgactgagctggcctgtgcaggaacactgtcccacgtcaggcactacttacgcgtctccatctccacggtttgtcaaggaacatgccacctcgctatttcttgccactactttcgaggcgattctgtcgttacggctcgcaaagcaaaagcaaattgaagacgaacgcaccgtcccacgttattcaaattcgtcaccacatcccacgaaaaatcacccacaattccaaggacggatgttactggttgggagctccccttgcaaggactgctctgttgtaaatctccacagtatgtcgctttgtacccatctcgtcgcggtggaggatctcgctggtccggggatgccgaagctgacagtacgcggcgtggtgaatgagcagcaacttccgcgcaagtcgcgagttactggacacacccggaagcgctttcaggggtcgggttctcgagtcgcaagcctacaaagcgttttaataaggtttctgcggcacggatccactgctgcggatgcaaatcacgttttctcgatgagatcatttgtggatacagctacactgagagtcggcgcgagggtgtgaactcgaggtttcgattcaagaaccgtgatgactgcgacagttgtacctatcggagggcctgagccgtttcgcgcgcatgcctgtggcgttgacacggtgcttttcatttaggcttttcgcatcaccgctctcttcttccagttttttttaacttacagagggtgtttggttcgccgagcgtcgtgggagtgtgcgagtgttggagcaggaagattggatgcctattccctgaatttcgcatttgttgtggacccccccgtcgtcagtgatcgaccgggacaatccgggcgattcttgatgcaaccatgagtttttgacgacaatgtttttgggagtggacacaccgttcggagtggagggtacaagcggcgtggttta

SEQ ID NO: 3772 - DNA, 2811 bp, Toxoplasma gondii
tgaaaagtcggttttgtgtcgtccggactcttccaccaaaagttcgtttttcgtcctagtggctttgttccgtggacactctcaaactcattctcccccaggtcagagttgccgggagtggctaggaacagttccacaaattctactaaagcagcggcctgcggaaagtgtctggagtcttcggacaagatgtgtcgctgtagctttccatgcatccccgctctggtggaggcttacacggtgtggcagtggcgacgcctgctattatgttgcaggcgcagttgcacagatggccttcaacaagaacgatcggggtctaagaaggcgaacgaccgtaccgtgacaatcacaccgattactgctttaaatctaaatggatgtcttatgaaacaatcttattttggatcccgcacagtgtaggaaagaattgagcaccacatatattacgtgctggcaggtcaaggcgggaacggcttcccccatggtttagttaaggcctggttccgcgacaacagaacgagaattgcaaagcctcccaagactgttcacagaatgagttcacagagcataccgccatggcgccagttgtagttttcgtaggagtttttctctttcaagacacttcacatgggacaaagtgcggaaaactgtgcattctttaacctcgaaagcaacgctacaccagtgaaagataaaagccgttccggtggcacttccgacgtttttaccatcccggggcataggtgtctcgacgaagttatggttttgcactcgtgagtgcctctcaataaccatccgagtgttgtacgataattaaatcaatgcattaccaattaagcagtgttacggcagagtggatatcgattcacgtcacactatctctgaattatgaaacggtcgacccgcagtgtaaggattactgttagcactcgtattaacaaggttgggaaactactactcagatgttttttttaaacagttgaatggatctgtgcaggcgttttcaaccgaaagtagttttgcctttttatggccagtggcgtggaactcaggtggagtttagttgcgtgaacgaagacgagatcaattcaaagcacagatccactcggtaaagaaaacagtcacgacagtttgcagtggttccacaggcggaataacaatggttttgctcagcttctgcagtgctcttagtgatctctgcagtccgttccctcgtttgaaaaatgaatgatgtggtgttgtctagttaagaacggaatgaatattgacgtaccctagtaatggaaactttaactgtctgcgaaccagccaatggtggagcgtagcgtctatttgtaacttcacctcttgaagaggcggtataagggtgctgaggccgaactgcatgattccatgcacacagggtggggggtccttgacgttgcttgcaagctgtgagctaactgttcagcgtcttctgaaagaaatgccatcactatgtcaaaaggatgcgccaaaactgggtcagttgacttcagctccattagattactcatttgactgttgcagtggggcactcgttttacccgtgtacttattggtcgacgtgccggaatacgttggggccggaggggaccactagcccagcaacgaggcgacggtagagcttcgattctgccctgaccatgataacgcaccataatcggaaaatgccaaacagatggtctgcaactgagtttgaaatagggatgtcgaaactcttggtttcagccatccacagggtcacttcacagtatacgatttttccctaacaagtggctccagcattttgcttcccgcggccgaaacactaacggccaacgaggccttcgcatcacaagttgctacgtcccctgctctgtcctgtcgacaacggcctcgagccaaagcgcgtttatcggcaaaacaaatgcaccaggctggcgtggactgcaacgcagcattgtcccgcagcatgtgagagatagtctgcctgtgtattttctttaccactggtaaaattcatgatgctcctggctgaattcctgtcgaagcgtactctgaaggcctcacttctggtgctctacgaaattcacatcgtaagcacttaccgatgggtccaattggagagaacaccaggcggtccaaacaaaaaacttctgctttatttgcacgtttcaacgagttgtaaatcaacaaggaacccagagttctcgagtcgtagttcctgccccagcatccaactccctaatatgcgtccatgccgctttttagtttgctgaaattcttataggtttgataggactcgctcttcagaaggatgctccttctcgagacgcatcatacagatgcccgacgaccggcgttgtgcccgtcaacagagccttcagcgccaaaatcaaggcaccctcagcaagaaaaaaaaagtaccccccactgatggtcagacaggcggcaacgagtcaaacaataaaaaacaaaactgtcgcaacttccagaacagcagaagtgacgaagttgagggcgacccgccaagacgcggcctcaagcgagctagttgacgcggttatcgctttactatttttcgcagtaccgtggctcatggattcaacagttgcacttttctagtgatcaccttaaccgccagttccaccaatggacccagagagtcaagagctccgtggcacagttgagatgcctcttgtgagcacctccaagacgtacccactgcttttttgaatcgatccttttacatcagaaaaaagcggtaaccctgttttcttgagttcatatttattttcaaaatagtcgtga

SEQ ID NO: 3773 - DNA, 4506 bp, Toxoplasma gondii
cagaactctcttgacacaaggatgaaggcagagacgacgaaggaagcccggcacaggtaggctgcgaaccaggagagacatgtggtacgcatgcagctccctcagcagcttcccctaacggtttgctttcctcgtatttagtccctttgccttgccgtacgtctgccgtctgccgccctcgaagcagctgcgcccgcttcagagcatgcgacggggagaacggagacgctggcgaagaagacgaagagaacgcagaaggggaacagccagcaagttctgatcgacacagggcctgcgcaacgtacaccagggcgtcgggagagggaaggagacactgttccgtatccccagtgcgagaagccgcgttccctggagaagctcttggcgaaggcaaggaaggagactgttgtgtctggtaaacctgcaagatcctctggaggcctttccgtgtccgacagagcttccggataacagaaaaggagatggaatcgggcagcgagtctcctgcccccagtccacttcctcgaattggcgcccccgattctgctgatgcagccctcctcagcagatgtcgggaagccgccatctgctcacacgccgaggaaagagacctggcttccgggcacacttcgtgttttttcggtgagctccaaatctaaattcatcttacaattttgattcaattttgattcaaggagggctgcagggagaagaaaccacaaagagctgcaaacgtcattctagtttcccatatcgctcacaagcatcctaaacgacaggcggcgaggaaagagaccaacaggacgagacgacgagaaggggaagcggctgtgaagacgaaaaagcgactgttgcgaggcaggacaaagacacaaagtagaatgtagaagaacagagagcagattcaaacaccggaatatgccgcagtaaggagactggcgacgaggtcgacgtgccttgaaacgcgctgcatgcagctagatcgagactcgcctatcgcaaaaaaaaattggagacagccgatccccagaattcaataggttcgtctttctgaaggttactctctctcttacctttcaaatatatgttttttggcctctggcgctttcttggttccatttagtgtcaacgcgccgtctcttctccgcaaacaacagcatgctgggggggggacactagctggtctcaaccagaggcgggtactgtgtttctgtggcatctcgtccttgaatttcttttattgagtcggttctttgcatttttcggtccaggccaatccagtggcatatttccctcattgactgcaggcttgaaggagagaaggagtgccactgcgagcggtccaagatgaggtgcaaaaagcgcaagaaatgttgacccacgactagacagtgcgcacaagccggttaataaacgtccacgtatcgttatatatttacaggcaggcacgatcacacacaaatatacacattgaggaccggatacgttttctagtgctatcatactccagaaaacataggcaaatgcgcagtgtctggggcagtggcagaacgcgagataccgtgcgcagaaaagcatcgacgctggttttgcgcgacccagtatctgctgggaaacgtcatatagcgtaaatagaatagaattggtacagttctgacttcattgtgaccgccgtagcgtgtggagaagtccctttatctcgtagccccctctgagcactgtagggtgttcttcgccgctgcagcgtgcatgggtacatcttgctcggagtcacgatttatcactccttatctgggtgtctgtacgtctacagctttatcatgcgccagtttcttgtgtcaaacgtcgtctccgtgtcgcgttgcctttaagtggcacagcccgtgtgttcctgtctctattcgtcattttctcaactcaggtgtctgcctttgttcatgacgactaaatacatgtgcttcctggtcgtttcttatacttcatctatactgaatattcatatgtgtttgtgtcggcagaggtgtgtcgtgtttctctgtcactcattaaaacattttcatcacccgccatcaaaggggatctcgctcaaaaggcccaggaaaaacgaacgttgaatgtgaatggcgattgcaggggcacacctctctgtggtaatgaccattgacagcatagacgcttatacttaggcatgcatggcttaatctttacgacaaacatatgaccacggtcaaggtcaaccaggtcaatatgcctctgaggtagaccacttccaaaacaccaaacacactcaatcaaccgcccagtcgcctgtcgctttcgtttttcatgtcacaaattgagatgagagcctgaattgctcaaggatacatgccaacacgatgttgtcgcctggtgcgccttgagagcagcactagtttctggtgatagtaacgagagcgagatgtgtccaaacctgcgaaaacctcgtggaagcggtcaaacccacgggcatggcgcagcctgccgattaccattatgtatgtaacaaataagaatacgggtttagtcgtcaaagaaacgaacaggcagtacggtttcgcagcgttgcctctccccagttgttctcaaccggaaagcatggaaaaagacgattcgctgcgtctctgcacgttcgtatcgaacaaaaaattgaagcccttgatggggacaagacccttagtgtgtagataagtgcctctacgtcaccccacagcgaaagttcggggctgccatcgcgttttcgagcatgccaccggtgtcaaactctggctccagagaaacctgacttccctcatgtggtgtaccagatcattcctcctaagaatgctaccccagtgtttgtttgtctctcgtgaactgcacattctattaactttagtatggatcagttgctgccaccggagtgacggggaaaccctcagcaaaaacccaaagaaaatatcggacgaaaagcataaaggtagccatggcgtgttcctctcgaaactgaggaaatctagcagctcgagttctgagcaggaatatcgccagtatccgatgtttaccatttcagcatacttctatcacgctgtgcaggccatcatatatgacactcaacaaaccacattttgcgaactaactactcaaatttgcatacagaacgtcctgttgcggaggaagaaggaaagaacgaaaacccttccccaactccttgcccaggtgaacgtgactttctcagtcagaggaaaatctcgcgtgtgtgctgtcatcttcaccgggtgcccgagagccactctcaccgccctaatatcttagtccatgttgaactgcccttggagaatttcgtagagtaggacactttcagaagactcaggacagctacgcttttccagctccgtcaatggagactccgtgagtggcctttcacccagccctctctcactgtttttaattccgcgggtatttagacagctccctgacacctagcagccaaatgagactacgcggccttctccccgtggctactactctaccacttttctcgcgaccaaaaggcggcatttttcctccacggaagagattaaatggtagagacagcacgagcagaaaggagatatatttgtgttcgtgtctgattcacagccgtctcctcacttccgttgagacagagtcaggattcacacattcacaacactgggatgcgctggactccatcgagtcgagtgtttgcgcgagaaaagtcggggcagctcggggtcgttgaaacggcaaacactggcaacaaaacgggcaaacggtgcttcggaagctcagacaaactggaatgcgtagcgataggatgtggcgcgtgcaaaatgtactgacttggggagtgcttcttctcagacgctgccagtacctcgacagcgtccccaaagccgttccagagacaccgagtcatgtcgacactcgatagtcaccgacgaaagaaataagaacaagacttcactttgtggtaacctttcgtcgtcgttcgtagtggatcttcttcggggagtatatcacatagggggtcgcttgagttgctcgagtcttcaggcaaaatatggaaataaagctggagacgacacgctgagaactttggggctctgccctgcgcttttctcgcgcgtttgccgagtttatccctcttcaagcgtgtagctgaattaaaccgatgctttcagttgctcgatgggattaccactcgtttgttaccttttcggggctctttctttctgcagtcacgaatccgtgcaatgtcctcgactcagcgatacccacgtgaagtcacgcctgttcgttggcttttttgctatctgattgcgccagagcttgttttgtgcatttcaatctagaacgaatcgacgagttcttcgcctgtcaaatcactggacaaaaaactgaggaagctcttttcctttcgtctctctccttgcactcccgtccgtcgttctgatcactgtggccgtagctttttgtttacagaga

SEQ ID NO: 3774 - DNA, 2580 bp, Toxoplasma gondii
aaacggtatcagatggcttcctccgcgtcgcagggcatcttcttcctctgcctggggaacgcctcaagaaggcagagagcaccccaaaagggaggtggagacagaagaagacgaagaacgtcgcgacaagagaaacaaaagcgagaagagggagagaaagaggagtcccgagaaaggaacgcgctgtctgcgctttcatggctataccccgacgtctgtgtagtcgcctcgaccagcatacagagcagtcaatccgtcgcgaagaatgcgaacgtagtgaggatgcctgcggcagttgagggcaagagggccgctggatgggcgccagaataggaggcgagaaacgccgtcgagaaaagttgctggggcgccttgatccttcccacagagcggaggtgacgaagactcacaagagagcgaagaagaggaagaagaggaagaagaggaagagaaacttcttccacgaccagatggcgtttgagtcatcgtggggagccggaagaagagaagcgagggaggtacggtgggaggggagacagctggagattgcgggagaagaagagagaaactgcaaagacagaaggagaagatggaagacgagcagaggtccgatcgagaggagtgagagaagaagcagggagagtcaaaaacgtgagaggaaggaattctctctcaaggctagatcctggcgagtgcgttgacgttgcagatgcgagcagagcctggcacatgaaaatgcccccgtggatgtagaaactgcgaaacgcagcgcaaggaagagaactgaaaagagttgagcgtggagaagaagaaaggaggaaacgaacgagagcaaggaaacgggagagaaacggccctgtggcttcttctcctcgggggtctcgtcctcgtctgagagtagccactcacacataggtttccggtgtctttttttttgcgtttcgagtgaagtcgttgtttcgtttttctcaagaaccgcgagaatgagaaggagggaagtctctgtcttcgagctcgatttttccactctgtttttgtgtgtcaatcccgcgagagacgcctgttcgctttcgcttgttgacctgtctcgctttccccagtggcactccgcgaatcagagacacgagctgttcttctgtctctgtctcggtttttctctcctcttcttctcctcttctggcgaggcacagtcgacctttctgcttctctcctccggccctcgccgtccttatcggcttccgtatcagcggccggggacccagcggcgcgagacctctatctctcgctcgagcgcgctgcgacggctgcgtttgagtctgaggagagaagaagcgagaaaaaggcagcgcgaggtcgccgaaaggctggagagacgacgaagacgaaggaatgatgggaggaacttgaggaagggggaattcaaaagtcaatgcgaggcaaactttcgtcaaggtgttacctatgaacagcgtggacagcgggtgaaacagcgggagcgcaaccggaagaagaccggaggcgaggagagaagcgcggaatgccgcgtttcagacgacaaaaagaaggagttttctctttgtacgggggaaaaaagaaatcttgtgcgtgtgtgtgtcgcatcgcgaagcccgatgcgagcttgggaaaagcaaaaggaggctttcgaggttctcttccagtctcgcgccgagacgcttcacaaaaaccgaggaaacaaagcctcccgcttttccctctctgagctccaggtccacggtcgctgcactcctctggactcgctcgcctggcggggcttgcctcaaacgagaagcgattttcgcatgcagttcccaactgatttttcctccgttttttctcgatatctgcctcgagaaaaaagcttcgcagggcaggcgaagctcgcctcgcgactttggcctagacgcacttcgtctcgacattttcttcaaagcccccagacaccaactgtcactccgtcgccaaatctgcaagacaaagacttctgcctcgtcaccttttcttctttctcttgtcttccctcttgttctccccttgctctttctctctcttgttctccccttgctctttctctcttttgttctccccctgctctttctctcttgttctccccctgctctctctctcttgttctctctctcccttctcccataggcgtctgagggccttcctttcttctcttacgagagaggacggtgaaaaaagattcgaaaagaaagaagaaagaagttttatgcggaggaaagggcaggagaggccgcgcaacttctcttttcctccgtcgttttcgcagtgggaggcgctctcgcatgcttctgcgtctttcgctggcgttcactttttttccgatgtcttcttcgcgtcgtgactttcttcgagattcgtcggctctctgaaggaagtttctctcggagcaggaagtctcccctcttcgcctccgtcccctcggagttccccgtggatattctgacagccttttccctctgctgttttcttctcgccaagttcaactcttcttctccgtgcctctcgcaggccgaagtacgcctcgcttgagaaaga

SEQ ID NO: 3775 - DNA, 2292 bp, Toxoplasma gondii
acctctctgagaccctcgacagacggccgcaaaatcagagagagaggctgcaggcgacttgttcgcgtcctctcgcgaagtgctcaagaccggcaaacgaagtggattcgttgtcggcagcaaatggctctctggaggctggaagttcgcacggggccgacccagagggaagtctgcgtcggcgaccgcgtattcgttgaggaacgaagcttcgctgtcgtcttcgagaaagccaccatcaaaattggcctgcactggcgacaaagaataagacgtcatcgctgccgagaggttgagcgtagggagagctgaggggagaagggagacccagaaatgctggaaaactccagaagaggaaacaccgaaagcagaaagacaagaaaagacaaaaaaagacaaggaaagaacacggacaaaggatgggaagtattctcgtctctcgaatgcggcaaggagaaacggggaacagagaaggtgactctctcgtctttctcggttgcctcaggtgtacagacactgcgaactccctggaggcgcgtaggtggacagcgaggagttcgaaggcgttttcgggagaaaggagaaaagctgagttccggacctgaaaagacgcgcgagtcgccgtatctcgagagtgaacgttgctgcggcgaacagccgaacaccgagcaacgagaaaccacaaacttgacaaagccgagaggtaaacgaggtgccttgaccgcgcagggtctgccgctgcatgcgcccccggacaaccggagaacagggtgacctcagggaaagggaagccggagacaagtggacagcgcgaggcctccggattataatgttcaggcgcgagggccgctttctcttctgccgagcgtctcagagattggacggacaggaaagcagtcacaggcgagacggaggaaggcttctcagcgcgtttgactcaaaaaacatggccaccagagacgcagggaagtcgcgttcttgggctgttcttgctgcagaatcgtttctcgttctcccgcctctgaaaagatgcacgtcttctgtttcgtctgctgaagggaacagagggtcgcgagaagacagacgagaagaaaagggaggtctgccgctcgatgcctgttgtatggccgagtctcgagttctgcacacgaaactctcggaggtcgagaaagaacagatacacgcagaagtccagaaatctgcgttcctgactcgcctcttctttgttaaaactgtggagtgacccggacttttttgcctccaactctcggactgatttcgatgccggagtcgaagaccgcagcgccttgcacacaaaaaagttcgcatgcaaaagatatgccggcgccttccggccagcgcgtttccctccagaagtctcgacttccgcagaaacccagaacgagacatctcttgttctgcagagtcagcaactgccctctcgctgcgtgcggtggcgctgctccgacagtctttcctcgcgaaaaaaccttgccctcttctcgcggaaatgccgcggagaaagcctccggagaacccccaactcggacagacagagacggcaacagactcaaaaaaagccactcggggctgtgccctcgagaggcgactttgcgaacgcgctagtgcgaggacgcgcgccgctcagtgagctagcccattcgttcgagctgacgagtaggggcttgtgcaatttcggctcgagcagggggcgagaggcagtttcgcgcgcgaggattttccggctttttcgctttgcgctttttcggtttctccaggcgattttcgggaacattcaaggctcgaggcacactccttgtggccgagtttgcgcggaaccggtggagcgtcgagtgcgagctcgtgaatgcttcgatctttcagggaacgagagtcttccaagttggtggatttcctggcctccggcggatcctggagaaagcgagtttgtacagtcttgaaagttgcgcagaagcgacgtttctcctgggtctcgcgggagctcgctacctcgagaggcgcgcaggcgcagtggctggccgagttcctcgcagtgtgccggtgaacgagtttctggattcacttctcttgcgaacagccccaagtttcttccactttcctcctctctcgaaggactctgaggttctttcgagtttttccttccacagagcctcccagttccgcttcgcttgccgaagtccttcagcttctgccgccgtctgctactccaaccagacgaggtccttctcgtccgttcccccaagaattcggctttctgctcctcgcccaaca

SEQ ID NO: 3776 - DNA, 4713 bp, Toxoplasma gondii
ttagcgatatcccatagcagtgacgttctcagcgcaacacaaggatgcctgctgtcccctgtgacttcctgggccgactgggtgtgtcggcgttcttttctctcgaaaactcggactcttttcagtggttaggtttaacggcacaaaggaaatcgaaagtctttttacctctctcgagcagtccaacggcgtggtggaatctccatctgcttacctataacgatatatacatgaatatacatatatacatatacatatttatttctcctgcgaaaaagctgagggaaaactagacaacgggagagacgagcgagagactgaagacacgaactgttgatcgcgaaagaaatcctttcttgtcgttcgtttttgatggcctacggtcgctgaagtgtctttgcaaacgcccccgcggatctttggctttctgcaccggcaaagaacgtcgcctcccccagtcggggaagagtccctcgcgaggagagtctcgcggccgtgcagaaggggaaccgagagccggccgccatttcgttgaagtaagaaggagagcggagaacaagaggaggagcagaaatcagcagaaatgtctctcaccaagcagcgcacaaacacaaagcagaaacgcgcgacctcaacgcagaacgcgtcacggttcgaaaggtgggtggagtacagccagcagggaattccgacaaagttggaaggacacgacagagaggcgacggcaaaaactggaggaaaacgaaaggcgggaaaaacaagaaatgcgagaaacgcgtgccggcggccgcaagaaggaaggacctcgccaggctgctctttgtgtgctgcgaaacggagatggaggaaggcaagagaacgcgctacagcgtccgtctcttgctcgttttctttctcgaccgtttcttctgagaagaggcgacgccttctgcgagcaaagaatcgaaggaaaagaaggcacacacgccgaacaggaaaccgaacaagtggagacgtcctcagctgcagaggcagggggacaggaaaaatcgcgaaaaactgattttctcggtcggctgcttcaaatgagcataccgtcgatctacgaaaaacgaatcgcttttctcctgcgaaaaaaagcgaagaaaaatcataaaacgggagagaagcacgagagactgggagggagaaaagcatgagcaaaaaagacaccggctgcatttcctgcatgcgccacacaaacccacgagacgcctcacgggaggacaaaaatctggcaagcgcccaaaaggacttggcgcttgtttctccctttctttgctgtctgccggtgtctgatgtcttttaccggattctgcgcccttccccctttcttccttgtcgtttccgccctctgggcagccctcccatgcgtacctcagttcgcacccctctcctctctctcgcattcgttgtttcgcggcctctccctcttctgggttgctctcccgcgttgtccttctttgactcagacgctgctttctccgtccctctgcgcatttcactttttcacttggtgctcgcggacctcaattttcacacacgcgtggggagaaccggaaaacgcacatgctagaggagcgtcacagttaagaaacatgagcgaacagaagatgagactttcggaagcagatgtcccgcgttcaattccaaaaccaagagttgagaatacatacaggtgtattcaataagtcagagtttccctgggggtcgtcaaagctcgagtcgcagacagcgtcctagaagaagaagtagagcaccctttttcagcgcagcaatcgagtgaacacagacactggagtacataggacacccactgcgactctacagttatgagatacagacaaccaagcaaaagagagatacatccagtcgacagaagcgaccctgttgtcgagagacttcgcgaatttagaggaaagggagtaagcgttaacaaggaaggaaaaatcggaactatgagggaagacgatcaaactggaaatcacggacttttttcagctgtgctcgcggaataccccgacctataataaccaagaatagcgtactgtatacgcaaatagtcacccatccatttgctagacttcgagtgtgcggctttgcttcatgtgttgcattttttcgtgcgtctttcatgcagtaccagtttgggatgaaatcactcttaacactgtcagtgcacttcaagaaagcggcatgtaccgagaaatccaacactcgtttcgttcacagaaaatgaagccgaaagtttggagtcggaatctaacagaagtcggagttctctgtgtgtacatgtgtgccttatctaattggttttgctctaggcttttcgaattgccgcgggacttctaatattttctagacgacatgtagacgcgttacacagctcagagaatagcagacaaatgcacaactctttgaaggcttctttcaatcaaatctgcagcaaaatccgctgtcccacacggctagaaatggatagaaacgttagccaacgttgttgtttcggcttcgaaaaccggtggtaacagtcgttcagacaggatctaatatcgttacgcattttttctgcgagggaaccgtgactttttgtcttcaaaagcgcagagaccaggctttccgcctgcgtcccggagagcatagagatgccacgaatccgaggactaccgaaacgtaactcgcttgcggatctgattgccgtgcatcacgagaaaacgcaccctcgtcatctaccgatacagaagtttcccagctttgttgtctgacgtccgtttcggcgtttaaactcttacgccgatctcgaagttcagaccctttatccacttcctcagatgctaggatgatcagcagcgtcgtactgtgagtatgctagaaagtaccgttcaggtacaatataaatagatagcttcccctctgtattaacgacagacacacgaagttcagtttccctgcctaggcgtcaaccgttcaacaactcgctcgtgttctgtggaatcagacgtcgtccaccctatccggaacagctctgcctcgccgaggtgtcggtggattctgccttgtttacgacagaaaggacgtaatggcgctcagggtcgaaccgtcggggcgtctcgcccctcacattcgagattcgcaaaatgtctaaagtcactgccctgcaacttgcagtgctgaagcacatagaaggctaactgaaagtacgtgctgccctctctaagttgcagggaatgtgttctatgtttacggacaatccgaaaagccacaactactcattccgatgagtgctctttgtgtttaggaccgactctgaatgagcgtgcgaaaaatctgcttctccttccacagaaaacgccactcgcactcgcaagagcacgacccagaacgggaacttgagttcttgttccgcttcgcattaccaccaacggacgaactgtcaagttcaccctgccatgtaactcctaggattccgcgtcgtttgccgttcgtcgattccaccggtttttcgcggagaaaaccggctacaccacggtgtcagtcgaatcaacaggagagacgagctctttctcttccttcgttgcgtgtgtctgaagggaaagaaaggcgcacgaagttatggagcagaggtaaaaaagaggaacttctcgacgtcaagcggtgtgctgttggctgttgcaggcagagctgcaggctgcaagaaccgttttcgcacagcctcctcgccgtttcactttcctcacactcaccccaaaactcagcaggttccgtaacgcgagcttttctccgttaagcgagtgtttctccataaacatccccacgcaatcgcgcaaactggcgactgacacgaactcgcgagacacgcgcagtcagtcctcgcacatgcacatacagctcatcttcgaactcgtcagctgcattttcgcaaggttacgcaagcggaaccgcgtgaagagttccctccctccatcctttttcccctttcccgttccgctggaaatagcacgtataattgtctccgtctgacccgaaaaacgtggcttttgcgggcgttttactgctcaaaagcctcaggcgcgtgacgcggactccaagaaccgtgtcttggtcctttcctcgaggtagcctgcatcgtccggcgacacaaacacacacaaatacgtgtgagacttttcttttctccgagcgagttgacgaagacgcatgcaacacatattttcctttcccccgttgtgattcgcagccgccttggtgtctcggcgttctcgagccgcgtgagaaccctgagcacatcatgtccacgttggaaaagagtcgccttctgtagaaggtcctgtaactttctacccccatcacgccgaaaggatttgacgacttctctgggactacttcggtgactgggttgcctagaccctcccttcagcgtggtccaggcgtgagagcatacagtgcagcgcagtgttctcttgttcttagagtttgtttttcgcgcttccccttcggtcttttctgagtcagtgcctgatttgtcagctacacaaagagcctcgcaaacgtgaaaaaaacagaagctctccacgacacagcgaagaccatctcggcttgcagcgacctttctgcgccacagaggggacctgacagaaaggacttgggtacacagagagcggtggcctggcgacgtctctttctccggggacccta

SEQ ID NO: 3777 - DNA, 2525 bp, Toxoplasma gondii
gtggcagaagcactcgaaaagacgctcttggagagtgcgacttagaccccgaaatctacactttcgcacatacacatgcagccaacgacgttcgctcacatgcatgtatagacctacatacacataaacgacagactccttttctagtcatgcttgagcgtgaagattggcggttactccagatggcgacatgcctgcctgtgcaagcgggtccagacacgagcatttgctgctgcttcctcgaacattctatatacatgcaaacacacttgctccatgcaggcactgtcgttccctgtagaggcacagatgtgcgtaaagcggagagcttcgcggtgttgctcttttcccccgttcctcacgaatccatctttctcaagcaggaaaaatgctaaggtgaaagcattaaagagagaaccgaacccaagacgcgtgaccctctctctcccatcaggccccagctgctcaagaaacacacgcggtcataggacagcagctgcagcgcgtgaagaaagaaaccacgacatatttttgacacaaggcacagagaatgtcgagaaacactcggtgcaacagaaatgcgtgaaggtacaaagatcaacgtgaagctcgggaaaaactgggaacgatccgagaggctttccccgccgcgggggcaccgcaaagtctcactggcggctgggcagccgctgaaaaccaatcgcttctccaaaagatgccccgtttctctggaagaatgatgaggtggaagtgaagaagaatgtcaagtggaccgcaacttagcaggtgtgctcgagaaccccgaaaaagggccggaaaagagacaagacgggcgacgaaacgaggaaagcggtaccgttttttgagaagcaggtagaaggaacttctcgaaaaacgacatcttgcattcgactaagggaaaaaagcgccggaagttccctttccggcaaaggctctgcaaaccattcccacccccccacaccgtttcccgtgttctccgcgatttttacaaaagtctggaccctaccttcttcgtgcgcttcgccattgtgatagcaagaaagcggagttttcgcggcctcaaaagagtggggaaagttcggaagaaaaccgaggactactcacagagagcaagaaaaatggagctcatcgcacaatggcacgccctctgcgaaaacacgcgcatgctgaagcccacattcgcgttctgcctcagaagatgcgattcaagcagacacagcgtaccgccaaaatacaaagaagtccattcggccctcggcttccgagaaaaagccccgaggtatgtcggcttatatacggggaatgggagaacccaaggttcctgaatgtgttggcttgtgtgtaaggaactctgcccttcgacggccttccaaacgcggaaagacgagtgagcctgtagacgagtgtgaaaatgaaatgccttcaccaagttgtggcttgagggtttccacaaaaacgcaaagagagaaggggtgctcctggaggtgtgcccagccttacaccttctacagcgaaccgttgtatctagtgaatataccgcgcagcaacaccaaaccgtcactgtacaagagaatttaaccgtgtagacttggtctttttgcggcaaaagcgtagccctacggtgatcatggtcggatcttactgtactatgtgattagctaacgtgcctggcaccgggcgtcccttcttggtgcaccaggtcgacttcgtgtttcctcgagttcgtcgctatctaaacgcgtgcgtactgtcttcgttgaatctctgagcccactgcagaacggcggtggtgggtaatataatagaggagagtttatggcgttgatttaaaagaacagctagagattctctttctctgtcggtccgtaataggacacagtcctgttgccgcgtctaagctgtatatagcaccgcacagcggcggcgcacctaaacggttgaaagagctggtggtcctacgaaagggcgtctgtctgcacagcagactctgttggcggaaatgcgccgaagttggcgtggagatttgcgatttgaggtttttctgtggaaagactggcagcgtttttgcagcagacggagatgttgtgcgagagcacggcgcttcggtgtcgaagagaggcgcggtcgcttcgccttcctagccacagcacccacggtctctcggcgcgcggcactacaccccctttttgcagaatacacgcggatgggacaggacaaggacgggcgccgctggggtggctcggactgatgttgcgtgtcaggaaatagtgcgacgcactccggagggtggcacaggtctgcgacaacttttctgaatgcgtgctgcactttaaaagttcgtttttcaaaagcgcaagtttcgcagtgttttccagtcccccgtcgcgggtgtggaacggtagaattcgactcgctttcgtgcgactcctggcgtctttgtgcagagccgacctctcggcagaagccacccttgagagttctttctctttctcacacactcacaa

SEQ ID NO: 3778 - DNA, 3184 bp, Toxoplasma gondii
catcttgttttacaatacctggaacgctgagtcactgcagctgggtacggaaaagactggtgggccgagacacacagtcggcttgcgtgcgactctggcgagggtggacgcttgcgaaggtgctgcggtgtacatacagcgggagaagttttgaagggagagcgcgggtggagtctcgtgctggtatctgctggcactcttggaagttttgcgaattgtccgaggagaaacgagcaggcaggctagaacattttcccaagccccttcaagttctgcggaaaaggggaagggtgtaacgtcacccgctgtgctctatgctttaacgcgggaagaacgcgccgaagagacccagaaaagaaaggcacagaaatccgtcctgttagagaaaggcgtgctcgtttgcagcgtgcacacacaaagagagagcgcgaaacaggggatgcagagagatgtggagacaagtaccatattagagtgagttaggcaactgtgtgtgtccatcttgctgatgctagcggaaaacagttggacagaagaggcagaaggaggaaacctgcgcagcgcagagacggaaggagaggagcgatagatcacagtacagacgagacggtgcaccgaacacggactgcacatatccgctacggtgtgcatctccttaaacagactccggagagaaaagcttcactacctgcgcaggttctcactttgtccccctgttcggcagaagagagttcgaccgcaagcaacagcagcgactctaggttttcttcggactgctagaaagctgtttttgagttcttttcgcggcgaactctgtagacaagaaagcaggattggtcgctgtctcgagcgcatgtgtcacgatgttttgtcgtgtagcgcgtccataccgtgatgtagttttaccaacaaagaggtctgagcgagggaaccaggattccaacaaaacgaacagcagcttcttttgcgtaaacgtgagtcgtattgcggttcagaacggagataccggaggagcaggaccgcgtgggcgtcgttagagccatcaccatgcacggtctttttaatccgttgttctggcagcaagaacagatctttgttttcagcagaacagccagaggtgtttttaccaaaggtgtgtctcagcggtagtgcgtctcgcagtgagcaaatggggatacacgtgtgggaagtgaggtgttgcgacttgtgtgtgcgatgctgcttgcagaagtgagcatgtttgcatgtccgcctttagtttcgcacttcactgtttcggagcgggcaagataaaaagaactcagtggtttgtcttggttttctgtagtggcgccgcatcacggaatccctcactcctctcctgcgttctggagtcacaaaaaacaacacaccaggctttgattgcgattgcttcatcagcgctgttactttttcccgttgggatggaagtttcatttcagtgtatatccgtacaagctgggtcacaggcgcaccttcagaaacagataagcctgtcctggtaacaacgcactcgttttgccgataccacaacagccctcgcatggcaacgggacagaggcgctatgcgtcgagtcgatccgtgggatctgtacgaaaagaagcgcgagtttttcatgcaatttctatggttcagcgcggcgtggtggggcattctcctatttcgcaacttgtgtacatgcacactgcgttaactcccaaggcaggacaccccaactccagtcgcagatgccttctaccgcggtggctctttgttcgtacaggtaggtcatttcctgttccctcctgttcctctcggcagcggcactgtcgcttctccgtcacccattggacgtccggaaggaaacgagaaccttgtgtgaaattacctccctagtgggcactgaaagtcccggcttttccactccatgcggcatcgagatgcacactgctttcgaatccaatatgtgtcatacacatgtgtgtatttgtccgtttccggcggtgtgaagccagtgcgctcgaggggcccagggctctgcctctgccagtgtttcgtcggctcccctggttctccagttactcaactttatgtcactggtaagtgacattttctcgagtccaaggactaaaccgaaaccgcgaggctggaaaggataccgttctccggcgttcagttgtttcagaaaatggtggtggagtgccgccgaggttttgcgcggaagtttcgcagtcaaagcgaacagagcgggagccgccggctagccagagttttcagtcgggcaaggggggtcgtgcacaccgtgatgcggcgcggtgaaagcgggaccgcgataaagggcatgagtacaggctgagagatcgtctgggagttgaggagagacccattacagtgaaaatcgtgaaaacagcggtcatttccctaccatgattttccaaagtcttgcggtgtaaccgctctccccgatttctcatcacccaggtgtataaccgcgcaacggttttttttgtatcgccggcccacctcgccgtttatttctaaggaaatcatctcccagttaaccgatgacgtgcctcaccttgtcgcttcctcagtcggcatcttccagagtgatccggataaaacccatgctgtaaaatcgtcaagtttgtcccgagggcagcaccgcgccgcttccagccctgtactagcaccagaggctcgcgtttttcggacgagtgaccgagaaaaggcgtgtgcattttgaggggattagctagttttctccgacatttctccgacagtgacggacacttcaagctacttaagggtcacaggagaaacaaccgcgctcacttcctctggttctcggcgtggttttgcggagagtgcattcccacgttgcagagcgaagccggaagacgctatcggctcggtgtcgtttcccctcttcccttcccagtcgaaacttttgagctacggaaaaaacaaagaaccagcaccatccgtctcctgtgacttcattcctcggtaaaccatctcttccgcccctaggttcgcaccccaatctcgcgttagcagttagaacctcgcgcttgcctttcgggaccaccggtcgctagggtctgaaaatctgttttttcccccaagttcctgcttcagtcttcctttttagcctgtcttccctctgttttgctccgtccgcca

SEQ ID NO: 3779 - DNA, 3048 bp, Toxoplasma gondii
caggcataaaattgtcgtagtcacagtcaaaccggacctctatttggctgagagacgttggattcttcccttgtggcagtggattgccagctcacgagccttaagacgatctttcgcttgaaggctccagtccgttacagaccagaaatagggacccgaacgtttctacctccccttgttttaggaccgtatacttcggtaactggacgtcccatcacaagcccagaggggttgagcgaaagaaatcagacccaccttcgttctcgaagacaaatgtgacagtgtcggaatcttcctcgttttgaatgctgcaagaatctgcgttgctgcagagcttgaagactttgcacacactagccaggttgaggccaagcgaccgttcgcggtcgcagcggaagtggacgaagccaacatcatcgagcttcagagcgaccagggcgacgtgggaggaatccatagcctgcatacaaaaattgacacaaaccgttccaaaacatgatgggacagccacagaagcttgtgcatatttacagagaaatgtaagtgatgtattcgcagatacattcatgtacgaacgcactcaagtgtgtgtgtgtgcacaatttacgcacagtcacacctaccatatcgagttacaggcatagatatgtgcgacctgtgaatcagttaacttgtacacagatgaatatctacttgtgtcgtgtaattaattcatggaacttagacgagaaaacccggtcgccttactgatagttaccctaaaccccggcgcacacaggaacaactgcttctggttcgacctcatgaatacgaacagtacactgcgtggaaataatgaagggaactcgtgtcgctttctcgaggcaagcatcgtgcacatttgctgccatcttgttggaaccacaccgggtgtgcgttgccggaaccgaatttccagactactctgcaggccacaacatttctctcagtcttccaaaacgcggcactcatgctcacctgaaggcggagaccagtttcatcgcagtccaggttgacgtcgctgaccatgtccttgatagactcaaacagccggcggaggacgctggcgtgctggagcttggcttccaacatcttcgcgggcacaaaaaaaaatcggggtaggagtgaactggagtcgctgagagcccagcgagggcaataggctcggaataaatcgcagcaatgcaggaaagaaaacaaatcggtggcagaaccgccagaacggcgtgattgcccacaaggcaagacgaaatggacagcagacggaggggcaagcagcaagaacacctgcgaaacacacgccgatcgacggggtaaccgggatgtttcgtgccaagagacagacggacaacggacgacgtaagcaaaccaaagggttcagaggctctctcttcccctagaccaggcgaaaggagaaaacagacggccaggagaacgcaagacaacttcaaaagtggaacaccagtccagccacattgggagggtgggcgtagctgtggtggaagccgcctctcttgcgcagcagatgttcaagtgtacatacagctgagattgttgtggtgcgccgctgacaagcattcgacgacgagacgaaaaccatggacagaacgccagaagctgcggtttgggcgagtgtgcgtgccgcggatttcgtcttggcagtatgggatatcgaaacacatcgagacctcgggtcgacaccggtgacatgaagccacccaccccggaaacggaaacacgaatgcgcgtccacccctctttaccatgcggcgttccacagcgcgcgtggttcagggcttctttgccaccatgccacttttcttgtcccgctcccacgctggcgactcgactctggcggtaccttatccttgcgactcgcgagttactggcgttcttcaggaaaactcctcttttccgctaggtttctctaaacgacgagagtttttctgcgacaactgacgattaacatccatgtgtagggtcaatttgtaccaggcgggggaggtaagggcaaatttcgggtcttcagagggaccctgtcaaagaagctggaccgactttaggcacaggcggagtttggtcccctggcgtctgcgagccctcgctgcggccgcgagaacgcgcgacggcacagttcgttacatgctccggaaaaattcgattcggaaaaagttgactgggactgacgttcttgcaaggtgcgagagatctcgcgacccacgtctgcttactcggttcatcccttgagatatttcctctttttggcgttcttgtaagataatgggggacggcaaaacaacgtcgacactgcgacagtagcccagaggctacattcgccccacacaaatatatgctctagccattcgttcgttttaactggcttttcttctcttgtttcgtcgttgtgggtagttttctcgtctttcctctttggtttctttcttccctttcatttccaatcttttgaatcggtcggcaagtcaccacctgcccctccggcgtcactttctgcgaccaacaagaagcgttcggcatttctggacgacgaggtcttcttttcttcttttgtttatcttctctccattttttcgtccttttgcacatctcaggtttacgcgcggcgtcgtccttttcatttccccagtgtttttccgggttcttgccaccccttcgccttccagttccctgccgcccgtggacgtttcccgtttgacgtgggtctctctcgcataacttcaagcaccgcaactgccgccacaacttcccttctgactctcctcgccttcctgtaaatagctctcacaacgctggctttttctctcctcttccgccacgcattttttgtgccgtcgttcgccatcaacctgctttcgctccttgttttctccatttctgtcccattcctctcacgaacaacgccgcgattgcgtcgctggcttcgctgctcgtatctgccttggcatctgcccgtgtgttccccgttttttccccagttgtctccggtgatcatgtcctgaatctcacacaaga

SEQ ID NO: 3780 - DNA, 1293 bp, Toxoplasma gondii
cgaggactttgtgtggatgggaacagtacagtattttccgctacagtcgcgggcaagagaaagacactcggagcgatagacagaaaggtgataagagaaatcgtgtcgttgtgtgtggttcaggagaggaaccttttgcaggtcagcacgatagacatgacttgtgattcacggagcacagatcctgcggcttatttagaaaagattttcaatcaagttgcgtcccttactgatccagtcagttcgggtaagaccttttcgcacggctggttgccactcgaacgcggcgttccacgtacctggttgatgtcctttcagtgggcttttgaaaggacgaaagagtatcgatgggcctttctccacagacagaagaggcataatcggtgcccggacgagacagacacaactcgtcctgccgccaaacaggcccgacggaggcccggcgtcactgggagtttctccatctttagaatcgtcacaacggcgcttgctgggggacgaggagcccagcccgataccagtcctgcagatacacgggacatacaagaggctggagaggtgatccagcaccatctcggctcaagctgctcacgtcagtgatctccgtgtgtgattaggttgaaatgcccgaacgtggcgtcttaatagcgacagagtttcgcaaccagacgagcggatagtctctggaatggcatacactcagtgatgcaagaaacaattgcgccagtgtcaagaggcgaccgtcacctggatccttgcgagtgactcgttctgcgaaactttgcttactgagccacgctcagggggattcttctcatcgcgtctgttctttcggcaggacaccatcgggtgggggcgtgcgttactcaagcgtgtatgcagttgcgagcctcagcgatagacgcagtcgagttgccgtggcatttttgagcgctacggaaacgagcagaacgccgaaattcaacggaacgcagaggagggacggtccgcaaagaaattggagaaagccgtggccctgctttacacccaagggggaaaaatggggggaaatgggacgggactcaactcgaactgtggacagagaagtcgaaaggcaaaaaccaactcaaaaacgtcccatttgcctaagaatagacgcttccaagtgtatggatgaagatgaacagcgacgcagattctgtgacactatcgttttacacagtgcactctgacaagacaagccctccacgaaagcgaaatcccgacgacttgcatgcgaaataagtggagacatccggaagatatcgccttcca

SEQ ID NO: 3781 - DNA, 2417 bp, Toxoplasma gondii
gaagcaggcatcaacatccgtgtgtgtcttcagaaaggaagtatagcagggcatcccacgtaaatgggcatctgacgtttgatggcgccagttccattattatgctgtgtcgcgagttaagcggctgcacgtcgtgtcacacgccgctactccacattatcgcgccgtagtaactttcatgaggccggacatcacgtccaccaaacaaaaatgtgagtctcgggaacccaacagctctgcaaaagggatgactaaaaatcggcaggctcttctgctaacccatacagacactgggtgcatattgtatccacccaggtattcgatactgcgcaatgactgcccagaaatgcacttccccctgctgctaatgcacacggagcagcgaaccccgtaagcagcaggataaatggaaatgcctggaaggcaaacgtcgttggcgacagtttccggtataatcacactttgtgcgaagtcactgtgttcaaagccggcattcagacgttgcacatcggtgtccacggcatgtttgcctctcgttctatggtcgaatggattgtagacaacacacggtctattcgccttttcacacccaggttcagtaaagagctcagagctcaatgcatgattgtgccattttgccacgtgaaacccatgcctagttgcgaggtagttgtaggttgctagcactatggtgaatatgtggccgcaacgaaaataatatcgagtgagcccgatggctcacacgatgctactctcgggtgtcaagacacgatagtggtagctatcaactcagaaatgtgttttttcgtgaatgactggtggctacttatacgccaacgcccagttgtgtcgcatttctatttcagaagttgtttcattctattgtcagaatgagatacgctcgtggattgcttctggtttgtgcctgcgcactctgccgcctggttctcgaagcaactgctgaatccggacgggctaccattcgggtaactcaagactatgacgtaagtgaacttgcaatggctgaaacgatacagtttacagtcagctgtatttcaggaagatgaagccgaatcgcgagcagaaagtgcgattgctgacttggaagaagcggacaaacggtagcccttttcgtcttagactgtggagaagagccatcatattattctgagatgctccttttgaagagaagaggaaatagatgagaaaatacagtcaagtcacgatgccgctgatgaggctgagattgaagaggtgaattagttgttcgatcttgataaaaatgcgagctctgacgcagagtgcacaggaagtcgctgagacagcagttgctgaaaaagccatcgctgccgaagatgcagtaagcagctttccgagcctccctctgctgaaaaagcatgctcatgactaaactctgcagatgcacaatgcatctccagacggaaatttggagagactcatgtccgaactcgttgcggtatgatagtcgcactacctccccgcgaaacaacgatgattaatctcgtcgtcaggcaacgtacgaattgcgctcggtcaaccaggtacgtctggcgggtagttaccttcaaatgccggtagtaaaactgcgcaaatgttcagaagctgaaactgcttgactaaatctaaatcggtcgagaggaaacaaacaaggcgggccccacgctgacgggtagtcagaggaaggcgtggaacaaatcggagccacttcgtcagaaaccatacatagagatggaaaggagcgcgtgaacaatcaagtgaaaacttgtcgtactaaggattatagtacaaagtgtggtagcaaacaggcaaatttggcgatgccgtttcttttgtgtgttaatatctgtggggcgttccggatgtttaaaccacaatgcaaagtcatgtcaccggttaactgttcgcgtctctggttttccccagtgaattgtagagactgcggccactccaaacggcaagcgcacaaaccttccaagcccgtctgcagcataaccacgccctgacagacagtcaggcgattgttctcttggcaagccagaatactgatagcgctactttgcacgcaaggacgttaaccgtgttcacatcctattaccccgctagtgagacgaattgaaagcaaaagcatggttctgtggtgatttttgcctacgacaaagggcagcacgcatgacacagcggtgaatcgtcggcactgaagttgtcctctagtgactttggctttgcctgacttgttgctttcaacaaaggagacgtgcacggacgtttcgttcttgaaggcagcggcgccacaggcagcaaaggaactgccagtccttaaagaacagaaaggcctgtgtccctctaacggtcgccacgctagatctggaggctgagttcaatactgtgaaacaaga

SEQ ID NO: 3782 - DNA, 4240 bp, Toxoplasma gondii
cgcgccagttagcgtcgaagtcatctacaatacttacttccttaattgcaagtatttcgaaaaattggcgttaagctgcagagcaaatggtgcacatctcgtccaaaagacatggaactgaatgtcggcatagacgcgatgacagacaagtctcgaagtcaaaatctgctgcttcttcagtctcgttgtcaagatcactgccttgcggcttttcaatagtcatggtgttttaaataaaaatggtgtcactctcacgatctctctacaccgtagctcaagagttttttctagcgcattttgtggtgctaaaagtaactttatcccaaacctgtggtttttgcttatttctgctgttagcgtaactataaaaaatctctaacaaaagttgacgttttcaagagaagtggaaaaggtgctcaaggtctgattactgtttcacgtcgatcatcgttttctaaaaaagaattgcgatttgataaacggcatatcaagagtccgaccagcatccaccagggacgatcttcgccctgcaaggattttcctaccttcggattttataatagacctgccgtctacactttaatcctccaacaccccgttctcttattacgtctgacttagaaaagcaatgaaggtggcagtccataaactctgtcggcagtgccgcgtctgaggaggagctatgctggcaaaaaaaaagagaccgcacaaagaaaggacaacaacgaaatgtcgaaaactagtcaagaggtgtattcgtgtaatgaaagaagccagataaaacaaagtatgtgccgatgtgggaaaaatggtaaggtggcgtgaaccggatcaggtgtacagttgtatcgttagtgatggtatttaggttcataagaggcaaaaggtaaacacaaacgtgtttcgatttaatagctagtaatgacaggtcaattcacgcaggtcaacgaagggagaacaaacagaaaagtgtgttataatgcgccaagtacgtggtacggagatgttttgggtcacgtggatagatcagttaggggggcagggcgcaggtgtcaaggaaagcgcagaagaaagcttattcttgtgcatcatatatgaggagacgtggatgaattcaggcgtatagctggatatggtgtgagctaatccatgcggcgcaccctgtggacaccatcaatggatattgtgtcatgaaagacactgctgtacagcagaaagttgtgtggaatttgatgcacatcccttgatgaataaattagaatacatccgagcatattcttaataaagaggagaaatccgcctgcagttgacatggtagaaagaccgaacatcttgcgcggcagcttgtcccctggtgagtgaaactatccctaccccacgctgccccagcaaatgacgagatcgttgtaaaaccaagaaaagacgttgacgttgttacaaggaaagtcagtgtgataatcgcaaaaaacaacatacaataataacagcacaagcaaaagtattgcacaagaatgtgagatccacttgtttctttccgactcgcctgtgtcgcttccgcacctggttcagccgtttgacccctaatacagcatgaactacaaagccatcaatgagccttttggtgtaattatgtaaatctatgtactgtatatatttatacatatatgaatggaaacgctcctcttacaactcattcgtctccccagcaactaacccgacctgtcgtcttattggattatcagttatgtcttttgatctgaccctaagtacgcagtaagctaattggatacaaggaacatgacaagcattgatacatttacatagacgacaaaaagccatcacgatagtggcaacacaggtgagcggcagcctaacgccgttccgcttagctgtgtgcaagtgtgaaacacgacatcagtcacgaaccatgagaagaactggtgccagcatgttcacgtagcatatcctaacggatacggactgaccgctaaaaggcgacaattgacacagctctaccccgtatgcgaccagcttcacacggctgtcgtctttctgactggctacaatgtaggcaccagttgaaccaccccgcttcacgcacgctgctactgaccaactaagatccagttttgttgttttttctttcgttcctgtaacgacgacggcagaatcggtactcgtggtttcccagacgtttcctccaccgtaagaggagcagctcttcattaaaacaatcgttagtcgaagagagtctcccggagtaatcttgttacgcggtggaagtggcacagacagttttgccgacatctgcactcttcgacacgatagaaggagagcatcgtccacttacctgaggtttgtaattctctaggagggagaacaaataaatctacgggaaaaactacaacgctgttattcgcgctgttagtcaccgggtagtgagtgcccagatggatcgaacacacacaccgcgttgttagtttcagcagacgttttctttttgtcatgagcatttaccggtgtcttcagcggacgcttgtatggaaaaaaggggaactagggaagaacgaaagtggccagtagttggggcaacagcaatttcaaactgcaagtcatttttcggacgccactccccttccataatcgctgctaattggccatctttgacctgcgttcaacaaagcatcctcctgtattcacgtcgcgcgggctgtttgtgtgtggtttcggccttaagctgccttacacatctgccgatatctgtaccactacttcggtttaatacaaggttcgtcaaactgctaagcggtttgatcaccggtgcggcctacgcaaagactgattatttgtgtcaccatcaccttcccctcaatgtacacatactcgggcgcctaccggtccaacagtacacctgtaaccactacttggctacggaataattgctcgatcaacgcaaccacacgatagaactagcaccctgttctggctagaaatcccctaccatcggcgtcgaaagccactgtctcatacagacgtttcatctcacaaacgaccgcacacaggttccaacgctaggtttcttcgactgcagatgtgatctagctttgcaggatcgggtagatcgtcctgaactatgaaggcacggtgactgagctttaccgttcccttggacgacgagctggtatgggtgaaataacggatgagacacggcaacagcatttgtcggaaagaggcgaaggaatgacgtccgaagtaaacgttggtggcttctagtgaagcctaaaagagctgtgcaagaaattgctgcggtttcattaagatttgccggataacttcttcaaacgatccatctacgcgcccccaaggttccagatatccttaagcgcgatcaatttaagaccgttcaccacggatgcggcgagcgagctgaatgtccttgggcatgatggtgacacgcttggcgtggatggcgcacaagttggtgtcctcgaagagcccgacgaggtaagcctcagcggcttcctggagagcaaggacagcggacgactggaaacgcagatcggtcttgaagtcctgggcgatctcacgcacaagtctctggaaagggagcttgcggatgagaaggtcagtggacttctggtatctgcgaatttcacggagggcgacggttcccgggcggtatctgtgcggcttcttgatgcctccgctcatgggggcagacttgcgcgctgccttggaagccagctgcttgcggggggctttcccaccggtggattttctcgcggtctgcttggtgcgcgccatttcgaaaacttctccaaaaaggacaatagggggaactcctcgtagggggaaagaagttgactttcgacgatggaacgaaaaagaatgttagtgaccgcagcgaccggcggcccgcaacgtacaccttcccggcggccacacgccgaatccaaccggagcgacgaaggaagacgagccgcggtcagacgcacctttcccggaaacacgccacttccacccgtcattcccactcctcggtcggggggtggatcggcgccgctgctcgctgaattttgggctgccgtcattcgtagaggtgcgtcctgagcaactcgccactcttttcgaggagctagccgcggagtttgatcaagaaggcgagggtgtgacgccgagagcggcgtcttgaaatctcccggacggacggcggcattttgcacgcggccaactgggggga

SEQ ID NO: 3783 - DNA, 4579 bp, Toxoplasma gondii
atttctccgcgctacggccacggcattctcttggcaaatttgtgaacacagaaaagtgaaagttcggaaaaaagagagaagctgctcgccgaagaaaaagtgtatccccgcaactgcctccggctcggagtcgatgacgacttcatatatcctagcgagacgcggtgtgaatgtgcttcgtgtggctgttcctttgcatgcgtggctttgcatgcacaggatttttcccgagattggtgggggtgtgcgccagacaacgctgtttgttccagccacagttccagaggctgagaatacccttttcgcagaaacgcgacaggtcaaaaagacaggcttcctgctcgtcttttgcgattctttcagtcccgaaaccctcacggcgtcagagagtgttttgccccgcaaacagacagtttttttgacctgtgtggagaaaagtgagttcaaggcacctccgtacgtgtctgtagagagaaccacgcggcccgacactcggctagcgagcttccactagaggttcgatgaacctcttgtgcgtaacttccttctaccgcaaagaaaagcactaacctgtctgcactgtacactgccgcatacctccaagcattcgcatgtccacagatttgccagtgcatgcaccgaaaacaaggacttcacatagggtaggttgcggagccgttgtcaggggttattgtgatatgagacactcaaaaacggaggcgaacacaacgctcgcttgagtcaactcatgcagtttcttcgtcgctagactcgcacagtcagcgcgaagtcgaaactagttaacggggatcccggaactggaaaaacacccttcagttatgccgagctcagttccaatacacacctgttctgcttgaatagagaaatgatgcgcgtctgtgtgccggagaaaggccggtgttttgctgtctcttcctcgactctggatttagtttcattccctgtatccctagagtctttctcccggtcttcttgtctgcgcggtgtcgccgcaacttcacgtgtgtgcaactacttgctcttctttccttttttcgtctcgggcctcttctttgcatctctcgcgtctttccctcgaggagatgtcggggtcttcccctttaccgggagcgcagcaggcgtgggcggtagggggagaggtgggagtggaggcgcttccgaaatccgaagaagatacacgagagcatctctgccgacgcactggtcttcgaggctcttttcggggtctaggcgactgcctctgtggacgagaatcatgtcatcttcctcgacacctagtcgggtcctgatgagtctcatcaacacttgcacgcgatccgccgcaaatacctcaaacccctgagacacacagacaatcagagaaatatggaatcatccgtgactggaccagtgtgccaaagtgtatctgggaagctagcgtccaacatatatggatagacagacggacaccattactccttgtgtaatttgccactcaaacctgttggattcgagaggcactcgcagcgtgttctaagcatgcccgggcgttccagaaaagacaacataacctgggcctagggaaattgtgggtatctacccccagatatatatatatatatggataaagggggagatggcgactttctggtaaggggtaagcatgtctatgtgcttggtggtgtacggctgtattcatgcagctgcgtccaccgacagggtttagagcaacttttgagtgagacgactggcacaccgaaatgcatatctgtgcatgtgcacgctcgtacgttgggacgtgtgcggttcgcttgaactcacgtgagtttctccagtttcggctagaacgacgaagagccttgtgggcatgccgtaggttgcggtgctgatgtacacctttgtttctggctgaagcacgtaatcgtcaattttcttttccatgtcgaaaagcaccccgttgctggtcagcatcacactggggagcccgtccgcgaggccgttctgggatcccgactgtctttttcccggcaaagaaaaaattccattttcccagaggtagcggagaagcatgctgaacgtccagtcaccgtgcgcctcgatatactgccctcggtcctcggcttctcccgcgctgtcctctggattgacaatacacagcctcattcttggaaaccgaagttcttccctcaggagagagagagagggaagcaacgagagagagacgcacgccaacactcctaacccgcaagagcatagaacaactgttttgctttcttctaaaccttctcagagaaggttccccagagaattccacgaaccagcgtcgctgatgccgaggaacctatagagaagcctacagaggccctctggttttcccgagtttgtttccactaacgtcttcccttccgtcacggtgtttttctccctcctctctttcccgttcctttgatctgctctgtcagccgttggcaggttttcttcccctgcttgcgactccggcagacccacgggacccttcttggtcgctcacgataagcccccgccgtcacagagtgacttgcctgcggggagacgaaagagaaaggaagaagccaggtattggaaatttccgaagcacgttcgttgtcgcgtgcgacggcgagagctcaacacgcgcaccgatttcacatgtagagacaagatgaacttttaccagctgaagcaactctgagcgtgacgcccagccttctccgcgatgtgtaacagcgagtttgcctcgtatacgctgtctacctccgcctcttcttgagcaggtggggtaagaagaacacctcatttgccagttggcaactggcaagacgccacgctctctgtgtgcgataagagggcagcactgcgttcgtctttttgataaagttaggctcttcttcgtggctcagagggttgcagttagagagtcgtcgtcaagttcgactttggtaagtgtctgcagggagagcgctggatctgtgcagagacacttcgttttcattaagctacgtcgctggcattctttccaggaagctataaagaggcaactcttcctccacgggacaagactagtctatgttcttcgcatagggcgtcgccgtcttccaactattcacagctcgatgcaaaatctctgcagagttcttcaccaaacaaaggagaaccggacggacagccaccccatgcgcggagtgcgtgcgcacgtgaaactgccgaagtttcctcttactccagcacgcgatacgaattatcaaggaatagatgtaaagtgcacgattacaaacgcgattctgctcacacttatttgtgtatttgcttctacggaagccatttgggccgtcttttgttccggggggggggtcttgagagcgctcacagttttgactcttgtttcgcggatttctctagagttcatcggggacctcccgaggtgacgtgcgcaaaaaggagacgacgcttcatgcagaagacccaaagaaagcaaccttggagttccctttcacttctctacacggcagtacgagcctaacggatgcaaggcatactcgagactgtagtccgtgccgtggggccccgcactaagcctcgaactgcagcatttccgaagtttgtcataagcaagagattgagttggctgtctcttccccttcccttcagacaaatacacacttatccatgcggagagatttacgtattcacatgccttttttaaggattcaacggaaaagaccctcccgtgagacgtcgcgagttgaccaggaaggcagcgagtgtagctactcgtagtcaactggtgcatcgagactcgcgcatggaatacagacagacacgctcctacgtagcatttatgtgtatacagagttcttgaatcactttgtaaggtctgtgtctttgggtctcatgctctttttgaaatagttgactgcacctcgacgaaattggcgccggacggactctcccgactttgcgcaggatggcttattgaacaagtggctttttccgatccccgcgattatgcagaaacaccgcagcaaaataaaaaaacacgtggaaatgcacgttttcggaaagagggtcgtttcgttttaaactgcatttcagcgaacagcttgccatggtttgaactccgcagtgtccctgtggctttcgagggcggacaacaggcccgctgaacacgggagacgaatcgaggtcgacatgagagttcctcatgttcaccatttttttctctctgtctttcgcgagagatagcgcacaactccgaagcctttgtcgcgtattccaccgcgttctgcctctacgaggagtgctgccgcggagctaagcgcaaggcatgcgcggttctcatttgcgtcgttcgtttccgttcgggaaagcgattcgttgcgcccgtggttcttttgtggaacttcagctcctctgaatggctgaatcatacccagccatgtctagggaacctaagaagcgcgaagggaacagggcgtgcagtttcttttgtcgggtgttttcctggggcaccctcttccccgaaaagatgcgtgtttgctagttctttctcccgtctcttcaa

SEQ ID NO: 3784 - DNA, 2469 bp, Toxoplasma gondii
gctggcatgttctgtgaagagcagagttctgcccttttcttctcccgcctcctctcgcgacttcgttctcgcgctgcactctctcctcttccctacttctcccttctcctttgcccgacctctcgaagctttcttttggcacttcgagttcttttcttactctgcatgcggtgcgttgctcctcttcgtgaagctcgagtttgatagtgccagtctcgtcgccagcgagaacttccgaaaaagttgtgacttcgcctgagaggacacaaacagcgaaacaccgcttgactgtgtgcgtcttcaccttcgcaccgaggagagagaagccccccacagaggaaatcaagcagcgaaagaaactgcggaagagggagagagaagtaggagaaacaaatgcgcagtgagagacacacagagagaagggagagaagagaggacgcaggaaagagagaagaaaagagagacgaaacgagagagatgactgggagagacagacagagaaaggtgaggaaagcaaaggagcaaagcatcaaaggtgagaggaaagaacgacggtggatccgcgagctgcaaagacctccgtgtgtctcgaggctgctcgtcgcgttggcgtcttctgaaagaaagaatccccaaagagcgcaccggagaataacgttctggaactgaggaggatggtgtgcaagattctaacaacgcagttgacgcctctgtctccaggcctcaggtctgcaattttcacgaaggaagaaagagcctcctccccagccgcagacgcagcattttctctcggctggaagttctttggccacaaggagagaggaccagacgccgcagaaggaaacgctggctgaacaaacgacgaggcgacagaagacaacgcaggaggagggggacaagagagagaagaagagagagaagaagagagagaggaagagagagaagaagagagagaggaagacagagaagagaaagacgaggaggaagaagaaaaggacggggaggaagaagaaaaggacgaggaagaagaagaaaaggacgaggaggaagaagaaaaggacgaggaagaagccggggccatggcgctgttttttctgctagccggttggcgagcaacaagtgagtagaagggtgtcttctctgcagtgagcttttgttttcttcgatcgttccgaaccaggttttttcgaaacaagaaaaagatcttctgttcatgttttttcgatgtttcctcagctgtctgtcgaatctccccctatatatacgcctccagcgcaatcgaaacgcgtcgatgtttcagaaaccgacgcagtcgacgttcgtttccttctcatgaggtttccacgcgtttccgcagcctgcaagaacgggagcaggtctgcttcggctggacgcccaacggccggaagatgcgcagctcccccccgtggatggcgaaccgcatgaaaaatctctcacgcgtgtctcctctccgcgccaggctccactttcgcttttttcgaccttgcctcgctgagttgttcttcgcttttcctgtttcttcttcttgaacgaaaaagagggtgtgtgtcttcacctcccgtctttcgaggcttatcccctccttgcctgcagaagtcctttttcgcctgcaggctcctttttttgagtcctggcgcgcgtctcgtgtctctctctcactgacacagctagatcgtcgcgaagaccttctgcctcttcctctcgtccgttctgcgagcagatttctctcctttctcgcgctcagctactttttagaggttctttcgtctctctcctgtgacctctcactttccaagttctcggcctctcgacagctatccagacgagcgagcagcgcgtcggcatgtctcggtgaagggcgcttgggagacgtttgactctcggcgtcggctttttcaagctcggaaaaaagaacgcaagaggaaaaagtcttccgaacacttgcgagaagaccagaagctgttcctaaaaaacagttatttctgcgtcgtcggagaagagtgagagcagtgagagaagagagagaagagagataagaggagagagcgagaagaaggaatttttcagggatttccagtttttcaaagaccgcgccgttccggtttgtggggtcgacatcctggaggtctttcttccggtgttgaggcaggaaggaaggaaagtgagttttgtttcttgtcttcgaccttcttatttgaagaacgacgaggactaactgcttcttctatctcgtcggattctttggtgatccctcctttttcaaaaggattttcttcaccagagtcgacgctcctgcgacaagacgccgccccagtctgcatctcgctctttcctctccaccttttctttgtcacatcttctttcatctcaccgtctccgtctctctttcctcctttttccgccgtacgattggaaactttcaaacagagaagcagccggggaaagcga

SEQ ID NO: 3785 - DNA, 2035 bp, Toxoplasma gondii
catctacgccttgacatgtccacagacgaacgaccttttgcaaatctgcgcccttcatctgactgacttcaactttcctggcttagattcacatagttcgcacctcggctgtcgcgtctcccgcaactttcgcgcgtttggtcggaccctcagggtcgccgtggtttggactcgcgggggcggcccggacgtcgtcgtcgctgtcgtttccaccgtcactgctgaagttcgagagagaagaatggtcgtctgaagaagcattcacgtcgccgtctggttcatcgggcgcgggaaacgaagaagagagagcagtaggaagagacgaaggaaacggagacgacgaagagggtgtgacggaatgggcagcgtatgggtgtggaggtgacggatcgagagactcgacgcccgtcactgcagggaaagaagtggaagagggctgcagcgacatgcttgtcactggctgaagcggaagaggccgtcaaaggcacctgcgagtgactcgctttcgtgtctcacagctccttgcgcgagccgagccccggcgcgcaagacaggcgtcgagaaatcagaaagcaggacgaagcgaaatacagaagggatatgcgaaaaagagaaaggggagaagagcgacgagaaaggaaacaaaagagtaggcgaataaaacgaaggagggaagagtgacccaacacagaaaggaaaaggaagagagggggggacaaaagaggatccaattatggaatgctaagactttgggactggtcctcatttgaccttcttgggaagcatgcccacttttaagacagagacgtgtaccctcctaacagaggcagcggtctttcctctcttccttcgtctccttgcattcactagtttcctagtccttctttagtccaccttcccttctgtagttttcttctgtcgcatcctttccccgccgtctgctccctgtagcatttcatgagcgttgtatccccagaaaggcggctcggaagcacagcaacgaatcgtactaattccaccaagcgagggaagagtgaatagaaaagatgaagaagaaacgccaggtgtttcgtagaaagggagggaaggtgaaggagagagacaagacaggcacgatgcgagacacgcacactcagccgcttcctggcctgcggctcttctgtttccaatccagcgcttccagagcaagtcacctcagcagagcctcagtgcctttagccgcggaacaggaaaaataagagaaaagagaaggagaagatctggaacaaggggagggttcgtcgttccttctttgccagagaacgcgcgtttgcgtttgcaacatagactgcatgcatcctgcttgcgcgtcgccgccgggactgcacagacgaccgagagacgagtaggctcgtacggttttctcctacttcttcacagaagcgttttttcccggtggggcggttgactgcgcatttccgttttcccttcctcggcggtttttcctctgcgtcgctctttcttctccgctctctcgcttcgagtccaaccgcgggcgggaccgccaggggggactttgattttttctgggcttggcgcacgagatttcgcgttttcaatttgagtcgcgcggcgccgaagcagtccttgacaaagcgtttctgtcgacctccgttggagggtgaagaagcttttttctttccctggcccccacgagcacactccggtcttgcgtcgattctatcgcgctctgttcttttctgtggcgctctgtccccgatcgcggctgcaggggtctactcgcgacagctgctggtcgtcacgcatagatggtccacaaagcttgtagaggtccatagacagggtagcgtgctggctcactgatatgcatacatgccccgattcatggatccagtttgcatgtatatatgaacccaggtcaagtattctgagtatgcgttacacgtggattgtctcgttcggcgtcgtctgtgtctcgaaagggtatgcttcttctatgttgtttcccagcgtttcattgttttcgatcgcaaaa

SEQ ID NO: 3786 - DNA, 1842 bp, Toxoplasma gondii
accatatttgcattgcacgcttgaaacctgtcgaataaatagtggaaaccagttagtgtgtggacacggattctagacatccgaggagctgtcatacaattggggaggaaagtaaaacatcagtttcgagatgggaaaccggtcaaggctttgtgctgcgtccggttcatcttccagcgaacgctttccaccgaaactcccggcggtgtggttcctgttgacttagaactcgcacacccctcgaaaaatcttgggtttgaatgtatggatccgcacgaaatcatcttcacagtcaaggaacatgtaggaatctacacaccggaaggttctacttcgtttctttcgcgttcattcgaaacaaggacaaatggcgacctccgaaggatgtagaaatttggcaaatgagcagacagtattacgcttttttcgcgcgtgtggggtactccaaaaacggggcttagcacttgccaatgttgtaagcggcaaaaggacgcgaaaatggtgggagcagcaaagacagctaaaacgccacagcattaatattctccattaagattcatatgccgaagaaagatgcagtgtgtagaaacctgtgaagtccgtattctcatctgtaacagagagactagctttagttgttttccgacacatcctggatcacccgcgttactttgtcttctaaccgttctgtcactactggctctctccctgagctgcacgtgagctcatgctggagcttcgtatggatagggttaccctggtacactcggaaatgttctttgaacgcggctggtgtggcttcttgtccctgggtgtttcctctcctccttcgacacgtgtttttttctgctttttcctgcgccacccgctgtgcctagtatcgaaagctgtagagttgccaccctgatcttctcccttccaactctccgcttcgacacaccccccaacgacttgttgtgaagctctggcccccctgtttcggttgtgacaggctctccaggcgctcttgcactctccagtccagctggtgtcatagaaccgttatctctagagtgccacgaaagagccccctccttttattcgttgtttcccctgggtacgagctatcttgtggctttctttgcttggggatgacccttgtcgtgaccttctatgcgttctcgatgagaaaccgtcgactcttcgttgcatgcaggggtttctgcgcgaagatactctcccacagagccacagaaagtggtagccgctgttttccaacgcagcgtacgtacctagagatccttccaggaaacgctgagcctccgctgtgactgattttctgcacgttggcacgtggatatcgcgatcccctgtcccctccactgcatgcagtgtggcggtaagacgagggccatatcgatcccatggcagctgctgtgtggggtgccgccatacgtaggggtacgatttctggtcctgcccaacttcccgcctggttgattcgagcaacttacaaggacaaggcaattaaccatcttgctatttttcctgttttcgtcgtcatcggctgtcctagctctcacggctacccatcgttttcccaagcgctgtcaagtgatgccattggttacactggacaaaggccctgcaaatacgcgtgcctccatcatcgatccccctttatctactttctcgctttccgttatcccttctgtctgctttttcttttctcggctccatctcattcccctcgttccttgtagcggccccggcttctacgttccgcctgcgattcccgtattggtcacgcctccacaaggcgtattccttttttcgtcggacctttccacagggcttctaaaa

SEQ ID NO: 3787 - DNA, 2954 bp, Toxoplasma gondii
tctgcgtaagcaggtgatgtgcgtacgccaagtcgaggaaacagagcgagagacaggacctggaggtgaccagctgaagaaagacgacgcgtcaccggcggaggccggacagctgcggggacgagaagagggagagggcgacgctgcggctggcgagacgcaggcagagacagacggcggagcgtaaataaggaagggggaactgggcgttgtcatttgaaggagagactgcacgcggtcaagttcgcaggagaaagcagacgaacggagtccccaccagtggacggagagaaacgactcgcgcgtctttgttgtgggtcgagtcaaggcaccgagtcggcagtctgactcttttgcgagaagaaaccgacgcatgagctgcaatgcgaacatgagagagcaggcgcagtcaaggaaacagcgacgttggagtacgaaagcggaggtttccggcccgcagcggtgaggaagaacaggatagtggagtccgtgaggcggcactgtgtctgagagaaaaatctggttcacagacgagacagtgctaccccgcacatgtgcagactcgcggctgtatacgttcgcgtctttgccgttttttctccggaggcgaaacccagcggctttgaacggccacaggcagtggttgtgtcgtcgatttgtgagaggtcctgttctttcctcgaactttttcacacagatctccccgtcgtccccgcttctgagtgcatgcgacgcgattctttcctctcgatcttttcaggggaagaacagagtgtggagagatccacggcgtgccatcgttcacggtctcgcgtagccgctctgctccagtgaaaaaaaatgtccactggatgaagaacggcagtgaaggactccgatctgattttttaaaacgcagtccgagtccgcagcgacagaacatgtcttgtgaggacaataggagtccgcctgattcaccggaaaaccactccgctcccgggcatacgttcgcgcgtcgccagtcctcgcagttcagatgtggactcgagatcttccctttctgtgtctctatgtcttagaaaggcttcagacgacactccgcgggaagcggaaacgcctttcaagcaccgttcaccctcacagaaaagcacaccagggacgctagcttcccggcgattcagtcctttctttggggaaacacacttcagttctcgacgcccatgttctcttaaagaacgaggtgccatgcgacctaaccagtaactgaaagcggtctctcacagaacctgcagtgtccgtcgcttgccactccagagccgcttgcagacagcgacgtgtgggggattcgactttctgagaactgacgcgacatccgacttcttgtactttcagagaattctctcagtccagccttcgtcgcagttttcttcgagaaacagggaacttgaggaactaaacaaacgctttttcgagttctcagtggacacggaagtctctttcccttccacgtgcttgccatgtgtggcggcgtcttatcttaggggaagaaaacgaggttctacagctacagggtacactgtcacacattcagtgtttgagtctgcatgtcgcttaagaacgacctcgtctttgaggtgcgaaataagcgacggatactaaatgggcacctgtgaagaactcgtcttcagcacaacggttgacgcgcagcgtacggaaaccacggtattccgctgggacctgtctaactagttgttggccgctggcaaaaacgcctcctccactcgtggttcgtgtgaaacgcgttggctgttgcacagcaccttgtgcgatctgttgaactctacgcgaaaaagcgaaatcgcagtcggcctgcgacgccgacacctggaataccggcaagtcctttcaaccgtttacaaggaaagagaccgacacaggcgtgtgtccacgtttctgaaactctgtcgcgggtgtggcggctcctgcagataaaggaagcaagtaaggtttgtcggtgaagcaatcggatgtggttttcagagttgtctgctgactccccttccacacacctggaaaagatgtatttaagtgtgaggaggagagatacacagagcgatatcaacgccacagaaggcaagacacaatgcagtacagagcagcaaggagctgaaatacgcgcgggaaccgacactggtggctgttctcctgggctgacgacgagccgtgaagtcaggacagactccgaccgacggggctgatcgtgggtgcctctgaccagttgtgttctcttgtaaatacgagtggagacaggagtccagagagtatgcagtgaaaacataggcgatgtgggaaaccatcactgacgaaagtcagcagagtcgacgcagacagaaagaaggcgacggacctgattggccacaaccacccgtctcggacctgcccagctgtacgcattgatgcaagatgaatccgcatgtcagtcgggtaccacgaactgcctctcaatcagatcaactgctgtgtatcgagacgcgtattttttaggaacctgccttgtcctgtgaacagagagtctcgagagtgccccggtgcgctgctccctagtccaggctctctgcttcccggtggtcggaacattctacgaactgtttgcaggcacagcgaaagctcagcggcattccatggacagaaaggaacattactcgtgggaaagcgaaaaaagcgaaatcgagaacacttgtttctgtcagtgcccgcgagcccctgatcctcgagggtttagtgcacttaacatcgcagttctgcctgaagatttcccgcactgcagagaggggattttaaaagagaagctggcagcgaagggctggcaaagtctgtagaagcagaaacgtctctgtttttgccagaccaattccgaaagatccagttcttgaatgcttttccgctatcggcaagtgcctctctctcggctcttg

SEQ ID NO: 3788 - DNA, 3759 bp, Toxoplasma gondii
ggaaacagaagataatgtggatccgaacgaacaggagaggagacaggcgtgaggggaggagaaagaacatgtgagagaagacgtcatacacgcgagtgcggggacaaagagatctcatcgtaaaggtggcacttgcgtgcccctgtgaaaaccgaaagagttacaacggtatgcccccgaatgcagcggtcgctgcaagtcgtcttggacctttcagcagcgcctctagatgaggcagagaaaatggtaaagaacgtagcggcagacaaaaggaagctttgggaagggttgggggaggggggcggtaaattaattctcggacggtgacagaaaaataaagacgagggtcccttgaaaataataaaaagcaaagcgatgtgtcacacaggaagcaaggcaaatggcaagcctaccacagatccgtctcgccatcgctactgttatctgcctctctcaatttgcttccatgcctagaacagcacacccttcaatcaaccgatcagtagcattacgaattagaaccaccaagctagtgtcttcgaacctagtagccgatgttgaaagcagtgtcacgcaaatcggtggtttgctagtatctgcgtcatccttgattcatctgcgcgtttgttgtcagccagaccttgtgctgccgaacttcttaaaaagaaatgaagtaacgaagactgatgaagcttcaacagacagagtgtgagggagatgagcagagaactgcccgcccctcatccgaagagtgcacctctcctcccgtgaattctttacgttttgtgattcaagagaagaatgaggtttagagtcagcatgcggtgtggaagacttacccaccgttgtctagcatggaaggttagacctaaatggggcgttacacggagatatttcctcacaagttggagaagaacggttcacatggttctcgcatttatctttctagcagaagggttcaaagaggctcaaaaggaaaatgcctcaccgtcgctctcaaggtgaagcggcctctttggcggttctcagacaggcacggagcgaaagatccaatgtccaagggagacagattcgctctcccgctgcaattctccgcttcgtagattacgcagcatgtccacatatggggggaaaacatgtttgtacgtcacgttacaaacgttttaaagaagactcaacgaatcgcagagggtttgtttttcgcagtccctagacgtggcaagcatgccccaatttgcgctcaacccgcaaaagacactttgggtcgatgcggaaggagttcgagacccgaaccagcgctacgacaagcaaggattttttgagatgcgcgtataaataaaaagttgcagaagaggtcgcgaaagccggacaaccagatagagttcggtggtgacgagcactacagctgcgcagagggcagctagagaaatactgcgcgcgtcattcacgcgaaaaaaaccaggggcaccgtggaagagcgaaggtggttcgaaagatcgaacggttgaacattcgggaatctgaatggagatgtctctgcctttttggggccagccggccgctcaacatgccaggaaaagacagtcgaatgaacaacgacgcatggctcgctcaccatatagttagcagagaccttatgcacggtgaggcggtgttgttgctgctctgtcgctccaggtagaatttggaggtgtgccagacgaataggccagaacgccatagaaaaggagggtaacgagctgcgcaaccagttcgaggggctctttcacggtcccttacagccctgtcgagagatcagagctctgacagcatttatctgaactcgacagtcgattcagaaaccgaaaccgaccgtgttggggaggagtgccgaaacgggtatgcgggaccaagaaggctgttcaaagacgaagtttgttcggccggcagctacgctgcgatccctggagcttctgtaccatcgtcaggcttctacgctgtttgttgccactctcacgtccccctgttccttttctgattgccacatcattcggggtaatgtcgttaaaccagtcttcagcgaaacgtggaagggtgaagtgggcatgcaccgggtctcttgttttttgagtcagttggaatgggcaatttcacatcctccgatcgttttctgggaagattccccttgttctacggccgcagggatcctggaagactagcgaactacgtagcccattgcactgatcagcctgccgttctgttcatgtcttctgctgcagcggcaggtagcgaatcgtttcttttcattactgagtgatctgggagtgctgcagtagagtccctgttaaataagtagagactcccttactgcattgttaccaaaccccgtcgcatgtctgcgataggagcccgtcgtgcattgcgtctcccatgatcagctgtacgtctgccgatacacagtactcgtacgcattggcaacgtcttccgagactctatatatccagtagtcttcgtgtttctgcgctacatgctgccacagatcgccacgtttctaagggacagcttctgtatggaatcgacacgcttgccagaagacggtagtttagtggctggtcgcgcaaaacacgagacatgccatcggtattgcccgaacgtaagtacaggctaagaaaacaacacaagcgctcgtgttacatcaaggtggggggaagccccgagctaaatagatacaagtatcatgacaagcttttggtgttttctccattggtccccaacgacccaatcgcgtcgttcgtctcatctggacacagctgttaaaagccggctcatttcacagaacgactggctgagtattggagacagaatacatcattctgtgcttctgtaggtcggcgtgcattagcaagccgtttcttctacgcaagtcacaaatttcgcaaagagacacaaactcaacagttttgtagcttggggtcgcgtcgccgaaatattcgcgtttcgctgtgcgagaaagcccgaacactaggatatcgcccgttgccacaagtagagactcggcgcgaatcccagaagtggattcctatccacaagacatatggctttctatctggtccaggggtacagcaatgcacagtttttcggcgtgacccttcatatagtcacgtgttcctctggccgctacaccggtcagacacaaagagggacaccgtagatcagaattgtgacgcatcaacgcagcgccacggctgacgctcgcaccacccgattcccgtctctgaccccattagtcggtgtgacggtgatcctcaatggtcagtcgccaccaaaatccttccttttccaggagacgtagaggagtcacagattcgttcctgctgcagtgatctttgaagatatgtaccccgtcgagacataatggacgaagccgacgtccattcttcctgcgtcctggttgaccgctgtcgctgtctcgtgggaattgccccacggcgttttgttatagaagtcgatattcggtagcctcgtgtcgagtctacggttccccgctcagtcggcggccaatagaaacacaaagaacaaccaaaaggcccttcaaaagggaaggaagaaaccatcacagatagtcttctctgcttctccgttccttgctgctttctacattctgtcggagtgggcagtttctcctcttgtctggcgcctcccctgcatctcttccaccactgtggagcgcattgttctaaccgcgatatttttatattccgatgtgggcaaggcaccta

SEQ ID NO: 3789 - DNA, 1909 bp, Toxoplasma gondii
gactgtacgtctggaaatagggcggaaagccttgaaggagatgagagaagcgtacccctgccgcctttttcgagagagagaggcagcgaagaatcgaactcaggaaaaagagacgtcctcgccacaccgaactctcgagagcctctgcttcgggtgtcactccacgagcgcgaaactggtaatgcctctgcgacaagcaacgaagagaacggagaggagaaaagagaagaggagaagaacgaagaggaggaagaagcacgagagaagaaaggcgacgagaagagagaagaggacgaggagcaagatgacggagacggagcggacgataaggaaagagtgaagaaaggaaaagccgagaaggaaaatacaaggagcgcgcagaagagacagatatgcgacctgtgcgatgacctgtctctgccaaaacatttgttccttgtgcatccgcgcgagaggtacagaaggggaaacgatgagaagcgaagcaggtagaggaaacagaagaggaagaagatgaagaggaagaagatgaagaggaagaagaggaagacgaagaagacgcaaaggaggaaggagaggggacctgagggtgtcctgttgaagaggattacaaggcgcatgtctttcgcatggaggaaacgcgggagagaagaaactgcagagagggggagggtgtgaggagagggaccgagacaagaagagagacagaaggaggagaggagagaagagaagatcttcatgacctcactctaggaccgacttgaccatgattgtccctccggctcctacgtttgtcgctgttgaagcatgcacataaaaaagaaaaaccaatctgaacactgaggagtggatacgagcaaacacaagaccatacggatatttttgggtgtgtcggaggcagatgtcgagacttctatgcacatacattgccctctattccttctcttcgtcactctattccttctcttcgtcactcttctgtttctcttttctcttcacgcttccttctgcgctcttttttctcctcttctctctgttctcggagcctcttgccgtgtctcgctgccctagcgttgcgtgctggacctctcgctgcgaaaaggttccctctttttctcgcgctgtctctcttttctctttgcctgcctagagagaattgggcggctcgatcgcctgggcgatcctcgtgcgacaggcgaacggatccggtcggcgccttcattttttgattcctcagagaggcttgtggcagagggcctctgcatgggagatcgcggtgctttctctctgcgtctgctgaggagacacacatgacgcggaaaggcttcgcatgtcttcgactgcacttcacacagaggtttcgtcaaagagaaagccgcgacgaggagacaacactcgcgttgtcccgagttctcttttttcgtctcttttctctgcttcccctctctctctgtcgtctctccttgcgagagacgtcacggctgctctcgctgcctcgctttttcactgcagtcgcgaggctgtcacgacgcaagagctctgagaaacaaagaacaggaaaaggagtccgcgagtcactcgtccgtttccctttcatcttctgcgcgatttgtctcttcaggactcgctgcaccttccttctcccttctcgcagttgccttagtgtcgagaggaaatcacctcacgtcgaaagagaggctgtcagcagagcagcagaattcgctcgtcgtgtctccccttcggtctccttcctcgttgtttctgtgccgcggtttcttcgctttttttatcttcccttcgccgctggcttcctcttcaacatgtttcctgcggagaggagacaacggccgggacctctgctcaaatcgcagtctcgcttgcttccgctgcgtttgttcgttggagataa

SEQ ID NO: 3790 - DNA, 1556 bp, Toxoplasma gondii
actaacggtactgggaaataggagatcgcgttagttcttgggaaaacgacttccgaaccaccaatgtacagattggtacaaagaagttaccatatcctctccgtacaaagccggcattaagaacataaagatcatagctagaccatgtattgtaattatcacgttataagtagatattgtctctgtacaaatgatcagcgaaccagaactgtataactcaaatcgaaaagtctgacttcagcgttcacgtctcggtctcaggagcgcgagactggacgggaacgacaaaaatggtaagaaacgacaggtcttgaccaacgttcttctcctccaaaaactcgagacccagagagccggactgcccacctgttctgtgatctctgttcgactcagaccatgttttcagttcaactcgcgaggctcacactgggagagggggggggggcgcgcgtgcgcctgaggcttgcgcattcactggtctgcgtttttcgttctttttctcgcgtttcgcaggaaaaagcgaagcgtcccttcgcgtgacaaacggagtcgtcgctccggaaaaacagagcatgcgaaaaaagaaatcttctgcagtctttcttgcgaaaagttgcggtgctgtcgcttctttgtggaagcgcggcggggtcacgagggaggcgtctgcgagaagcggggatgcgttcttttcttttttccttgacaaccttcatttctctttctttcttgacgtgggaggtttcctcccaccagcaacttctcctctgccgcttcccttctctcgcttttcttccctcgctttctccctccttcctccccgccctatcccctgtctcgggtgtgctcccgcgacatcgcgttcggccagcgttcgagcctccgctgccttcgcttcgaagaacgcctttcctttcagtttgcttctcgatttcttctttcttctttgcaacgtcgcaaacgccctcctgcggagacgctcgcgcgcgcggcaactcaacagcggctcgcgactcgcgagagcacccgcggcacaaaattgacaagcggcgctccgctcgcttccgtgtctcctcaagttcttctgactgcatccgccttcttcccccgcgtcgaagggggaaatcttcttttcgccgcagtgttctcgtttccgttgcccgtccttctgccgaaagggagacgcggacgtcagttcttgctctccaacgctctctcgcctctgcacgaagaaagacgagttgaaaggaaacatgccgcagtccttgtgtcctcgggacccagtccacctataaatccactcctccactgacacagttttgcgcgcaaacgcgtactccctacataaattcataaactcaaatttatatatatatatatatatgaatatatatgaatatgcgtgtatatatatgtatatatgtttatatattatagtatatgccaacgtgttttcttctgtggactgtctggtggagtgagcgaaagatttgttggtcgggcgcgggaaacgtccggctgcgaggcgggtgcctgtcgctttttttcgagcaaga

SEQ ID NO: 3791 - DNA, 3277 bp, Toxoplasma gondii
tgctaaacgctcaaagattactggacgtgtcagctgaacatctatttgttgagacatatatgttttctggatcaagatattggcatcgatgtttgtgtgctgtattgagatggacgttccacctcttcttcgctcggcggatcttctaaagtggaacaaagttagcgttatgcgctttgtgaattttttcttatgaacagagttttttgttgttctcacgtgcaaatatgtgcacttgtacagatgcggacaagctcaccgttggacaccgtatgtcatttgcgcttgcacgagtcagtgacacaagtgtcaatagcttgtgttcgagcgggaatcgcaccactggtagtgaaaatagaccgtggcgaaagttatcgttgttaatacgaatacacaaatctgtttatagaccacagttgcccgtgatggttaagcgctggctctcgaaaaagccgtatgtagccacgcccaagacaaagcggttgctgtcgaggtcagactcagcaaagactgctgggatccgagatgttcgcacttgcggctttcccactccagttatgaaaaacacacaacaaaattctttttggctgcgatataccaccacgccacccgaccgttttcgacagctaacattggttgggttccagtttcctactgttcaaattcgctaaaaccggctgggatgcttagctgggaagtcagcgtgcaacatacacaatcatgtatccacgtagatgaaaaacgtcgatatatttagtcattttacggtttggatctccttgactccttggctgttttttgcttgctagacgcctacaagtgcaatggctggtgctatccttatggaacaacgaagtccgtggtaacctcgaaatacgttcactgtgctaacttgactagaatccctaaggaatgcacgtttgagcaaacaagtgaaataactgtacacgtacagatcatgcgagatgcctaacagtgtttgccaacgcaatttctgcgttgttattgagtttgttattgttggggagaagccggcgacagaacgtttcagcaggcgtaccttgtctttgcaagagaggaacaggaacaggctctttcggttgcaaggatgcctcgcgacaaacgccgataagcgtcaagcgtctattccgttctttagcgtcaacgtcctttacaagttcagcttagtgactgtggactaactcagaaaacgtataacgggttgtttaccgtctgacctcggttgtaaaaagtggatgagctactacatgcgtttcgggctttgcacatgtttgattcgcatgcttttagtgtttaggccagtggaaagcggtggttggtgtcagtagtcaacttagtcttattgacataccggggagagtagatgagtcctgacgtgcactacgatctggttggatgcggcaaagtgcacgtggagacaggcaaacacaagcagggctgagaaaaggcctttcatgagctaccaaataaaaacaaatcaaacactggatatttctggagttggggagggacggtaagggggaagtttggctcatcgtgacatcagattctgacgaaagcttgttcaccagagtgttccggaaactgctcggtcctcttaccattttccccgcctgggtcgtctgcaaaaacgtttgaggtatctacagtctagaaaacgctcaaagatgctttttatatctctcctcctaagtgacgggaagaagatccactttatccgttgccatctgtttctattcttcgtcgcactggactctgtgtcacgatagaagccaccatacttcgtctgaatccaaggagacagcatccgacgatcctggcttttccggtcggtttggggagtacggaaaccaaggttcgtgtcttgtctttgtccaacaggcaggctcctcctctgaaattcaagaatcacaacgagcaggattccccctgctattagaagccaataaaacggcaacctattcaaataacccattattttggttttgcctcttccctcaacaatgctaccgttcagaacttgctcgtgagtgcggagaaggaatcgggaaatggatatgccactcgtgttgacgccagaaaactgctcgctcgtaaaaaattttgaaatcgagtgaaggtaggcagaaatgtgagacggtgagagcgcttccaaacagcgatcaattgttgctctgccagtatctgttgccgttgcaatggtggtgacatgcggtttgtggttggtgatcggtggggggggcccgaagaaaaatgagaaaaatagagacgagaaaagggacttgaatccgttgttgtaaatgagcaacactagaatccgcaaatgagagaccagagtgaggcaatcttggtattcacctgtatcttcccctggagacatcatccttacataaaccagaaggaaaggcttgcaagtgatcagcgtgtgacgagccctaaagacgtgtggtcgattgacatccgttatgcttctccttttttcccggcttaaatgagaggcgacattgcaaaaaggtatccgaaacccgacagaatacccgcaagcgaacaggcgcttggtgatcgggatcccaaacaggcgagaaacagtagaccaagcgaaaaagggaacgttgcaaatagtgttctgaccagaacgaataccaacaccgatcccccacaacgagctcttttcttcttgcacgtatttccttgacaagacgtccactgttttaaagggaaggcttatctcgataggggtggaatcacttcgggcactgcggttctgtgtgtatgcgaaagcgactgttatagcgcgcagacagagtctaaaagtaatgcgcatgagaccataactcttttgttgctggaaactttgaactggaattcccaagcgtcttgggtgtgaagcacaaaccgaggtctccgtaccgatctacgatgtagcgatccttttattaactgacactcacaaaacacacgaaacatgttcacagatcttccttagacgggaaggcactgcgagacaccaaccatctgtccgagaagagagcagaacccgtgaaacgaccgaatgacgacgcgactgcacccctgatggaatccttccagtggaaggttgcttatgtctcgtagccagaaaccccgtttaccccatgttcatcttgtctgaaaaacactggcaatctttcacttcctacgcgcttcttttctctcgaagaagctgccccctataccggcagacgtgtttttccaattccagccatctttttggcga

SEQ ID NO: 3792 - DNA, 3127 bp, Toxoplasma gondii
catgcgtagtatcggtcatccactattctatttcaaccgtgataacgtgttagttctcgttgtcctcaatctgtgtgaattcgacctacgtgttatcaagggcgaaaacatcacactggagtgcggatccatcatttgaagaacaaacgaacatgaacgcatcgttgtggctcttgatgggcagagatacttctttttcgtctatttccgacgagtcttcaccagaaaagttcttcagaaagcactttcccgctttgtctgacggcacgccgtcaatgtccttggaataacacatgatcgacgcaagatggcttcggcttgtgtccccgcctgtcttcgttggcctcgtgacatagaactcgagaacgccattatcccatcctgcaccagtcactttgaccatttgattcggggtcatcaccccctgaacatgaacagagttacatggcacctcgacgagctcgaggactgcagaaacataacacagttacgacatcggttagactttcctaattgtacaatccagccattatccgaatcgttatgcatgccaactgacacgcccttcgtatgcatataattgaagaaaccgcgagtctttacgtcacagtactgtacacaggatgtaagaacccacctcctgggcgggatcagggacactcggggcatcattgcttcccatgagtctcgtgatacacagaacagtgctaacgagaaaagcactctggcgtccttgcaaagtaatctgttgtcacggctcaagcagcagtcttcaacacacagccaacaagacgcttcaggcgcaccagacggtatcacgcttttaaaacggtctgccatactaaccaccgcgtcatccatcgcgcgatctgctcagaggatgacgtaggatcgcacatacaaactctacaaaaaatttggtgttcattttgtccaacacctgacacagtcagggtaaaagaagaagcgagcgaaagctgcgatagtcggcccacactaatctaaaatgcatcccccaaattccggttttcgccaacgaggctcaacctcgactcacatgtgctgagctgagctagggccaccggttcgttgacaaggacactgggctgcgccgccggatttccaactgcaaacacacagacacacaacaagcacggaacaaaagcgtattcccgatgaagatctatatatggtttacggatttacccttaggcgctccaacgtccccgcttgtcttgagacgcacccatccacgacgccagcagttccttccataccgcccgcccagaacgtctggcgccaatctcgaaaatcatgaatactatggattccgttactgacggaacgcccaagtctacgaaagaaacgcggacgtacctttccttgcattgacaactgctggaaaaaaagcagccgcgaaggcagcactggacacggcagcgagtttcatgttgggagagtgacgtgagttgtgcgtaaaaaaaaaacaatccacccaccaggtctcgagactagagggagggcgcgaaaccaaatttcggaagtactaaaactgtcttcaatgtgacgagctttacccagctgcgtcacaaatccatggactggaattgcgtctcttaaccgacggtgtgctcacacttggacaaccgtgtactggcgtatacacgcgcaccagaaaagcgtcgatagcgggtgaaatggaatgcgacgagttgacgagataagcgacgcaccgaggctctgtcggcaatactaggtattagaactggccaggtggactgagcaaaacatcgacgggatcggacaaaacctgtacaaaaacctcccacaagcttcggtgatctaggtacgccagccgcagccactactcccgaaacgacttctaggtcctgtgctaccaaaaaagatagcgacgcgccgtaactatgtcggaaatattagtttttgtatccgggcatatgtgccatgcaaagtaactgcatcggacgagtagctctgtacagaacgcccccgtacgcaactgtgatgattgctctgaggcacggcagccacagccactgctcccgaaacggcttgtttttttgtaggacctgtgctaccaacaaagcaagcgccgtaactttgtcggaaatagtggttattagattcggcatatgcgccatgcaaagtaactgcatcggacgaatagctctgtacagaacccccccgtacgcaactgtgatgattgaggcacggcagccacagccactgctcccgaaacggcttgtttttttgtaggacctgtgctaccaacaaggcaagcgccgtaactttgtcggaaatagtggttattagattcggcatatgcgccatgcaaagtaactgcatcggacgaatagctctgtacagaactcccccgtacgcaactctgacgattgatctgaggcacggcagccacagccactgctcccgaaacggcttgttttttttaggacctgtgctaccaacaaggcaagcgacaagccgaaactttgtcggctacagtagaattaacatcgctgggctgatggaccaagcgagatttgattggatcgaagagatcagtacagaacctacgctagcgtcgatgcgctgagctgcgccaatcacacactgctcgaagcggcttgccgaaaccgtcctttcacccacctccttggaagcaacacgaggggggtgggcgtgtgagccttgatgagaaaagcgctgtctcgcggggaacgctgcgaaaacagcagctttggttgtcgcatgcgacgaagcgcaatacagcgaaacggatcccgctttttggttgcatgcctgacttttctggcaggcaagagaaagctgattctgcgctgatttgcatagttggtgtgcacagttgctgttagtgtctccagagcttcttgtctccgggagtcttctgctggtcgcttgtctgtatttcgcgcttcccagtacagcgtttagatacagtcagagtttttcagtggtttcgccgtgcacctgctgtgtcgctctgttccacggggccagtacactcgtccggctctctctgtgactctcccacttttgctttttctgttatttgctggtaccatccccgtcgccccgtttgccacca

SEQ ID NO: 3793 - DNA, 2050 bp, Toxoplasma gondii
acctaaagagaaagcgccgtcaagcaaaggtctttctgcgagatacaaaaagtcgccgaatccgccacacgaaatgcgtgcatgcagacgcagctcgggtgtacgtatgccgaggttttcgagcgacgtagcgccgaaggagcctttcctgagttcattggggggacgacgacagaggaactctctctgctggactttcttgcagaaggtggagagtgttgagaatattcgtgttggttttcgtcagtatatatgctggaattcgttagcgtcgagaagtctcacactgaaacagatgcgcggtcgcatgcgttgaagatgcctgggcgctctcacaagactggcagagatgcgttaaaacgtctggaaaagttcttgtgggtcccgccgcatctcgcgaacaaagcagagctcgccgtcgactccacgccctcgtggcagatgcaaaattcaggtatttcctcaagagacgatttcgttgacacggcgcggagaacggcagccatgtgacaactggacaggtcccgggagtttgttttctgagcctcttgtcgcttggatccgagggataaacttcacgttcgccactcctggcgaagggcttgtctgtgtgtagtggtgcaagttctccagtgtccattcgagtcattttgagtccgtttttttataagcgcgatgaggcgcgttgtttttctcacggaagacttcgcaacacacggtggaagtgacttgctcttagacaggagtcagtatagaatttctcactttaccagagagactgctcccattttcgtttacctatactccttgctgatccgcctccagttctttgctgtttcccctgagtcggcaccacgcgtgagtttccttccgacacgaaggggagagagtcgcgggcctctgagcaaacgcatgaacgtttctccccctggctgggtgccttcggagaagttctgaaaggttggtgcaggcgcgcttttcacgagcgcctcaagaatccccttccactgcggagacactgagtggtactgggctacggcagaaagctcttggaactcacactacgagatcagaggactccgaaccagctcgtttctacggagagcagacggtgtttcttcgcactgccctagactctcgtggtgctcaacgttcgtgtctgaagcgtgacttgccccgcaaggctgttcgtcagcttcgtcgccttagattggaaacgagaaagagattgagaagccgcttttaccgctagcttgtgttgccagttctttgtttcactcgctcttcgaattcgtgtggcgcctcctgtctcggcaatgaagcgaatgcggtgttcgcgaacgaaaaaccgctcctcgcttctgagacagttcgacgccagtcaaacttgttcgacctctttcgggtgttggggcaccccgcaaacgcgtccgacggtcgactggttttccttttctacgtggaagccaggcttctcttcttcgcttcttttcttccgacatacacttggcaagtggcgaagcgcatttcgcgtttttggggaagcggagaatggcctgcagttcatgagtttccccggctgaggatcgagtgtctccgctcggatggcggtgccgtttcaacgctgggtcgcggtctacggtgatcagcctccaagcatgttaccaacaacttcgtccacctgccagcgaatcgacctagatttcctttctcgcttgtctctcacactacgttgcatgtttcctagcgtcttcttattttcgtccaccttctttgccgtcaccgcttctttctttttttgccttgtgtttgtgtccttcttcctttttctccgtcctcctcttccttccctcctcctttctcttctttctccgtctgcccaggcgctcccgccttccttctttgaacctctcctctgccgattctccctactcttcttctcctcgttccctccgctcctgtcctgggctgatggccaaatggtacagcgggaggaggtgtgagggtcctcggcggcgcagagtggcttttccgacggctgcgtctccga

SEQ ID NO: 3794 - DNA, 2498 bp, Toxoplasma gondii
gtcgtcgcggtcagtcctaaacgacacggttccggaatgattgacgccgaagtggaggggcctaccgtgcaaggaaaggctgcaggaaacttccgacaggcgcgtcagcatttgaccaacagtcgtgtgagtgttgtatctcgggaaaaggcagctgagcccgtcttgtcggagggagattcgcggagtgcacatgctgtcagcaatgtgaaagaggcgaacggaaggggtctacgtggagaagaggctgagctgcgactagataagcagaaacttgctgcaaaatgggctgattccgaacaccacgtaggcaggcttgtggacacgggaggaaatgtgtctcacgaagcagcgacaacttccgtggggagaagtggtaaggaggatgtggtgggcagccgagctgttgagcgacgaagacagagtggcggcgagaagttcgaggagtcatgccgggacgcagtaggtaccaccgctgtagccactgggatctcttctagttcggatcgcttgcgacagaaagggaggcccccaggcctagcgggcaatgccagtggcgctacacctcacggtgcagagcgtgaagtacctagcacgagcagcatggagaaaatggcggggaatcgcagaacaaattgcgtggacagatctccgacccgacgtgttggagaagcaggtcggtcgttctctcaaattgttcgaagtgaaaatcaagacgcagtggtaggacagatcgcgttgggtagcggtcattccagcgcaatggttagtaatgaaagacgcaaaagcttgcgcaaggagagtggcgaagtggcagtaggaagtgtggatgaggtagagcagagacttctgcgacttcagcatgaaaagcggcagctgagaacgaaacttctgacttaccaagcgaacttcatttcagagacgggaagacacgttcgcctctacaaagacattgctcccatcgagagggagtacagaagatacaaagatgtgaaacaagaaatttcgagacttcttgaaaggcagacgagtcgcctttcaactccgtcccacaccactctctgtcagcgcggacctgatgatgacaccataccgtcggaagtgttcgaccaaacccggcatgagttctgtgtgtaacgaaaggaacacgacaggacgtgtatgcatgaaactttttcttcgggtgcagaacctataggaagggataaaactcctctccttttcaagagaataagttcagtcgagaaattgtcgatagaaatgcggctcgtgtccgtcagatgctgtataggcacccagaataactgccgggaacgtaccgttcataggagcttcgtgaagtagtcgttgtgacgtcgctgatacatctattaccgtaatcactcttccaatggccagcgaggcgcatgtggagttcggttgttgtccatccaacactaccggctaatcatggacttcggtgaaagtattcgttattgtctcctttacggaaaagcacacacgacttggttcttgctcactgttgtcgttctttccccgaaatggcacacatgcgcggtggcacttacatgtgtgcagtgggtagagcactctgtacgaattggagtacctagagtatattcatgtcaggttacggcaaggaaaaccattttcagacgggtacacaaggggactctagcacacgtccgccccactatggcacataagcggtcacaggaaaacatctcaagcattcgttgcttgaaagggcagctctctccgatcacatggtggtgtcacagtggcgtgttttctatagagaatgcccatggaggagccgccgtggtttgtaccgttccgcgtcgagtgggacgaagacgtgccgtggacagggtttccgcgcgtgcgacttattcagtctcactgaaggtcaaatcagagcgaatatcggcacccatctgcgtggtggggatactgcagcaaccaaatgtattttccgccgcatcatgtggaatgcggcaccgtgttcatagcaatcgatccgccaaccggcaaaaagaattcgatgtgtgtactggaagagaaacgctttggctagctagagacatgcaagttgcgaccagccagaacgcacgtggcagatcgaaccttgtgttaggcgggcaagacaaaaaattccgagcgctgcagggtatctggcatttcagtaatagagtccgcctagtcacaacagactttgacaaccaatgccgtcacccccctttttgcttctgtcaatcgtaaatgtcaacatggtttgttgtcgcgatctgaattgggaatttacacgagactcgatggtaactgtcaccgctgctatgcgaaggcacccagttctttgttgatatatgggggtgaccgctttcgttttttttatgtgtggttgccgggtagtaccttgccgtggactaaagtgatacgcaacccatcatggcccaacaactccattttcacaaggtacccaccatgcctcattacca

SEQ ID NO: 3795 - DNA, 2180 bp, Toxoplasma gondii
aaaacacgtattgacgttttcacaggaagcattgtcatcggatgcgtcggcgcaacgtgctcccggtagaccgaacacgctgcttgttctgttgtttgtgtgtttgcctcgtgcagcatttcccactgccgctggaggaaaatctggtcatttatgaaaccctgcatcatcttttgcatatctctagcggagttcgccgtgcataagatccggacactgacccatcgaaactgtttagttcacagtcacgggtgtcacgccacctcttctttgaggcgaatgcgtggagacgcgtgtatgattcgatggacttgtgaaaatttcttttcttcactttgtttttcgccccgtacaacgctgcgaagcttccgtagatctcaacggtagtaggagactacaaccgctgcaaggtagcatacagaaaaacaaatgtaacaggatcccatggccgacttgaggacacgccgcttccaccacgttgggaacgaaagacttttcttactgaggtggtacgcgggcttagtttctatctccacaccagataccaaaggctttttccagaccgattttcagcatgtgcacctaaaaacacatagtgtgcttcaagttcaaagttggcgcgtgggtgtacacactagggagagatcataacttccggctgtttggcagcggtgaaactcctatcctatggatgccaattcggtagatggacttgttgtaatcggtaggtcgttttcccatcgccttgacgattgtcgctttctgcacacgaacagctacacgatggcggtaccgtggttaagggaattgcagttacggttttccgcaggatacaagttaggatgaatcgtctcgcagcaaaggtgaagcttttaattatcagtctcgtctgcgcacccgagtttctacagaaacacggtgacgtcaggtgctgcgatacgaagagcgacacgattcaccattcagctgacgctggcttacagggaggctgtgtcgccaaagcaacgttacatgatcagaccgtcccccacgggaggggagccctccaaaactgtatcgctttcttcgttggttgaaatgtaagagttattttcggtattccattctcgagaggttgcttagttgtatcggtaccatagtcttccgcgcacgcataggaggctagatccggtagaacggaaatgtcgggcgtctagtgtgctgtccttaccgcctagtgcccgatgacggggtgtttcgtggtcaccatggcatttctctagtggcactccgaagacacatggagaacccgtatcaaaaatgaaatagtactgccaggaccatctttctcagtcaaatatcaccgtcatttaactgcttccacgacatagactggtcgtgagctcttggcgctggctcgagcgaggccgcagtgcagacttcgtgttcagtggcatctccattacgtggacgacacagacggtgccggctgcgagcaaagtcgctaagtgaagagaacctcactcgtttttaatcatcaacgggtgttctggtgtggtgctgcactggagaggaagtctcactcgcgaacatttttttgcgccagcctccaggagacagcggtttcgaaccgagtgccccataggcctggcaaagctttcccctgttccacaggctacgcacatagacaaacgagtagaggcaccctttaactctaggtaacgcttctgaacaagccgcccatttcgataagcttgctagttcgtacggtgctacgaatgtcggctgcatgcacgcggtggacagtctcaagtgaggggagacagcccccatttggcttgctgccttgcgagacgattctccctgagcgcaagcgaaaaaaaacgacgaagacacattgtcttttccgggattgacacaggtcaggctgcaggaggtcctttgatgattggaagcagaattatcaccttcacacgtttctgctggccttctacaccgtttattcctccttgggtcccgacttttttttcctctgttacgagcacgcaagcgctgtctacgcgcgctcactggcttattggtggagcctccttttgttttccgagttccgaagggtaacggagtttcttttgtcatcctgtggtgtaggaaactgccctgcgataagtcccagctgcttcgcttcaattttaagggggtca

SEQ ID NO: 3796 - DNA, 3747 bp, Toxoplasma gondii
agaagatggagaagggatggtttcagcgcgaggttccggtttcgcggcgacggaacacaaaggggcttcacccctctccttcttcagaggcaccgagggaagtcggggggcggcggggacgcggagagcgacctggccggcctcgagcagtgtctgtacaccccagacgctgcagccctgtctgtcttcgtcgccagctttggtcaacgccttgaggcctgccacgttccagcgaggatctgccgtgaggggcgcgccgacgtgtgcgaggaagtttttctcgactcggtggaaggcgacgttgttgaagaacttcgccttcgagagcttcagaaagttgtagctcgagaaaggcgcgtcttcggtgaggagatcaatcacgatctcccccacagtcgtctgcagaagaaccgccatggccaacgctgtgtggagctcctcgttttctcgagagatttatgttcggagcccctttcgtcggggaggcgaggcaggggagtccgaaaggaaagaaaacggcgcgacggacgagagcaacaccgagaagacgcgctgacgaaaaatacacgcacacttcaaagctgcggcgggaagacccgaggcgccacgccgagaacctggaaaagaaaaccgtgggaagcaggctacgccgcggtgtacatacacccgccaggcactcgagcggcaccggtggggtctttcttgggggggggaggaaacgaggaaagtcgacgagaaaacaaacgcgaagaagagaaaacacggaagacgagaagagggaagcggtaaagcgaaaagaataggcagaaagaacagagaaagcacaccgagaccgccacacgtgagtctctgcgtcagctcgtggcagacacacaggtgaaaacctcaaaatgaacaccacgactccaggtgtacatacacctgagaagatagggaacgacgaagagtctcgtgacgcctgagagttcgcgtttacgatgagaaggggaaaagcttcgttagtctcctcctctgcacagtttcgccttcgtgcgaatgtctggacaggagggtgagccgctttcgactgaacagcgcagtgacccaggcgccacgcgccgcaacctggtcaaaggaattccttttttcagtgtgtcgaggaaacaaaagagcaagagggcgaggagggagaagaggaaaaaagaggaatgccggagagtccgctcagcaaagagaggtatgtggacaaacagaaaaggatagagggaaggagacctgcgtttttttgacataaatgcttctcgcgaccccttcctcagagtctcaaaagaagaaaaaagcatgctggctgcatctgccgcctcgaggcgatcgaccctctctacaggcggtttcgctttcctcctctgtgtccactctcgcttcccgtgctccggacgcggcgtagaaaaacgcatctgattcctttctgcttttctttcaaaggaacatttccagtgtcgccatatcgcgaccctattattctctcctctgttctcttctcgccgcgcctttcttcttttcggcaacttcagaacgctgcatgcgtttccgcgtggacggtccgcgcgggcgagcacttgcttttcactcgttaaagcagaaaccggaaacccaggcgaaaacctgagcctctctgcgtttcaagaaatcgcttctccagaaacgcggcaaggaacgccaaagctccttcctccttccacacaagtcccaagatacaccctcacccttctcgcacacggtacatctgcgataggtgtgcataggtcgaagatacatatatatatatatatatatatatatatacatgtgcattggtagataggaatatgcatgtatatagacagaaagattcatcgtataggtgtctctgcaatgtccataaaacatgtgtgatttcatttatgtatatatgcctgtctctctatagatatgtatatattgattaactgtgttccttgtctcgctctctcgctctatagactttgtttttcagtgttcctctgcttttgttcttgttgcttgcgtcgagcagcctggaagacttcagctggtggtttgggagaagaagagtgaatcgttactttacctcttggtctgtcgagagctgcaagtctggggaccggcagaaactccagtccggggaagttgatcgtcacagaagccactgctagattattttcgtcgatttttttgctccgtccaattcagatactcattgaagaaacgctttcacttatcaggctgatggcaatggcaagttctctcgaatctagtgacagtttcttcaccggacggccctctccagaaaaaaaaagcagagagaaaaagataccctcgagaactgaaaaacgggctgcgttcatgcacatagccagatgaaagtagtatatctatatctatatatataatatatatatatatatgtatatggtcatgtagctggtgagtggaagtatagtgcattgtttcatcgtggaggttgctcaggacctcctttcaaaatgcgcatggaagccgacaattcgacctatataggtctgcacgaccgactgtacatatatatatatatatacatatatatatatataaatgtacatatatatatatacacatatatatatatatataaatgatatatatatatatatatatatataaatgcacatatgtatatatatatatatatattaattcctttatgtatgtgtggagatatatacaaaacgaaggagtaaaatggggccttgcgtaggtgagtaggcggggatgggggggcggtatcttccgttagtctccatacactgacgtatgctgcagattaccttgtttctctcagagtcacgcggcacaagaggctcgtcgagaaagagagagagattgaggaagaagcccacttgagagttttattgtccgttatcagtggaaagagaagagagaaaaaggtttctagagctgcgtttctccaattatttttttgcgtcttgcttgcagacaacctcggctcactctctgcgactcttcgcttgctcatcggctgacagcggacgtcgtcccctttttttcgtcctccctttttgttttttttccttcgatccgaggacgcctttcgttccgcccacctgtggcggcatttgttcttctcacttccggatttctggtttttttcgcgacttttctcctcttttcgcggcgaactttcgactgcgtctccctcagcagcctctgtctctcgtcgagcttgtcgcaggaaggaagagatttcaggtttcagagaacgagaaacagagcaaacttttctcgactgcggctttatttcaaacctttttcgtcgcgtggttttccgtgactttttttcgagacaaagaagacctgttcttgcggagctccactgttcggacgtctcgtgctcggcgcctccgtcacgcgctctcgttttcttcttcgttccccgttccttcttctcttccacgttctcgagttgtcttcttctccttcttccgccgctctttgccaccgatcttgcccgtgaggtctcgcgaagatgcggctgaagacttgaaaagaaactcggagagagaacggagagagaagaagacaagagagcaggcgagaggagcggaagaaggaggacggagagagaggaacgcggacgaaggagcgaggagaaaaggagaactagagagggaggggagaacaaggaaaagaagaagacgaactccaggacga

SEQ ID NO: 3797 - DNA, 4749 bp, Toxoplasma gondii
aaaagagatgtatcgcggcacaaacagagcacatccttacgctcagagaatctgcgtcagacgaacacaccagtttgcacgaaatcatgccgatcccctaatcacgcgaagatcccgcttggaagagtggtccccggcaaaaagatgtgccacatggacagaaagcacccaatcccacagcatacagtttccattttcgcaggccgttagtctgagaaatgtgatacaggccaaatgcgcttacgcgatgtgactcgagaagcaccgagaaagaacgaatgattggatcctgcgccgtcgcattcgcactggacagctgagaaagacaccatgttgctgctcccgttgtcaagacatcttcttcctcttcagatgtagaaggatctgctggattctctagagctggttcctcaaattctgcgacatcctccgtttccatgttactcccaaacaccacctgcgccatcgtctccggcctatgcctgcgtctcaggattcggtcttgtccgaaaagggctagcgcatcgttctcacaggagcatgcagttcataagagaggtcgagtctctaaaatacgctgacagaggttgccccgacaactaacgcagcttgccgaacgaagttgccgcaaacagaaaaggattctggtgccagacgcatgccacgggagcagtcacaaaatgccacaggtgtgttagcagtgaattaaaccggcagatcttgggaagacaggccagcgctctgaagaaggcgttgcaaaacatgggctgtttttgtccctggtagatcatgcaatcacgatggtcctgaatgggttcagcgtccacgtactgaagtgggaggtcacaccttcttatcgcacctccgtgtcaagggaaaaaatgtccacctcagtcccagagacggggcatgcattcatttcgtattcgtcaatgcgtgtgctgatctctgcgaaaggccgtccaggatcggctctgacaaatcgatgactagcagcccggaaccccgagcacgtgagccccgcaaacactggcacccgaaatcgaggatctgacacaaacgaaaagctatacactgcgaacgagaggaaggtgtggaaagatgcgctgcagggccaaactctggaaataccacacgagacagagcgtcaaatttcctatttgcgtctaggtcaacgcgcatgcatcgagcgcgatgctacttgtatcgtattcggatatacgccgaatcccagcaattgaacgttgaacgtcccgtctcagagcacggcggtcacagaatcgttgcagacggctcggaggccgtgccacatcatgacccatcggccctcgtaggactaggcggtttcgcccaccagaagacgggagcaaacggccccaggtaatgggttctcggtagccgaatgttgccctctattggaccatgttgtcaccgtgaaccgtacgggtttcgcgttggcgcattcagagagggcaaatacttcgcttttgctgtctcaaagagatggaaagcggcggagatccttgatcgaacaaagagcacaagaggcttcacccacacgaaaaagaagacggctaacaaaccatccgttaacacaattcatcgacggcgtgtcgtatttgcggacttcgggtctcaccccttcagcagataggtcaagtggccgagtcctgcaaagggtgtgatgtttccgacaaagaagcgaagcgactctctgtttagagcaaatacaactttcccctgaatgcatcagtgtgcaattgttccttgccatgcgagctggttaaaatggcaacggcgtccgtcggttgctttcatcgcttacacaaaggggtagcggcgcgatggacggccgcaccttcgtcaaaattctgaagacacaggtgttcttgacgggaagagtttgaccagcgtcgatgcggacctcatctttgtgaaggtgaagggaaagactgccaggaaaattgactaccctcagttcgaggatgcgctgaaactcgtggccgaaaagaaaagagcctcggccgaccaaatcgtcaccaaaatcgccgcgtgtaagttaagccacacatgcgtaggcaagtttctttcgtgggttaagtgaaagtatttcggtcgctagtcgaaacaatttgtctcaggcacaccacatcacggtccaaggactgccgcaagtgccgcaagtccagcgccttactcggttaactttctaggatgattcaaactggacaacgcctgatccgggagttaaccgcgtctctctagagtctgggccaacgtgctttctttgtatctcttttgcagctgaagggggccctattttcgttggaacgaacacggaacacgtacgcttgcacgatgacaaggacacctacaccagaattcacaaaaccggcgggcccgtgctggtggccgaaggtcgctggcagttcaacaacttgtctaacatctgtgatagaggcgaatacgacgtacgcggcgtgaagaagggagtcatgtgaaaaaacacaggaaatctcaggtaatggtttgatggcatcgaaaaggtgaaggcatgaaaattcagcagcgcgccttacggaaagacgctccgcgttgttcgtgctttgttcccgtgagcgcccaactccacttcattggaatctggtttgcctataacgcgcgagcggtggcgactgacagtaatccaactgttccctggtgtcaaggggtttctttttcgttcaccatatcatctgctactggctccgacggggacagtgtcgtagccatgaacgtcaggggacagttgcggacagaagaaggtagggaaacgtgttccttttcaatttttttcggttttttttttttgtttcgcttctttggctggcgacacgttatagcagcagatcgcttgcctgacggcagaaggtataggatgtggcggggatcaatctgtttcctgcgacgccttgtcgcctacgatctaaacaatagattgtgaatggaaacggaacccggtctgaccatcttgtgagtctactagtgtatgaattctcgagtccgttcagcgtgaagccttgattttagattttcagacttgatacacctaactgactgtccgacagacccgatgcttactagaggtattaaacgtgtcttattgacacattttcccgtttgaaaatgttggacaagaaaaatgtttcacagcgcggctattgagtgttgccgctgtagtctctccaccgttatagtttcgggttttgaaaaatacgtagatcccgtaccgaactgggtagtagacttcatgatggctggcacgcagatgcatgacatgaaggtccgagacttgctctgtcgtcctatagtaccatttcctcagtgtcggctacctatctgggtcaaacagccgtggcattgtcccaggatccccacaatcaaggaaatttcaagagtctcggacagttcacctcttgtgcaacgagcagagacgctttcctgaagccaactattcagaagctacagtatttcatatcaatgtacttgtgacatgtagtgtcactgcgaaacagatagtgtcacttacatgggcaacgcggcagaaacactgacagtacgatgctgacacagaacacatcgaccgccacggttaacggggatctcttgtccgcgatgtgacggatatcgagaaaaaaagctgaaggcatgaggaagcatagaaacgatttcagtcagctcctgttttgtgagagaccccagcgttcgcgcagggcagatagttatataagcagcggaattatgctcataggtgagctcttcactatctgtcgccagcactgcattccctctagggacccacctgtgtcctgaaaatgtcatgccccatgtccggctgatgcattgcattcctattctctgaaaccgaaactgtgacgacgcttcactggttctaagtttcatatcgtttaagcctccccagccaggaaaacgacttacacatgtactgccacagctcggtctgtgggtactgactctttcatgagtgggttgcctccgtggactctcgacgtcgccattcatctggttgaatgagtatcatttcaacagacattcgtggtagctgcaaattccactatctctcaagctacatgtgtagcgaaatagcatgtacctgatctggttcgtatagttgcatttcgtcagtcgtttcatgctgacctctgagatccttaatgcccgcctaggtcccgcacactgcagagacttcgatgcagagtcaaaactgcatgcagtttgcatgcccatgcatctcccctggtttgcaaaacgcttgaggggcccagtccttttctttcttgctgagtagcttgcaatttctcctttttccggggagatccggggagtgttgcagccaccacatgagtcgcatttcttgaaaatgctgagtgcatctgtatcgacatcgagctgccgactgcggagcgcatttcattgcccgttgtgccgctggagtaatctgtagtaacacttccttttggcatcttgtccccatgcgaagaacctagcccgtttgacttgtgtttcggcttcccgtgcggtcaggaaagggtgacgctcgcgtcgtttgttcttttatgaggctcctccattctcctcggtctcagcgctcgaaagcgagaccagcggcaaaatactcaacaccttagtcgtttgtgtagttttgtttattgtttgctttcgaactgctcgaacattcttcagaggaaa

SEQ ID NO: 3798 - DNA, 3428 bp, Toxoplasma gondii
ttggtttttgcgacgagctgtcttcggcgtccatactgcccatacacgccaggagctgcagtcaagtgtcacgctacgttttgtggtatcgtggcagtccaaaagcggaccagggcaggtcggcacccggtgggttgtcaagaagctgcacgacgatatcggctacacaggagtgtgcagtccattgtgattcttagcagtgttttctttgccggtctaggcagccaccgttgtgtcgggtgggtgagcaagattaggaacgagttttctttgttcatacggttagcgcatttttggcgggcaaggtgtgataggttcttgactgttacggtgcgttagggtcgagtcatgccttgcgttatctcgagatctcgtgcttcggttgtttctgtctttgctgcgaaacgtccacgtcggatcattggtcaccgcaattgttcctaggctccccgttcacgatgtcgcttctatggtgaaatgctgagtctggtgccgccccctacggagcaaggttgttcttggatgatttcagcggtggggggacagcagccgaaagtatttgcctcgtgggaaagacttggctgcaaacgcctccttgaccaaccttgtctatcctttcccgacatcatagtggaatcagtaaacctcatagtctgctcgatcgacagaataagcagttaagaagatccagggatcggggggctgcctctgtcgcgaatggcggcttcgcagacagtggagcttcctgactgtcgcacccgacgccacggttttggttgttagcacacagaagtcccaaagtatctttcgctaacgcccagatgaaagcgaaattcagatacacacttctaggaaaggaactgtgtgcgtgtggtagatacaatttctggcggtgtcttttaacgtatacggccttttcagttgttctcgaagaggtgtttcgtatatggtgcgttttcgcagtccctgatgtctgtgactaataagccagacgactgtctatcaaagctgcctgtagactaagtggcgcctgcagtggctggatagctgaagcgtcacctgtcgtactgtggaatgtgaacgcgacgttttgtcactgacgagtcaggctccccctgttttgcggagaaaaaagatacttagttcatcccacgttcacaatgagccacgaaaatgcttttcaaaccgtggacaggtacccccgcgctgtggtagagtggtagccatcgcatggctgcatacgaacacgaggactgaccaggaaaacccacttgttttaccatgcttgcgatggcgagttacgaatgtcgtcttgtcgagcagtggaagttttggtggaaccagagctttcattgagtaacgcttactctgaaattctactgtcagtgtggtggaagacaggttctaattgcgagcccggggttgtgtgtgagtggccgggtagacacgggacatccgagcgcacgtacgtcccatcttgtgacgaggtggtgactctgcatttgttccgctgcgcagagtgttacataaaaaccagtggtgctacatgggagaggcacatggacacgaacagcggcggtcaaagtctgtcctctccggcgacacggccgacatcgagtgaagttgaccacaaggagtttctaaccgtcttcgcgacgttagacgctgcctgactcggtgacactattggacacgcagggagcacaatcaccgtgtatgatcataactttatttacagtggatcaaaagtgtatcgccgtactctgtgaagcctgtcgtgatgtttaccgcgaacaaccgattcctgcacctttgcggggcaacatgaatgctgtcaccgacacaaaagacacagaaaatcgacgaggagctctctgctccagcgatggtgttgtgagtgagtctgaatcattatgtaactgtaacgcggggagtgcttacaagaattgatgacgcaagcgtcgcgttctcatcgggacttctgctagtctcgccctcagtacgttgctacgggaaagccacgaaaaaaggcaactgaggaactttgaaggaatgattgtgccgagcctgctgtcatgcttgggcatcaaaaatgtgacgttctgaagggagccgtgaggtgtgtaagcgacgtggagtcacgaattagacggttctgaacagcaagagacagctacgacgcttcaggcgttaactactacgtcgggacggttgactgcgtagttgcaggcgaagggagctcaccgcttttcgatgcgatggggactaataaatcatccgggtcccgccgtgcgcagctcgggaggagttgttctttctagacgagggaaacatattccaaaaaaatgatagttttcaaggaggaaagcaaaacaagggagagcgtcccaactgcggtgcgctcagccttgcgttgtggcctgtccctcgtccgtagcatgctattcgccatcaagccattgcagcggtcgtgtcgatttagatgtgctgcgcaaccgcatacaccggtgccgcgccggtatatccttttctgtagagcggtccgttatcacaagcaaggggattcagagaccagtgtctttccatacccaaacgatcaaattcttggtgttttgccggcccgggtacagaaggtgccctggcacgctgtgaccacgccgaggggcatcgcccggattcccggacacagccagtggccgtgttctgagcgcctgtggagtttcacagttggaatgcagttgcccgctattgagggaacctggaaaggaacccttgttttgggcgaaagcctacgattcgagagacgcacgtcctgctgctgattgcacataccggtgacaccacggccgacgactcacgtcgccgtccaagtaacgcgcgatggcgccggtatgtccgttaatggcattgtagtcttctttcgtccattgtgcagcattaccgagtccggagcttggcaagtgcttcagtccgcgctggtttccagtacatcagtccgaaaaagcctttccttcaggatcctccgactctgactgtgtagcttgttgcttcgtacttgtgtgaacgtcacaaaacgcgaacaaggttgcctgaggtatcgattcatgtgttttcattcttggacccggagaaggttgtgagagtcattttcacagtccagcgtttccatccggagatgacgccccattgcgggaggcggaagtgtttccctctctcgcccacgtgactgttggtttcgggtgacccctgttccgacatttccccttgttaaacgcgtttttagcaactatcgaacctcgatacgacctcctccatttgtttccattttgtaaaacggcccaagggaaaacgttgtgcctccatccgggtaaaggattttcccagtctcttctcgagcaggtgtgaaaccagtagcggcgcccctacga

SEQ ID NO: 3799 - DNA, 1397 bp, Toxoplasma gondii
tgatgccaagagaggttctgaccttgctgcgaaactggccttgtcgcgaaccttcttggccccttagtgggttttcaagcaatctgcaacttttctccgatggacagtcggcctacacatctccggacttcagcaggttcaccattaggatctgcgcgttggtcacagaatggaataagacgattaaacaccttcacagagaagcaaggatactacacaaacactcggtctcctgcacttgtccgcacatcaggaaaccaagctcgcttgcggcggtgagccttgaagaatcgaaaaacgactgtggccccccgagatcgagtgtgaaacttctttttggaggcctagaagtgaactgtggagcacaaagcatctgaagatattgttttacggacgactcatcacaaatttcccgtcgacgggagcacaaaaatcttttggtcaagccattatccgcgcccctgactgagaaagaaagccttgttgctaatcgtttgggcagctttttatcagtctagtgaaaaaaactcattgtgtacctttttgctccatgagttggccgccgggtgattctccgctgcggcatttttacagccttggtggggatatgctcactgttgtccattaaggtgttccattaggatccctttttgagcatctggctaaaaaccagcagcagaacttgcccccttcagggaccaaccgctttgccagcttgcggttacttgtcttggtgagtcgtccgaagatctgaagcagtatattgacgttcaccgatacatatgaggtttgtgtggtacctcggggggagctcaaaagtactggaccctgcattttcagcaaattctggagtgttaacgatgaagcctctcttcaatggatgaatcgcgagctgacacccatttgttaagacggtaaaagcctgggtgtttcccccgagagaagatccagctcccttgatgaaacgtttaccgtccattggttcgcaagcatcccgaacgagaagcatatttccttctcttctttgcagtttacagcatacatggtgcttgacacgcccgatctggttcctgtgctcctcgagcgtaggtgacatgttcgggaccagtgccacgcttcaaataaaccgttatttgctccccctgagtggacagatcgtttggatatggagtttttctaaatctacgtcagacttaagccgctaaaagtatatgccgtgtgccccaaacccgtaggatatccttccagatactttgggcagatcatacttccgtcgttccatctgcgtgcgccacgactctccggcgaaaactcgaaaaatcccgtttcctcttagactgcatgcaaggagctgtcgatgtctcgctggcctgcgtgaaattgcgcaaaggagtgga

SEQ ID NO: 3800 - DNA, 1668 bp, Toxoplasma gondii
agaagagaagtccagaagaggcagagcgaggagacgttgcagttgacggagggcgaggaggtaggcggggacggcggcgatcaggagcgacggagacttgcctctgggatctggacgagcggctggccgcgaggaaagacagagagcaggaggagggagagaggcaacttgagagagaagaaaacaagcagaaaccggggaggcgcggtagggtgccacaagagacgcatacgcgaagggagacaccagagaggtcgaggaaggacataggagatccagcgaggaaagaaaaacagatatgaaacatgatgactcgccgccgacctcagacctcctcaccagcggcagatttcggacttttgacgctcccaaagaagaagagaatgccgcactggaggcagatgccgcgtttttagcatcttcaggagacgaagaagtcgcagaggaagaagaagaggaagatgacgaggcgttcttcttctggacatttcttgtgttttcggcttgcgagaggcctgctctcccgtcctccgcggctccctctgcttgctggaaagaagtcaggagaagagacgcatcttcttccccttctgcgtcgccaggaggcgcctcttcctctgattcctccagccgcgtcgcgtccagagaagaggccgtcgtccccctcgccatcttcctcctctctctgcaggaaaatgagcggaggagacacaggggaaagaggacgaaaagaaaacagccaaaggagaaaaagaaaaaccggctaggaaaaggcgaagaaagcacgcagagagaagaaagagagcaagcgaaaaacggaggaagagtgtggaaggcagagagcaagcgaaagaaagaagagtggaagaaagaagagagcgcattttagcgcccctccctgggcttgttggctaggtgagaaaagaccttgtgcgccgtttcttgatttcttgcatcgcgttgaaaagaaaaggagcggggaatttcattcgtttgcgacctgagtcgcaggagacgtcctcctgtctcgaaaagcaaagtgaaatgtcaacgagcccgacaacacaatcaagcctttgttccctcccgcctgcaaaggaccccagtttccctctacagagactgcgcgcgacagacgatttcaggaaaaaataaaaaataggagaaaacggttttcatcgcgcgaaaggaagacaagccagtgcgcgcttcaagcttgctgccgagaccgagaccacagaatacctggcaaggaaaaaacggcgctgagttaggaaggaaggtggaagcagaggagacagaaaagtttgacgcgctgaatccggcgtatggattcctcgaggctttcaaaagtcgcgagctctcaatttgtcttgcacatttggcaagaacgaaaaacagatttcttcgcttctcaaacagcgtcctcacccttcatgtaaagaagcagcgcggaccaagacaccgcgcgtcgcgagtgagcccagacacgcagggcgggaggtgacttttattgacttttattttctctctttctcttttcgcctctcttcgtcgaaagcaacagagtagaaggggagaagaagagaggaaaggacagaggaacgcgcgcgaagaaggcggcgggaaggagaaaaaggaggacattccagaaacttgacctcatca

SEQ ID NO: 3801 - DNA, 1736 bp, Toxoplasma gondii
tgcgctcactaccgaagcagcttctgggagtttcgttttcttttctcgctgttgctgagacgtcgccagaatcgccgcgaacttgctcagcgtgtcatcgcgaaagagggaccgcggggaacataggagactgttggatccgccttggaaggaaggcgcattgtttgtgttttccttgttggtcccgctcgcgcgaggcgagttcgccggcgtccaagcagctgctgcttgcaagcggcccttcggcgtcttcgtcggagccgcttcgtgagcctgatgtacagaagacagcaggggaggaggctgaggcgctttggaggcagagacagaagcctcgtctgtgggagcgccagtggaaggcgacagagctgcgggagcgttgggcggcacagcagacacccgaggagggaaggaagaagtgtgtgaactctggaactcctttgcagacaccgaagaagctgataacgcatctggagaggtcgcccccccctcagtcgtagtgagagccgaggcatcgtctttcttagcacttgaggcagacgcccccttgggacggcgtgggcgcttcttcgcccctgcagtcttctgggttgaggcctgcgtcttagaagtttcggcctccgtcccttgctgcggacaggctccttcgcgagcagtgtgtctgttcatccgtggcttcttgggtttcggttcctgggaactctcaccctctgcacacgcagagacacccgacggagcgatgttcttcaacttccgcggtttccccaccccttctcttcctactgacaagggctgagaagcccctgcatccggacttccttctgaagacgccgtcgcagcacacacagccggagacgccgtcacttcagacgcagaagccagggcaacggaactgaccggggtaacatgggttgaaatggcagaggcggaagcaggagccaagcgaagcgagggaggagttacgcaagagttttctgacgtcgcagggcaggtgacgccgctgttttgtgcgacgagagcggggggggtcgggaaggccggcgcatccctttctgcgttgtgtgaccggtacccctgtttctgttgctcaaatttggctttcgcagcggaaaaaaggtcgcaccacattttgagagacggtgaaggaaggaaagaggcggaaagaagaaacactggaggcattcagctgctctgcaccgccgtgtaatacagcggaaacggaacgcgactctcatgccagaccgccgcggactctggtgtacgtacaacgcacacacaccccgttcagtttggcgcgcagtttcccgtctctcaactgcagtccgtcaggacgtcaagcgtgtgaaacggcagaacatgccggtaaggaggcggcttcagcttccagggtgcagcaacaacagtgcggagacgactcgagatcgaggcagacaaacgaaaatcccgtagaagacacgaagaattttgcaggagtttcgcggcagcatatgcgccggatcacggaggaatgaaaagccgagatacagtttagcaaagatcgaaaaagtccggcactcgcgtcgacagacattcacgaaggtcctggcgtgccacaagacccgaatgtcgcggcgtccatggcagaaagccgatcttctgcgaatcgggaaaccgcatggatcgcagcacgtcaaataaggcgggtgtgcagaaattgtggctctttacgatgagcttgaatgggtctggttaggaaa

SEQ ID NO: 3802 - DNA, 3326 bp, Toxoplasma gondii
tcagtcggactacagaggttccttttaacaaacgcaggcgcgtgtcccctgcgtaattatgtcaccaacacggcgccactcagaagaattaagtgccccaaaggcactcaggcccatcgtaaagagctgattttcgaaatgttatgctcgtaactttcgccgttaatggttgatttttgattatgaagtgatatcccatttggaccatgtcaagtgcaggcgctcagttcactgcctgttttttcttacatgcgtcatttgcttgttgcctcgtgctcggcagctgtccctgcgatgtgggcacaccgccatccctcaatttccgtatcagtagacgcggagtagcgagggtagatgtgcccgtgcactgcatctccctttcttgtcaggccgcttcaatagacgtatcattctctgatcggcaggaaaggccggacatcagcgattgacttgcagcagaggagaaggaatgcgtacgtatgggtgactcaaaaactacaactgcgtcgtcagagggcacctaaagtgcggccaaggatggttggaatttgtacagttggatgtttcataattgttcgtgaagagtgaaacatgcagcagaggtggctgacagaattggtattttacgttcagtgtcattcagctgctccctcgacttcgtctcatgcgctcgggttcagctgcgtgtcaaaagttgaaagactactcttccttgcaacactacgttgtccatttcctttgtggactgcttctttccactgtagactccgcaagtccgtttcgctgtggggaactcagtcccgcgacatccagcgtcaactgagacagccatgcctacaggatggctccactcgagtttcggcagagattgaaacttctcccgatccggcgggccaaacggagaaagaaaacaacttttggatcttccggttttggtgaatacggaagggcttcatgtatagagtgcatagtcacatgcgagcggagaggagtaattcctgcggcccgcgactttccgccggacaagcgaatactgcatctgcacaccgcgtgtttgtgtaactgtgtaactgatcgttgagtcggcagccgtcctatggcagagccttttcaaagataagacacgcgcaagtggtgcggaaaagatgttcgaaatactgaagttgagataacagaggaaactggagagtaccaccgagactcacagaagcatttctaggcctttttcgtttctggcaacgacgctggaagacatcgcatccaacaggaattcaagattgagcaatttaagctattcatgaaggcgcatgagttgcactgccctgaagggcaccgatacccattgggggcgagcttaagatgcgtaaaaaagcaaatcactacagacagtcgcgttctgattcatgattatttagaatagtgccgttctgttccctattctcagcgcacgcattcgtagtgtgcttagctacgaaaacacgatacatttttggggtgcacggaattccgtgtggcaacgtcaagaatgagaagtgagatgcgtaaacttgtgaggtgttaggaaaatcacgctcgactgcctagcatccgatgaacgcgtggggagaatcgctgagcaaggaatgcgactccaatgaaacaggcaaaagcggacacggaatcctggactctgctctatgctgatgtgactaagtcgtctcacttttggatttttcttcgacttgccagcgaaaaaagcattcgaccttattttgtctttcagaggactcgcgcgtgagccacgacgcatggtctgtcgtataccgtcctcaaactcgtcaccacctgacatagccgagacccagtcaaagcgcgtttccgatatttgatgcacgggaccagcctacctaccactgcaacaagttctctcgttgctggcttcctttgccagtatttttcttcattccgtttttttctgtgcctcattttactgcttctgcggtgaggaaaacaatctagccgcaaacacgtgttttactccgaacatcgacactcatcgttgcaccatttacacttccagctaacaatgatttgggatgcggagacgatatgggtaaactgtgacctaattctcaggtcccgtaaaacattaaacactggaaagacaccggaaaccttaaggaacataatgatgatggacctggaggggaaagtgagtgttatcagatgccccgtatttacacggaacttgtactacgataacttgctgcagttcaagctccatacggacgatgactgcgtttctattggtgcgaagatgcaaagggagaaaaaccaaaaagaaacgtgcacctcgcttaggacattgagtataccctgcagactcacgctaatctaaatacgtactatacatagttcagtaggtccatctgcacacacgcgtgatcatacctctatcgacgtgtcaatgtagttcagactgaatgattgacagatgcagacaacggtttcgaggttgggatagatgaacccagaaagactggcataaaacagtttcggttttgtcatcgtgaaaacctgttgtatcttgctgactgttgccagccgggcgtatgaggaaagaggcccagctctccgacacacagaagtctgaagaaaggtaaggcaaaacgggaagcctctctgacatgccaggatactatctgctgtaaactaatttcagaggaaagggttgtttctgtggtgccttagagtgcagctttgcttcgcagtgcatttgaaaactaccatggtaggtttttataagctgtgcgtagttcgatgaagtgcttactatcgatgacgcacggaaaaatgctcctcgaaacaattccgtagacatttcttggttttctccaactcgttctctgttgttcgatatcgtttcacccgattctatccctcattgattcaaattctgtgtatttatgcgtcgggccccccactacctttttcttttcatatcactactgctttcttttccctgtatcgttgcttctgcaggcacgagatttccttcctccatgaatgtcttggagtgtctggctgcacccaacatgccaccaaattcgggcgagaaccggcgttgagcccggcgtggggccgtccctcgggcgggcatcaccgcgctatgtccgcgtcgatttcggcagcagaatcgacgagcgaggagacacaaaaccatgaggctggcagtcgatgcaccaggattagttaaatttgcattttcagacatttccaagcttcacttccccatccgtgtctccgcttcatcttttagatatctgagaagtggatttgccgcaaga

SEQ ID NO: 3803 - DNA, 4533 bp, Toxoplasma gondii
aattgtatgtctagaggtacgcaaccacacagagctacagttgtgtgaagtacggtcttctgagtggccggcccacaaaactacagtgttatgcatacatgctctcctcccgctaatcaactgagtttatcaatccagcactgcagtgcgaatacgcgtgtgtcacggttctatcgcagaccactgagattggaagtttgtggttctggccttcaagttttggtaccattacgcacacgccggtgactctactggagttcgtcgccacgggtatggacaccagtctgtgtcgcagccgtacgaattggtccggttatataggtgtcgcgggcgtacggggaaaataacagaattcttcagcgggtgcaaattacgttttccccgtcgtcaagaaaactttcatggcggctgtacgaaccacggccgtctacttagaaagcgtgtcaattcccaaaccctacggaccacagccgttttggtgaaaagcgcacatacgtatcctgtatctaccgcttaccccacatagatttccgtgtagtactgcgaattcatgtaatcatgaatgctgatgtcgtcgccattggagaggcccgacaaattcccatcgtcctttttggacagaccttcctgcatgcgcagagcggcaaccagatgcgcctgcaaatctggcacagttatggtgtttttgtcccacccgatctggcgcagagatttcattttccgcagaggcatcaccatcactcctgaaagcaaagcagcagcacaaaagaccatttctatgtctaagaagccagaagatcgaaactggatatggctacaagagtcaacagtacgagggtagtgaaccccgagccttgaacagaaggccaacggaaacggctcgcaaggattcgaggccccagagaaaatggagacgacagtcacgcaaattggtagcctccgtcgcacgaacgacacgagatgaaagacgaaaacgagtttgaaccgtggtagcgcagctggtgtactgtctgttatgtagggcctaagcacaaagacagtacttttctaggcacgagagagagtaccactgcggaagagagggcctgcgtgaggcaaagcatcagagtcctccccgagaaactgctcgttctggacactccagggagaaaacatctggttctgtctgtcgtgtcgtgctggcgtgtctgctcgtgcggaagacggggtggaagcctgcgggttacccagttctcccatcacaggactgtttcttgggtcgtcaagtggggaggtctccacagaagtgaaggaaaaattcaccaagccgtagagacacaagcacacgatgccgaagagtgcaacgacgcagatcacggaagtcgacagcccgacagccttgccaaggctgcgacgtctttttgcacggctgaacacgcccataggatctctcagcgaagacagaacttgattgagacggggaaacgcacacgcgccaccttcggtcttcgcgcaatgcgaagaactcgatggatccttccaggactcgtcttcgacatcgcgatcctcagcagccgagcaaatgccaggaagagaagaaacggatgcagagtcaagcaacgaggcatacaaggaggatcgctttccaaagtcttgcgaagacgaatcgacgctgacgagattacggaaccgcgacgacggagacatcgtgcccgcgtccgtagttgtaggactaatagacactcgagggtaggcaaaaaaacgaggcgcaggacggttttagtgaagtggattcagaacgcgtccgtgcgtgttcgaaaaactgtctgcgaattcgctctgcgagtcggtctccagcaaggcttatcacgcacacattacctagacagactcaaaaacggcgcacactcaaggactgcgtcgtgacagccggcacaccaacatgcaaagctgtcactgggtttgattcgccaacttctgtctcatatggaatttacgcactctcaataattagcctcaacggctgttactgcatctccataaagcgagggctgtagctgtagaggctttcacggtgttcttttgagtcttccaagagccggagagaccactgatctacggcaaaaacaatgtggccggttactgctcccggttcgccgacaatgctggatggaagctgaaagacaggacacagatttgtatgtcatctatggaagctcctcgtctctgttgtgcaaccatctattttcatggaactagcgatactgctcattccgcgagcttgcctgtacgcgtgtcagggacgcggctgagatgtggttgcatgccggccgtgactgataatgccaggaggtgctcactggtttcgctgagtggcaacaactgagccatgaaaaaaaatcaaagacactgcgtgatgtggcgttcactaagcagaaagtgaagactctatcagatgggtgtcttagtacacgttccaactgaacaagtggtcacggcgtgtgtttacacgagcaacgcgctacagatgcccaacgcggaggccattagctagtgagctgaatgaaaacttggtatttggttgagtgtcacagtttcgctggaaatttggtggcaccgaagcgcatgcgcccttgggctgaatcaggggctattttcctgttctatgtggagtagcttaactgataccgttgcatatagtcaggcctgcgtgaacaaaccgtgccgtatgcagcaaccgacaaaaatttgcgttcggcataatgatcgatagtcacatatagggggggtgatgtaagtgcagaaccactagcaagagtgacactggtggcccctagagctttccaggcaattatgggtgggtgcaagagttttcacgtgtttgtagtcaacgtagggtagacaaggacaaaactgcgaggtctgcgtgtacctaaaacctactcagtttaagggctggtgcgacagtcggccgctgcatagtggcttgctcttagtgtaaaccatctgttagagaacgcaatgtcaacctgcatatgtctaccgaaagacattttggagcgaccgctggacagagagaaccgtgagtacgggctcactattgagagagtcatgccgtttcctgcagcgacatgggtcgtgcttgttcttggcatacaacaaggttgtcttcgacactatgtagccaataattcttgtatgacatcctcgacagtcagggcagattgcattcgagaaagaaccggcagttctggcgaccccactgcgttgctacgttttgtgggatagtaacagatagtggtcaagtaaggatgaatccagaagcacaattgtccattcccgtgaaataaaatacacaagaatacccgagcggcatcccaaagtacagcatgcggtctctagtactgtgttgtgaaaagttggcaggcaaatgccaatcaaacattcaaacgtcactacagcggtaatatccaaatctactttgacgtgagacgcccaccttgtccaggttgggggacatctctggccgcacatgcacctctttatggctgtatattttagaagcccgactgtctgttcacggataaaatcctcgctgctggtaaatgttgtcttgtggcttgtaacaaacttgcgaaacaggtgttaccaatcctctctgttcatgcaaggatgcagagctgttgaatgttcgtgtctaccgtcgtcgccgttccggcgatgaatcatcacgggtaaaaaacgcagggatcatgatttgggagtttttggcggaattcctgacttctacggagcagtcttttgagatggtgaaacgtcttcgtgtcaattgcttaattatggggtgagcgtctcctgagtcgcaaagcttgaggcttcttccgaccaaaaagtgaaacggacttgtcggaaaaccggccgcggacaagattgtttcgtcgtgatatggctttcgtggaacattcattacctctgcaaaccatctgacatatcctaatgataaaatatcgaccatagacctgggccgtatgctttaagctgtcacaaagcggcggtacaacgacctggcgttgtacgagacgtatctcaaacccggcgttgaagcaaagtacctgcggtccagttaatcatatactaagcatgccttttcactatagacagcatagcaatcggaatatacgggtcgttctcagagcatgctagcgccttttcatttctgcattgctggcatctctacgatttttccccttggtattatgctaatcgtttcgcctcgtagtgtttttttcctatgtcacagcaatcatctgcctacaacacctgtcaacgagacatttttcgactatttcataaaccgtgttatgggaccattcctccagtttctgacgctgatgtcttaacggacttgcgaatgactgggctcgcgggagagctccaggtccacctccgtactacaagcagctgccctcaataacttcagcgggtttctggtcagcattttttcgggctactgcgaagcagactcgtgagaaatttccatttgtcattcagtca

SEQ ID NO: 3804 - DNA, 4831 bp, Toxoplasma gondii
ctgcttgttctcgtggtttccggtgaggcgtcgaaacaccgagaggcgccatcaggtttccccgacacggctggaaggtcttcctcgtctgaggaagcgagaggtgcgcggaaagctgcctccgcaaggcctacgagagcgaagcgtttcttcaaaataatatgaggagttggagagtccacagacgtggttgtagacggtggggagtcctcaccgtccactcctctgtccatttcagccttggcgctcggcacctgctcagcgaggcagtcacctacaggaacaactgcatgcgccgtttcgcgggcctctacactcctactagaacattcgtttggctctccatttgcagaccataaacactctccaagaggctctttctcgaacgctttccgggtctctccatcggagctttctgggcgtagaactgaggcgggggtatgcagattcacttcaggttccgtttgcatttcctcagtggcgggaatgagatgcgtgcttgtgcaatctacactatgtgccaaagcctcagccacgggtgttccaccacagggcggctcttgcggaactgcgtcctggttgcccgataagaaagaattatcggaagaggcagaacacgccatggtggcacaaaaagccgacgaatggcggggtatgactctaccctcacgctaacgaagcttgacgaggacaaaaactggggaaaatcccaaaaatgatgacaaagttcctgcctagatgtccaccaggcttgggcggcaattaggcagctgatcggctttggcgactaagaaggcgcctgtctggcacgaatctaaaactaacaggtgctcttccatttgaacgtgacgcatggagcatctctgttcactgccaaggaaagagcttgaatggcttgtagagaaagttggacttctgcccacatgaacaagtgaacccagtatgggatgggcactgcgtgactaagaacaggacgctgacaaacagccagttctggcgaagggtacttcagagcgtaccatcccctcttcaacataatatccagagtacagaaataggccattaaagacgtggatggtccttcccatgagtgcagcccctccgaaaaccgaggagcctctattcgcggcggcgggggagtggcctcgagaaggtgttccgaaacacagaagggaatcaaaagtgtgaatattaccgaataagcgtatgaaatggaccgatcaggaaaacgcttgtttcattcgtcgctttctccgactaagcgctgtgaaaggcggctagcatgctgtctggttctgcatgcaccactcgacatccgggaatcacgctggatatatcagacaatcgacgaccgagttgtattccgtctcttctctagaaagccacgccctaaactctctttaaagaatgtgtgtgtggacagatgttaatcgtcgtttagaggttccaccacaccagaccaaagaaattctccattatgccttgccattttctgccggggccagtggggtcttgggtggtcgctagcccgggcaccagcagtgaaacaaatgtgaatttgcacagaacatatgtctgttctatataatgtttgcatgactctgaacgcacctttaattttggccgaggcaggtttaatagatgtggatgatgcctttgcccaaacgccgcgatacggaagtttcaaatagggtgaccaaccttgacgggtccctctgcaatgttgcctggcactggtgacagttctgggaacgaccgtcccccactgggccgcaaagtcagactctccaagaaagactgcgaaatgttattgtacaacagtatagtatgtatcgtgtagtgcagtatatacctgtattgcccatagctacatctgttgtacctttcaaagtgaattacaaaaccaagcgccgtcggcgatgttgggagttagacagaaattgaacaccaatgaaagccaagcctacattgaagctgtgctgcctggaactctcctgatatctgctccctgtgcttccagccagcaagtaggagtgcgtgacgcgagggctgtcgtctggcctatggactcatgttgtcgatgaatgggtcagctttcagactaaccaatcaacaacagatcacctacagtcacttgcacgaaacacggtagctttgaaattcttcctagatagttaacaatggcatacccgtgggcagtggacgatgctcgcaaatttatctcttctgtgaagtgtattagctgtacactcagacaccgttcttttgagagtgctgtactgacgttcacagttaacatcccactctcaacgtacggaatgtttgtggcccaccagctgtattagctctttttcatgcgtgcataagttagtgggggggggggggggtcagcctcgtgttgtttggatgtgaaagattttcagcagcttctgacgtcccaaccctgttgaaaaagagaaagaaaaaaccattcctcagatcttttggcggcagcactaccccaacgatgacagtgcttgtttcgggactccaaattttggaggccgctgaagcaatgacatcgctgtgatgagattttcagtatttttcgctgctgtgtggatgaattctataagagaacgtggaaagatcgaggaagcaagaatatttggtgtgtgtgcttcgtgacggccacttctactgaatgttttcttcctgcacgtcaggagcactgaagaccttctgagctggaaaaacgtgaccagtatatgtcccaacgacttggttctagcacagagagagggcacagttgtgagcactaggagctcacttgaccgctcatacgcagtcaagtgctggaagaacgactgttccaacgtgcgttttatgcgggatcacgaaattaacagctaaatcaagattgttgctgacgatgtctctcctttgttttcccctagacctgctgttgcatttttgctacggaaatccgaatatgtctcacttcctagctcccgtgcgcacgcgggtgtgagatgctagaacgtttcagctgagcacacaggcctacttctccattcggtcctcgtgcttcatccggcaaggtcgcctctctcacatcatctcgaatggctgcaaaagcaattaagatccgcagcaaccactagaaggggagcttaccatgggcaacaaaacgagtcaaaatcggatctcggagcagtgtcttgcggcttccaaacgttcgctcccgaacgcctcatcgtgcatttttgaccgcttcagagggggttgcgaatggtttcaaactgcatgacattaggttttcttcaatcgtcttcatcgacgcagtcgaaagtgctcaaacggcgtgtgtcatattcttaccatgctgcctgggtggcccctcggcgatcccaagcattttttcaaacgggtctgtctgcctgtctggtccgaaaagtgctgcgcttctaacttcggtcaccaggttcgcaagtctctagcttttggtgtagaggtggcacgaaatatggatgtactatcgtgctctgtggactgaaatatccttttatttcagtgttcgcacgtgattgacccgagagagacgcgcactggcgaccacaacgacgactacgagcccgcatgcggtgtggtccgtctcggagacagtcggcgttgtctcgcgcaaatctcgctagacggccaaaaactaacattggggtacgacaaacaacgagccaaaactcagtattggaacttgcttccatgaaaccccgtctcaagcccatattgcagctcaactgcgactacttagccaagatcaaatctgctagatcaaaagctacaggcaaatgtattccgtgcaaagtttctacagtctcttctgttgcaactacagacagaaccatctgtgaaacatgtcttcagctggcaaggatgtccggcggtgctttgtgttcctttcacgtgatctgggctccatcgtgaacgctgctcgtttctgcctcagtcttcgacaagaaacattatttttaaaaggtagctactcaagtgttcctggtatacaaaggacgtgcttttgtcaatatcgtcgtcgcgaggagtcattgctctacgtggcgggcacgacgaatccacgacgtaaaacgcgaatttttgaacggaagcggttttttttattttgatctgtgtttcgtgttgcgtaggcaaggtctggaagtcggacgggtgtctggttacggtgactctctctacttgtttcatatttcgtgaccgtgctctctgcggtccaaaaattatcttgcaaacagttccacctcattattacggactgcaacgttgtttttgtctttgtatttccgtgttcggatgctaagtcttggtggggcgacaaacgggccaaacagtttccgagcggtcgtttgctattagtgctgtacgtttgtctctcatagcctgttgtttaccgtctactctccgcttatttcgctactctgcatctccttgtcggcgtgatggcttttgaatccacgctgcatccaccgactctttctatacacctgattcccggtcaaacctgatacgatgaacaaattcttgattcatactctttgtattcatatccattctgtcgtgctacgtgaaatgctcatttgttgtcgttacaagggtgtgcttgccaagctaaaattcgcctgcgtctttgtatctttgccttcctggtcttcgggttatagctgccactgttgcttggttaagtcgttcccacctttcacctttcttcaatccaccaacgcacgtttctctcccttcacttcttggcctgtcccactgtgacttcctctacccgcaacaa

SEQ ID NO: 3805 - DNA, 1468 bp, Toxoplasma gondii
tgcatgtggtgtggaggcctttggactcggtccactttcttcgacccccgttgagatctgaaacaccagagagcatccattctgaagttctaccgccaaacgcagtagttgctgcgcagatgcgcctttggcctcgttctccaattccctgcaacgcatcgatgcgactagtcttatgccggacagaacagattcgtgatacactcagctatgacgtgcgatagcgtagcaagaaatgaatttgcgactttatccagttgcccggctctgtctaccttcttctcgatgtagcggcggcgttctgtgttccttagagcgagtccacgcaccagcctcgtggagtcgaacagttttcgccagagcggggacagccggtggaagacagaacaggagggattcaccgtcacctcgtttgcttccttctggtgatggagggaataagccgacagactcacttcttaacagttcatggcagaggggcaacgacgtcaccatccagctttccattcacttaaccgcacaagcgttctgctcgttagtcaagcctcactcgccagtcgaaagccattaaaagttcgcgtttctggctctcgtttgtgccggaagtctgccaaagcaaacaaaggatctgaaaccgagtagcagtgaacgcgtgacagtgcagaggggtgcccgcgtcggcgtcctctctgtccacgaacagccacaattctcatcacgagaagtcctcctcccctggatcttcctccagttccccatgactgcctccggttctcgcacggacggcgatccgccttcacgctccccggcctttgccagttttgtgcaagaaggtcgcccgtcttattcttgtcacgttccctgtatctactcggttcactgcgctctacagaagctcttcttcgccttctactgatcagtgcactctacgagatgcactatcatcagtcctgaactccatgtttgggtggaaacctgggcgtgctgtgtcgcagcgagtcgcgagattgccggcctgtcgacgagttcccgtttttcctgcactggctacagcgtagcggcttcgcctgctcactggcgacggtactggccgcacggtttcacgatcctgaggtcggcgagatgcccctgtctggcgaggccttttgtctacgcagcgacctctgtctactagagaaaggcagaaggccggagcgttttctcagatgtgctactctttgtcttctgcgatcttccgtgcgttcagctgtgcttttgccaaaggagacctgtgtgcagaggacttcgctgctaaaaagcagaagagtgcgcggcgtgtgtagctcagtggcatttcgggactcggtcttgcgtcgttcgcgactggacgtcgtcgtctgtgagagcgtcaaactagggagaaggggcgggccagagcgttcggaaaattatctgcaaagcccaggtcccgtatgatattcaaaaaaga

SEQ ID NO: 3806 - DNA, 4458 bp, Toxoplasma gondii
gcatcgacaaactctacgtcgcctgctgacagggacgacaaagcagcctaccgaactgggtttgactgcagtggcagttgaatctgacggagcagaaaagccggtcgtcgcgttgtatcgtcattttgcacagaagtgcagcgtttgtgctacggaaaaagttcagccaaggctctctgcaagagccagaccccgcgaaagagacgatacctcgtcgaggtctccggcgtcagaggagacgacaacaaaaaatttcggctttcaaccgcagctgaaccgagtgtacatgcacgtcaagcttcgaggcattgccgaagagatctcttcaacgccgctgctctgtcgcctcgcctaacgaagcctggtgtcgggtgtccagacagcctgaaggaggtcggcgcaaagaggggaagttgtacgctgaaaggcgggagacaggagcatatccaaagcagggtggctgtcttgggagagaaaagaagcagagagaggcgatgcagccctcctgcgagacgagagaagatgaaagccgtgagagaagttcctgactcggtgggatgccggagtgaaccatctccggtccttctttcgcggcccaactgattcgcctgccggcggagaactgtcaacagagcattcaaagaacttacaccctcgtggcgagttgactctgcggcgagaggcaccactgcgacggcatgtggacattcaccggagatatcgccttcaggtgtacatacacctgaggtaagcttgcctcgttccccgtcgacttgcgcacgcacgcaagtgtcctggtttgcccgtttcttgtgtcctgacgacctcctttttaaagtggcctttctctcctcgccgtggttttggcctccaaggccgttgttgacactcaactgcggacggctgctgctgcgcgagacaaacggggcggaccgcgcgaatctggcgagccgaccggtaccggacgccagtgagtgtcgagtagacgaatttccccgacgaactttcgggcaaggcaggcggcaagctattgggacagaagctgctttcagcgctgcgtggagttggcggcttgcagatacatccgcgcgactgctgggcgtccgcggcaagtgttccgcgcagtttttcaagaaagatccttgcgaaacggaagaaatgtactcgccaaagggggtgagaggacgacagaagtgagaaggaaggaacagagaaaacgcggcggtaccgcgggaagtgactgcgcgcgaacgcacgacagacgtcgagcgatccgagggattgaggtgtcgatgcacggcattggcagcaggcttcttctgggcaaacccagtcaagagttgcgttctttatgcgtgccaaaccgccttcaattgacaggctggagagttgccattcaaaggaaaaaaagttcaagcagagttccggacgacggcgtccgctgtggctggtccgcctgcgcggtcgacgctgcgtataatgcacacacgacaggacacccgcacacacacgatttcgcgaagacgcagagaattgcgcttcttcatgaaacatagggaaaaagaagaaaccggccctgctttgcaccgtcaaaaaactttttctgtgcggcggcatgagccagtgagtcaagcctcgcttgcttgctgcgtttcccgcgcctcaatttttgcggcagcggcgcctcagcagccgcgtgcgacggggagagttcaagccagaaagccttgacgcctttagcatgcgtatttttgtctgtagcaaccgttgaatccttccgccctgacacactgcggaaagttggctttttcttcgctgtctctcctgcccgtttctcgctgggtgagccgagctgtcgttcggatgtctgttgtgacacactgccagccagaatttcaagtcgagtgcgctcagtccccgagaggaaagcctggaagtccagggatcctggaggccgatttctcggacaaaaggatagtgttcgacatttccacccgcttgctctgttccatggagccgccttcgcaaacagagaagatcttcctccttcgaacacgcggcgtccaagtcgctccctttcgaccgtagtgatcttcgtaacgttgctctgcacaagcaaccgaactttgatccagacattttgccttctggaaagcgaggaaggtgcagagagacaaaccgcaagaaaagtggagcactcgagacttctccccagaggaaatccttcgctcttccagagagtgctcttccactacaacagacaccttacacttcttacatgggagattggctgcgttcactttttccaccgcctctcgtgttgaggctgtttccaagagagaaaaggcgactcagaaaagaaaggctacgtagaagagaaacgcgatgcgcgagtgaagatgcaaagggaggaaaagaacgctcaggagggaaggtgcgagaacagggatacagaaagggatgaaacaaagacacagaaagggagaaactgggagagttggagaacttcgcactggaaagaactccagattacacaaagaaaggaatgagcggagaggaagctttgaaacggcggagccccggtgacattccacctcagcgtcgcctctctttggtcttcacgctcgctttaccgctgttctggacatggagaaatcgcgctccaggtcttaaggagttttgaaacacatccacacttgcaagacgccgttggataacagctgctctagaaagccattcgactaagcaactgaagagcggtggcgtctgtcaacccccctgcgcagagaccgcgacagaaaacgtcttgaggctgtacactgcccccgactgctaggctgcgtttggaaaaagccttcgacttcgatatcccgcgacatgcacgcgtcgccgactcgattctctgaatgcattcttatgttcttcgaagcagaacacaaggagtatcgacagttccttaggcgtctgtttgccaggagagacacggcagcatcgcgcagtcgcagtgctgcccttcttgatctagttgacagatgcaacgaactgaaagcggtcttggatgcggtaaaccaagatcggtaaaatctgaaaggaagaacatgttcaagatcctctatagggtctgtcgacaaaacctgaacatctccttcaaatagggtttatttcgtgttttaaaaactttttgtgactaagttatgcaaaacatcgtcctaccatctccggtgtaaatacaccgaaacctctctccctctcctcccgaagctctgccaagaaggcgcaggttcctgaaacgacactctgaaatttttacatagtgattgaacgacttctgtaattcctttagctgtgcgtacgaacttcatccttacgtaagactgtagaacaacttccttcagcaatgataaacaccgaaaaaactcagagtcgaagttttaaaagtatcctggcaagtgcgaatgaccctgcactggtgagaagcgctgtgtgacagggaggtgaatcggcgagtgccaagcgccataaacttcaaaggtacagaacagagagaggagcagcggcagcgaccctgccagcctgttgtgcttttcctagacgagaagaaaaatacattccgagacctcacgggggaaggagaggtcccaaagaacggcggccctcccgtgacgaaaaagcttccttttacacttgcttcaactctgcttctcctcctccaggaaaacctcttcttataaccaagatccaaaaatgatcagtcgacgcgatttctgcggcatgcctcacgacggacgacgccgcgggcgggcaggcgtacgtacacctgagcgcatgcgtgcagactggactagggggggcagaggaccgacagcactctcagggatttcttgcggccagttttacctgaaaaaacgagagagagacatcttcttttttctgctgactttctgggactccagagcagcgcctgagtctgctctccgggagcttctgtatccgcctcccatcccccttctggccggcctgtcagctttcgcgacggaggtcgctgatctctctgaaaacagtccaggtgctgcggatttctttctgatttcttcggcgcagtcctcaactgtgccagaaggcgaagggaggccgagggctgtgctcgcgaagaaggagaggagaggcgcatgcactcggactcgccagtagacgtcgagcagacgatcgctttcggaggcgttgcacaaaatgcggtgtggtttatggaggacaagggccattgcagttgagaaccgaacttggacgatgatgctggacgtatgcgtttcctcgactcgcgcatttggaggaatcgcgtaaagacgaagaagatggagtgcgaggtgtgacggtggctctctaggcgcctctgcggtgtgtaggtacaggaagagaggaggcgaagtatccgagcggagtcgttgcaaagactgcaga

SEQ ID NO: 3807 - DNA, 3882 bp, Toxoplasma gondii
ggagtccctttagcagcctatcgatcgccgcctcttctttgtcgcgctccggcagtccactatgacacagaaactcctcggcttctttccgcgcttcttcgcctgcctggaggagcagcgccgcccgtgggtcgtctgcaggcctcgccgggaggggcgcgacgctgtttgggatccgtggacgcaggctgtctggtgcgcaaataatgccgtacgtaggatctgtcagtcccctgcgtgggggcggaagtagcggcttttgctcctgaaaatccggcaaagcgtcggaggaacctgcgtttgcagacgcgccaccatgaagcggcgaaggcggaacggaagagtcgggagagcagtgaaaagatctgggctctggggacggactgggagaagccagtcgctgagcactcgtgtccagcgccgttccgactgtacataccttcgagatcccatcgtctgtgcagtcttgctcagaagcgccgggggtagcgagcgacgaagttaacaaatccatggcagttcccagacagtgaaacggcgtggaggacggagagaggtgagacaggggacgagtagaaacagagacaaacagaaatcaaggatttcgaccatgtgacaagaatgggaggcgcgaggccacaattgtacgaagcaaggtcaccacggcagcagggcacgaatctgtgtgtttctgaatgggggaaagaagaccttctttgagagatgagagacgcgaggtcagggcggagaaaacgttacaacatcatgcggaacaaactcttcattgtcgccgcttctcgcacctcgccgagaccccggcattttgactgtgttcttgtcacggcacacgtaaacaggttgaagacggtgcactgttagccggggaaatccagtgcgaaggtacaagcgatgcgaccgcgttaggactaggtttcataggaacgagcagaaaaaaaaggtcgagaaaaacaagacggcaacgcgcctcctttgtaaaccaggcacgaggaagcccatccgggtgaggcgtccggcagaaaagaggggtcagcccagagcgaatgaagacgggaaacgagactgatgagaaaactgaatgtgagtggttggaaaaaaagaatcatcgcaaaagtgctacgtcttgtttcttcagagcacgcgttcgacagcttctcgacagccggcacgctcaacggagctgggctttaagaagactcggaatctcggcagggaagttgaaggcttagctttgcttgagatgaatcgttgagaagctgttttaccgtcgcgaaagctgactgaaaaaaccacgacggtgttccgcgcaaaggggcaaaatggtcggcacgccgccccgtcgtgtttttccgccaggtttatttgggactagacacgcgactcagcacagaagtaagcgcagtgtcgctcgcattccacaggtggaaggaaggctctgagtgaaacagaaaactggcatggaagccaagcaaatctcgaaagggagagcgatgtatcggcaggatacttggggagttttttcacctccacggctggctgtgcatgcgaagaaaagcgtgtcttctggcgaacaagatcgtgagccgttgcgcgtcaaatcgcctctgtcctttttgtccgactccccagcatacacactctctcgcttttctcaaagcttcaaagacagtttttttgcgtttttgtctcaaagtttccccagatggttccaaaaggcctctcacctaggcacgggggttttactgcggcagttgtcggtcgctagaagacaagcgcccaacagtggcatttgccgccaaaacgcgctatcagaaccgcagggttcatggcttttgcagaacaggaaacgctctaaagagatagatcgttaacgaaggtagaagggtcgtatcaaggaaaggagttttggagagcagaggagattcttccttcagcagaaaaacacggggaactcgagagtgttgcgacttttttcactctcaggagcacgacttcccgccagctcagaagagatgcggcatcagcacaaatgcacatagaaatccggaaccactttattcggcgcactattaataggtttgatcttctgtaccaaccgatctaaaatccgggtgtgttttgttacgtgacgagttttatgcattggttgccacacagaaagatgtgtcgagttgcctcaaaaaggctcggtgaagttcgtaggccgaggaactgcatctagcaaggctttttcagagagttgcaaagtctgcagcactctaccaaaaatcttctcgtcccttgacaggacgcctgtctcatcggcctttaggtcagatccagacaaccaagtgctgtaggatcgctgcactactccaccttactggacaacccggttcatgtatggcatctaacgggaaactaccgtttctcatttcgtgtagtttgggacgtattgggtaacagaggggagtaccattcgaaattactttcagagttttgaaaaattgcagggaagccggaccctagacgcgttgaagcattgaaaaatgatggcgcgaggaagcaccaacacaccgagcacacacctcaggcttcttctccctaaagtcaccaaaatcattttacaaaccgactagacagtggacttgttcgtttcatttcgttccttcctcgggacgccgtactcaggagtctagcttaaggtaccatcaagcatacgcccgcgtacgcgagcctgtcttcgactgtaggcctcaatctggagacatcgacctgcacattcctatccctccgtatttcttcgccaacgcaggccacacaagcctggctgacgaagaaacacccaagcgtgaagcaccgggttagtcaggggaactgcgcgttggcccttctagatgttctacgtctttttcactcaggatatttaccgaaaatacgcacttccagctagacgccatgccatgattgcggccagtcaactccagtctcttcttcgtctgagtccgctgccatatttgtcaccgttcacatttctcccagttgatttcgtcactcctactctacatatttacttttttttcttcagttgcaatgttgagttactttatgaggcatcctcctacggacagactcaggttttcatcaattctccgtttggggttctttccggtttgcctcatttctactgacacgcctcactacgctgttatttttcgttctgttgtcttccctgaaacgcgcttctcactggggcattgtcgcattgcacgaggtttgatgttacctttctaagagtacacagagtgtcgttcacttggttttcctgctgccttccagataggaataaattaatgcacagatggtaacgagctcgactgacacattgatcattgcgagtgaagctgttttttcaacttccttgcgtatcccagatcgaaacacgttttgcgcactgagggaaccttcttgccctcccgtttctcgtgcaaagtatctcccacgcctcccgttaccatgtcaacagattatcctcggataacaaccaattttctccgtgttacccgctgaagttcgctcctgcttttgatgatcggtgacctgctctccagatgatccgggcgcgtacagtcttgtggcagctggtcatcgaagtcgcttcccaagctttgtttcctttggggcactcccgtcgtactgactagaatcaggctttggggttttgttgtcgtagtcaatttttgtcggactgcagtctgatgcggttctctgctctccgtaggacacttgctagtcgagttctttctttcctttgagttcgtctcccactgacaggggctgacgtcggtttattactggaacgtctacaggggcttctctctgcga

SEQ ID NO: 3808 - DNA, 2509 bp, Toxoplasma gondii
tagaatacgccctcagatccagggagaatcgacgcgacaaagagaggcctgtcgggagaagaagcggctcttccgaggcgcggcaagtagggaaaaagaggaggaagtcgcaggaaagaggaagcgcgacgacatccctcacgagctgagtgagaggcgtacgaagaagatcctggttgggaagaaagagagctgggggttgagggagacgccgagagtcggtccactgagaccgcggagaaagccgaggaggaagaccacgagagaggagggtgaggtgaggagagggcggagctgcttcgaaacggagacgcctggggagacaaagaagagggaggaaaggatagagaggaggcgcgcaaggagacagtggcgaagcgaagaagcagaaaggacagaaggaacgaaagaagaagagacgaacagtgggcgcgtccattcagggccgcaggcagaagacagaggccgcacatgttttctcagcggtagttcggccgcgtcatccggggcaccaaggcgcaagaaggcaattgccgacgatcatacgggacgatggagacggagaaaacggtgagtcacaaagccatttagcgcccgagtaaggcagagaagaacgaagaggagaccctttcgagcagcaacaaaaaaaaagtccggtatccccttcatcgcgcccactcttctcacccactctggccgttcctctcccgccgccccattgtcttccgttctctctccttgtgcatcgctcctccttcttctctcctcagccactgggtctcgccttatccttctatctcttctccactgtcttgtctcttctttctcctggccgctctagaggtcgcgccgcagttcgcactggaagcgatgagtaagcgggaagagcgtttgcttccccatgctgagaaatggcaacggatgaaactggagcagacgagaccggccagggaaaggaagcacggcccgcagaagttcggactaccagtgtcgctgcaacacagcagttcgacttgcgtttgtatatttgcactggacgttccaagaaccgcaaaacacgacacagacttttgttcaaggacagcgaagtctgtcctttgggtggggtgaggacgaggagcgcggcctcctgtccgctctcgacttggaaatagtgtcttgtgcgcgaattcgacaggcgatgaacagacgtcttcgccagcctccctgtttatgcctctctctatggagaaagtccacgtagaaatgtccgaaaggtgtgctgtggcgatatcttcttacttttctcctttaggagaaagccgcgaaaccttacagagagacgggagacacctgtgctctcaagttcgcacgtcgccttcagcgttaaggcttagggttttagttgccagcttctttccgctgagtcgaaaacatgcttggagaaatccctcacggttttgtcacgaggggtaatctcagaaaaagagaagaacaaagggtctgcgtcgtttttctcttggctgttacaggttctcaagcatcgattgctaggcgagagacagcgccggtgtgtgcctgcgctaccacccacaaaagcggacgacgggacatttgattccctcgcgagttttttggaaatactcgcaacagaagtcgcagctagcccgtttccttctttagaacaaatagttagtgggaactcctttctttcgccgtcatttgaggaggcattttcgctgcggatctgcccaggacattcgacaaaacgacacgtgtcggcttatatgtgtagcgcagaaacgcggaagccgtttttccctgcgattttcctccggtggcggagtgaatgaatccgcgcatgctccaggttcttttctcaagaaacagaaattcgcgaacgttcttgtacgagaaggaaaaggagaaaaaacaaaagcgatacccgctggatttttcgtccttcgtcgcccctggtgtctgcgccgcgttcacccgcttttctggaccggtttcacgttgggagtctggactttcgtctatttttcggaattctatctgtgaagggtttcctttttttagtcgtatgctggaaatagaaaggcgaaattctatcttgtcctgtccccgtcatccttttccccctcctttcctctcgcttgcgtcgtataccccttcctcttgaggtctttgttagctccccccgtttctccgttttctttgtgtgcctgttcgttctcgttcttgcttcgctctctaagtttcccgtcttccttctttctggtcttcgctccatctctccagaccttagcacaggactaccttctctttcgtaagcgattgtgctgggtccttttccggtacggcgtgatcgaccgcgtccgtcgccagccttttttgggtcaccgctctgagcttccccagttccttcctttccctccgcttcttgcgctctttccgtggtgcggtgtccgcctgcttctcccctttgtgtgtcttcgtctctcgtttgtccttcgacttggcaaga

SEQ ID NO: 3809 - DNA, 3691 bp, Toxoplasma gondii
gggagacaagtgtccctacttgagtagaatcagtgcgtattttgaagcacctccaataactgccactatccatttacattggggaagagacgagtgaaagatccactagacgggagtgggtccccggttggtgcgctgccccgtggagtgacaagccggtgtagcagccagaggaagctggtgaagtgtcttgttgcttccgtatttgcgggggatgcggcaatactgctcaagatgaaactggaatttggggagagggcagagtaccttatcaggggttatcggaatggacataagcacacactcgacgaaagctccatacgtcaacggcgctcacgtttgctgttgtcagcgtccacacaatacgttgctgttgctttgccattatttgcacagggctgggctccacgaactgggacgcctaactgaatgccagccttcgcaagactaagcagacacatttttcgtttcagcgaggggaaggctgacaagacagggacccgcggtaacgccttcgcttctcagcggctgcgatttggaggaaccgtgccccgtcaacgacaatctcagctggttctcgtaattgacttcctgcctccagaaaagtgaaattccactctagcttccgtgtgaccatcgcgaagaggcggcgttcgtcagtctcctaacggctggtaatgaacatcttcggaggcaagtgtaaccggcagtgcgctggctaacacggccgcggttctgctgacgaagatacagacgaaaggaagactgttcacttaattttccgggagaggggaagccatatcctctcaacaggatgcagggaatgatgcctagccgtaattcacgcatagaaggcgagttgaggcgcgttcgaactgaaaaggatatcgggcaaaacttctggattaaagaacggcggcaaagacgtcgtccggaagaagtctgtagctagttccttgctgaggatttgttggcgtgcgtttgctgtcttctgaaaatgtctgactactccttccgccgcaagttctcattcggatcaggcatgccacggccgccacttgcttggtcaggggacaaaaattgggaacctacgtgaaattgcgatagtgcgaggcgactcagttgcttcgcatgtgagaggatactcagcaatattgcaaggactggttttttttcacggcgcgttttcactgtgcaaaaaacggacccgtttcttgagcgggaggagagggcgtgagtgtgtatcgacgtgaatgttttcctccagactctacacttgacggcactgcttcagaaggttcctcatgacatggtagaaaacaaacggggaagcattcataaattcggtttcacaggtcgcgcgagcctcggactaaccgggactcgggcacccgatggtaacttttgttgcaaggtgttttttaagttcccatccgcgttccaggttaaggcaccacaaaaaagggtaaggtgcgtcgatccagcacgtgacggtttattcttttttgtcccactctgacttcatttcacctttcggagtcatgtgtcgccgtctcattttccagaaaactagggcagcgtcttcgagtttcaagtacgtgcttcgcaatacctatcactgttgctgtttggggcaacggtgttacgcatctcagagagtgacgccgctacagttttgcccagctggggctgaagatacgggcgcaggttgatcctttctgggaagcatggaatctttgtcaatttcaattgccgtcatcactagcacgacacacgtattgaaaacagcgttgaattccacacctcagagtgaagagagaggcgcactatgctgagcttcgttttagaggggcggagtacggctttgggtctatcgaaactatcaaacctaggaaacactatgccgctcatccagtttgtggaatcacatatttgtcacactttataaccaggaagacctagagcaaaggagcagaataacccccagtgctgaagtgttgcgcacctaagatggagtcgcagttattggcgcagtgagaaacattgcttattgcggttggaaaagctggctttttagcatcagccactccaccgtacaagcatgtgtgtgtccagtcggtttgaagaactcctatgctgcgcaacaatcatcgggatgaattgtgggttccccctccaagcattggcgttacggaaaatggaaggccaaagagacgcacatgtgctcgagcatgacatgagcggtgtcataactgctaagattgtgccaaccacgaccgattgcctagtaatcagtgccacattcagacggtctttcccgactgtgagctattctcaagatccgcagcaacatgtgagacaaagaggtgctgtgtgcagtttacactgaggtggcgataagcgagctacgcatcgaacgaccttgttgagttgatgcgatttcatctcccgaaggttgaaggatgacacttcgttgaatgcaaagtggcctacggaataattcatgtaaactgcaatcgccgccgcggcttcaacacgcggaagagggagcggcgccgcgacacatcacggaaatttgcccgacaagaaatgtgaggagctctctacaaagccttcctcaaacaccacatgctctgaatgacacttgtatcatgtgccaagtcgtgcttagaaacccccgcgctcgcagcattccagttgagtatctcaacagcacgaaacgtaacgcaccgccaaccgtgtttgcagcggcaaggacagtcctgttctatgcacaactgcgagtcatgagtaattgattctccgcatcgtttttacatattttcccctcacgttacttctgtatctcgaaacaagcttatcagctatgaatatgaggtaataactgtatctgccttccacttttcccccgtttgcgaacacgagctggacgaaccttgagtcgcgctggtgcgccagtgactcatcgaacgtgtggcgctcagagtcgtcgcctctaccgccaaatagaaatcttttccatggaatcgaccgttttacccctttacagtctctctaccttctttaaatccctcaccagaggttgttctccttgcgttgaaactcaccgtcgctgggttggcagagttttgagcgttcagcggtggttcgcggtgagtgctacactcgcgtcgattgccactcctcgaatttcttttgaggactaactgaggcgcttacttctgcaaagactccctcattcataatttcctccttcttccatccaaccgggtcttttttgctgttcctgtgtaatttctgactgacacagtatccactgttgtagcgactcagttttctaaccaagcggatccgcgccaagcaagaattgtctcgatgccttcaacattcaagtgaatttgaggagccccccttgaactagggctttgcaacaatcttcttccggggcgtgtggtaaatcccaggaatagcgagggtttcctgccatcacactcctcactggctgcgaaatcgtcgtactggctctgctttttgagaatcgcggcacggtgatcgacgagagcaaaacttgacccattggcatttccactattcaaccaaggcaggtttttgcagaggtgtccttcagtgtcaaacgtaataaatccctccttaagtccttcccgtcttcctttctttcgtctgagcaaca

SEQ ID NO: 3810 - DNA, 4760 bp, Toxoplasma gondii
caatgcgctgccggaagaagcacggaagggaagtggatatacagtaggagggaagaaccctcggatgcgcggaactgtacatcagattccgaggagccatcgagaggaccgccccagcggtcaaggctccacgcctcgcatgcagaatacgaaagaaacgacaatacagcagagccgcagttaccagctcactgtgtaggtgcgaagaaataaggtgaaaacgattccggcagcacggaaaaagcggttatcgagtagacaaagttatgaaactgttagcggagaagagaaaaagagcgtctgaaatatccttcacatatgtgttgcggaacgtattggaaagagggggcgtagcaaggctttcacgctcggtgtactcgcgatgtagaggcaagtttggagtccttcttgttcattctcggtgtctccttccctcaaatcacgcctgccccctcaactatctttctctgctgaaattcagatttttcttcgagactacacgcaaggcagacgtccgaaaatgaagacagagggacagcccggcctggtgcagaattcttgcacctcacagagcgagtattccgttgaaaaggctgttagaaaagccttttggaagcagtgcaagtatgtgaaggctgctcaagcgaccactaatgaaaccaacaagagaaagacgagggaaagacgttcgaacaatgacaggcgaaaacacgtggcccacccgacacagctaggactgcattcaccttgtggcccttcgttggggaaaaaaagagtccggatgggccacacgattataaacaaggagattccagtggtaaaaagtagctacagctcgacttcccgttggacaaaagccgccgctcctactggcgctggctctggcgccacctaggaaatccccgataggaaaaaaggtcgacaaaaggcacggcaagagttgaaagccgctgtcggcgcaaacacgcccgaaataaccgtttcagtgcagtgggaagagatgaaatttcgaaagggaaaggacgaccacgcttttgaaactgtcgcttatctggaggggtgctcagacggagttccggaagcaatggacagtagagaacggggaggcgcctgcgagtttcctgcagcgccgactgatccacgagaaaacaacagagaaatccagtctgtttgaagggggtgaacgctctccgtttccctttcttgtgatgacagtaaacaaaaccagcgtttacttttcgtgcatgcagttgagagaacacgcctaaggtggacttcgtcgcgcccgcgcaggcgcgaaaccgacagtgtggtgtgctggcaagcttgtgttccgtttgttgggaaaaggaaaggtcatttcatatccaaaaacacccaagatcctgcaagttcctttacggatcggtcaagtatgctcaaggatcctttccgcagcaattgttgcaacaagtcgcgtgcttttctgcagcttcaagcaggagtttcacctccatttgcaagtaacgacaacaggggaaaattgaaacgtgaaacgaaaggaggcgcgtggttacacaagcttccatcagtggcaaaaacacttgaccaaagcaaagcagaatcaggtcaagaatgtcccagatctccttgatattctttattatattaatacctggtgttttcctggtgtagcacgtgcagtacccctatatggaagctaccatactatctggaactgtacatcatgatgacgtactacaaaaagtagagcgtctgtcgtacatcagaactagacactgctaatgccactgtgcagtgaatgtacataatccctgcccggtgctctaacgtgtaagcggccgtattatgatggctcccagaatgcaacaatccaaatgattgaatgaggtgaagaacctgtgttcacatggtacggatttagagcacctccgattatgtcctttagagaaggtgaaaccacgtcggtcgaaaggtaagatggttccttaccgtaccgcgcagtaaccagggttcaggttcgtcttttgctgtgcctgttttggtgcagtcaccagaagacaccaagtcttaaacatgtctacacgttcgatactaatatcagaagtaacaggtcataacaggtttctctagaatacagcaaatagagctcaccgcagcgacagaaacgaatcaccaacaagaaacgagaaacccggtgcgaacaacatcttgtgattacacgaaggcacagccgctctggacaaagggtttgccgctaaaaagaaaccttgatctgacatacgcgttccctacgcgggtagaagaataactgctaccattcccgagtagcgcagcatggatatgcccaacagcaacataaagagtttaggctttccatgaattctgtttgccagaacaggcatgacagtgccaccgtgagtgcatactatacagtcacgccactatcagttaaagtataagcaggcttgttcactgttcgcggcacctcagatacaaacgcgggaagcagccgacactccacgtaactgcgtaaggaagctgatggtgttggacctcaatatcctaacggcattcgtgtttgcttgaagcctgttgtcgttaacgatgttgattcagtgtcagcctccgaccttggtcacacaactctagaggacaacgacacgctgtgtcagaacagccctatcacacacttaactcggaatgcgagaggaccttggtatgcgatggaaggtgccactaaatacgaaatgaagtgggacggactggtgacgcaaagcaagaatcttcgagcttcacaaaagttgcgtgtgggaggatgttcaagcacacattgtgtccgattcaccgagatgcttgtctcgtgccaaatcgctgcgtgccaagtggtgcatgatcattagcgtgcatgaggttgaacttcctcctttcagctggatacgctgacgtcagtcccgagaaactctaactccgagtccattgtcgcgtttaagtctctcaaacatcatggactcaacgtgtaccgccgcatctgaatggtacttgtgttggtgagtgttgaacttgggggaccgagtttaatcctctcaagcattatgtagcgacgcatttgcctgtcgttgtgcctcgcagttcttcccaacccgcagttgagatatggactttatcatctctcgttcaccgccctgaccctgctacgcttcaaagagagcgcccgaagtgcaggcagagacacccgagagcagcggttgtcagcgcgcttcttgtttcgtgacaaagcatctccaaaaaggctctgagtaaacaagggtccgaaaactctgcgttaccccgttcctgtctctgccgcttaactcgagcgaggcagccgactcactagcgcgcggtatgctcctgtcgcgtgtcagctggacagcccagaaaaaacacgtcgcgtactcctgttttaatacctccaggtgatctggtacgcctttgaagagcggttagcatccgcgaattgctctagattgcaagtactgtggtcgaaggaaaaaaatcagcagaaccgttaacggcagaggcgccgccggcgcggtttgtctcgtcggggacggctcagggcagcggatgacacttccggggtcagttcgcggtgaatatccgttcttttttctcagatgccaacgcatcgactcaccgaaatctggtaagccccgaaacccaaaagtgcctttctggtcgctctcaaaggagtgtttttccgtcgcgaaccccgagctgcgattctttcccattcccttgagctacggcgagagaaacggttccgtggcgcgcgtaacgctgctgtctcttcgcatgtttctcgcgcttttctcccagagttaggagaccaccgattcggcggtttttcggagaaccggttgtcgctgtcacagacttgctttgcgacgacagtgctccactttctgttgttcagtttgagaattgggattccccccgtccccgcacaagtatccccgcacccacgaactggcagatgctactgggttgtcggcccggaaaattcctgcctggattttttttcactctggggattcagacgctacgagagaatacagcaggatagcgctgggatacaggcgatgtacgtttacaccccagggctcgaaatgagtgggatctcttgggcggtctcgtctcgtgttaaaagaagaaagtagatctaaacctgccctctccgtcgctctctctgtcgtcacactttgcaattttcaagcggacttcctcattccgaaccctctaacggtcaacactcccgttaatacgcatcggtgtgtcgcggctcgtatgtgcatgtcacactattctctcttctctatatctcatctctcttcaaattattttttctgttcctcttttcccgtgttcttcgtttctcccgaactttcaggcaaagacgccacaaccacgtccacagcttcatccttcttccccactttcctggctgcagagaggcgaacttctttctctgtatttttcttctctccccctccacaggcgaacttgaccgaagcggactttcttgaggctccgtggctccgagagcagaacgacattccaaggaaactttcgcgcgactcttagtggtcgtcccccaggcgttccagtcttcgaggtcttctggacctttccccgagcaggtcgtgtcccaaagcgcgtgcggccgcgtttctaaaaaacacctttctcgaacttccctttccacttactcgagaaaa

SEQ ID NO: 3811 - DNA, 2042 bp, Toxoplasma gondii
tcgttaatgtcacttgtcgttaccgagtctggctcgaacgaaaagtcgacaaactgatcgtcttcccccgcaactggcgtttgtcgagttaaagtctcaagttgttcgagcagatccatcactcgttgctctctatatttcgaatctgatggattcaatctggttgctgcagccttgacggagtcactaggcgcggttgatgacttagttgacttcagctccgaaaaaccaaacgcattcatcgtgacatcggcacctgagcgactgtgagacgtcccctgccagcttgatactctctcctctacgtcatcttcacccaccccgaggtcattcatgagctgttccaaggagacatctgcgtcctcttcgtgtgaattaatggcagagccatcaaaatgctcatgccgttgaacagccaccccacgacgaacacctctccattgcgaaaaaactccatcgcgtgcctcctcagctgctggggggaagttgatctgttctggcaagtattcgtcttcagtcaaagaaactgaccgtgctccaaccccccctatgtggggtacgtagaatctactcacatcactccctgagaacgatgcaacgcccagaatggctgacttaattgggatcccaagtgtacatacggaaagaagaagactgcacacgcactgtcgtagggaaagacgcgagattcctggtcctgggaccgttgtggctctatcctccttccccattctagcgtccgcagacgcgagctgaagcgaagacatgctcatgaggcacaacctggaacagccgaagtgtcctacacggaaacaacggacgtcacgatacaacgaccgaatgagtgcctgatacaactgaaatgaactagtaaagagataaagcacgatgaagcagaaaatagcacgagaagtagtagtttcataagcaccgaggagacttcgcgtcaacaacgatgccggtgtcctgggcaactcgggtcaacgcggcgggtcagcgttgctctgcgtcaccccatgagttggtgctgaaaataaataaaaaatatattgccgaggatatttgcagaaatgatttaaacgagacgcccttgcaaaatctcgctgccactcttgacggcggcggccggctgctatctaggcgacgtcgtcaaaagaaatgggtgacgccataccatccccgaaatcttcttaaaccatgcgcggcagatgatcttaattgctgaacaagggtgattgcaggtttaaaaaaatagcagagagacagtcttgtgaagcatggctgtctgctgctgggatacgctttgtcttgttgcgacagccggcgcaagacagccatagggatctagcagctaaaggaaggcgccgggctcaactgccgcccgcaccaaggatcattgccagcgcagtgcttccgattttccaaaaaaacaattgtcacaatattctattgttaactgagcaggtttcctccttgcacaaaatttgtgcgacgcttgttaaggcacagaggctccacttgaatgatcaggactacaatagctgccagaggcccgcgcatggctccagcccttctggcgcgccactcaatctccgtcgccgcacgtgggaatcggtggccacatgcagcgagagcacacgaccgtcactcacgtggtcagcgcggaaacgttgccgccatcaaacagcggtgaacactggtggtacgctttgcgcagcgcgcggtggctcagttttcccctgttactgtcctggggaatctccacgtcgtttcagcggaacaatgtggaaaggcgatgctagtctctagaaaccttctggggaagagaatcacagatgaatgaagccgcccttctgactgatactccaccgccttacaggagacaactagttcccctctgggaaacttaaccagtccatcttttgccgatgtcttccgcccgtagccaattttcgcagagggcgatagcaaagtcctcacccttctcggtcttgatcagaagtcagaggtgctaacccgtaccagtgtacaatgagccaaaa

SEQ ID NO: 3812 - DNA, 4655 bp, Toxoplasma gondii
caacggtgaaggacgcagacaaagagagcggctcggaaatgacaactgcgaaggaaaatctttaagaagagagcaactcgacagtggcagaggggaaagagtttcgagacgcgagggagtcggaagagtgacagaggagactgcccttgcagaagagagaagtggggaagcgcagagacgaaagacgcagcagaggaacatagacaagagggtcgggagaagtcgggagaaacgagaggaaagcaaccgcgttgtctgtgtttgcgaactctcaaactcacgtatttggatcttgaggtctcctctggtgtcttcacagacggcttcaatgcaaccttccccggaggatgctcagttccaccacagacatttactccgtctcttggcagtgtttggcagcagattccttcctacagtatcggtctccgctggtcgtcgtcgctcgtggatccttgcaacatttctgcatcttctgcagccacgagaaacgcaaactccctggggcactgcacgggttccctgacaagcacacgtcaagctgcgtcgacgcgcgaggtcgtcgtcttcaaagtcccgactctgttcaatgccttgggcgaagcaaccgaagaaacgtggaagaatggtggagacctccaagacgtcgggaacaaagaggcgcgtggtgtaagaaacggtgcgaacagagcggccgggttcatgcctgtagcgccgatagccttgagcgtgtctcagggaggcgttcgggagtgtatgaacggtgtgaggaatttctcatgattgcctggtgtgtggaatagacagaaatcaccttgacgtctcaaaaaaaacgaaggtgtacgactggaaatggccatcgatgtctgcatggtagaggtagcggtacacccagtgtgcaaatgccgctgctttctttgtgccgactcgagacgatttctccactggatttgtggtggatacaagtggactggtgaacgtgtaataaacagtgttgttttccttcgaaaggcggtcccatgtacgaccttgcagaaagggtggaagaggcccgtacaaaggaaggattcgagaaacgcttgcgaaatgcagaatcgcgtgtcgcgaggtgtcatatgccttgcagataatttcaagttggcgctgtcactcacatctgaagcctctgattctttatctctgagcagctgcttccttgtccgccactgatcattcgaactcctcgcgtccacaaaaaacccagcacgacgcattcgaaacatgcttcgcgagtgctgcacatgaaggatactgctgtagagagagggagactgagcgcatacacccatttagagaggagaaatatatatatatatatatgcacgtactgatgcaggtcaccggctaggcaatcttcagtgtttgggtattccccgttcctaaaagaggacctgaattgctttgaagggctacttggccttcggcccacgcctgccccgtgtcgatcgatgtcataccgtcagcctgtcgaggtcaccttagaatttgtggtctcggtaatgcgagagaaagaacgccactgcagttttccactcgtaagaaggcagcttgaaaaaggtggccagaaaagctggcatccatgtttcagacgaaaacaaacctgtgactgctgggcaaacggtgaacttttgattcagcagggttaggcgagagagaagcctccaggcgacagttcgctctcgagtgtgcctaagaaccagacccttgcctaatctgacggcacctcaacgcccgatcagagacgcagtagtctgtttcctctcttccggaagatatctgcaactgtcaaaaaagaggcaaccacgtgtgttgccttttcttctactaactggtccgtatttcacagggtttacctttcggtaactagagcaaagaccgacgcaaagcacacgtgtgtctaattagccctatcagttttcaatgctaacctacgaccggaacccaatggggtccgggtgcatccagtggtgccgtgactccttgtatgccatgtgaaggtgcaaacagaaatgcggtgagttcctcgcaaatgctggttgttcgctgtgtctagcatgcataccctgcagcttccatcggaaagaccatctctggcgtccacccagctacaggtgaaccggtactaacagaggcgcagcactagggtcaaaatctcagaaaatgggctgtccgcaccgcagtccagttgcgctatatctgcgggctcgaacctgcccggaaaagactcttccgcatccgtgtggcaagaagcgaacagcgtcggtcttgcagaagcgggatgcctagcagttcatcgggactggacacgaagcatctgccgcttcactcctgacttacaatttattcacggcgacgaagactgtttgaaaaaaaagcctcacgtgtaacaaaagggcaatatcgactctccacgtgatagttcgcccactgaaaaatcgtcactgggacaaattacaaaaccccgcagcaccaacgaattgaggcgtgcggtgtccacaagggtggccacagaagaaagggttaaacgacttttatagagatacatacgcatatatagcaagtttacgtctaccgacttccaccgtcggcttagagctctatgctgtgttccagtgaaacaggcgcctgcgtgtgtgcgttctgcacccagggtcgagtggccgccctgacctcgtgcatctctgcttatcctcggaagcttcacgaaaggagggattcggggacatcgtcactaaagagtctagcttgtcaatttcccgatgctatccgcctgctttgcctctccacttgtgctgtgtacgtgacagtgccgcacgggcttctgccacatacccaatattgtttacgtgagcgcgaggattctgaaaaaacatcgaggcgttgtgcccgtagaacgttccgaggcttggatctagagaaaattagtccttcttgtcgccggccgcaggctgctgcgacccagaagcggcggactggccgcggaaatacttgtgaccagcgtacgccagaccccccatagcgaggagtgaggcaatcgtggctccgatccttttcatcagggacgctttggcaggttgctgcgtctgcgacgcgatcctcgccttgttgccgtaagccgcgtcctcctgtggtttcgcgtgagcttcttcagtcgcgaaactcgcaaggcctcccatggtggtggcgtccccttccatgccgactgcgttctccatgtccatcgttagagaattgttgtcatctaggaaaggcagtgcggtcgtgactcgggtttcaccagccaactccggctcctggagctctccagcagcttcactcccaaatagtgaggtttcaacccccatggtttcaggtgactgaacaacttcatgctgaacattgtcagcctccggaatagcttcaggttcagaaaaaacttcgggcggaacaatgtcagcctccggaatagcttcaggttcagaaaaaacttcgggcggaacaatgtcagcctccggaatagcttcaggctcagaaaaaacttcgggcggaacaatgtcagcctccggaatagcttcaggctcagaaaaaacttcgggcggaacaatgtcagcctccgaaagaccttcatgtccaggaacaacttcggcctcgaccgattcaggttccggaacaaccccagcctcgacagactcagtctctgaagtaaaggggtgttctttgggaaggccaacgccttcagcgagcgcttcaagcgtgtcgttgaattcgttggaacccactgcgtctctaaagaaatcactaagacccgccagtccgccttctccaccgaagagttcagcgacctcttctaggtctgcggcctcgacaccgtcctgtgcagactcacctgcctcgttcacgtcgtcggcgctcggcaagtcctgccccagttcgccgcgctcctcggggttcgcaaccgtggcatctccctcggtgttgacgtctgatgcacgaactgacacaactccgttcggagcctccgacccgaacagaacctgagtcaaactcgcgggagagaggaggaaaaaaccgagagtcgccgccaggggccgggtaagggcgcggcggccgccaccaacgcgcgagatcttcgccattttctccgtaggccacgaaaaatcgtccgttctagaggtgaagtagtgtaggggtcgtagatgcaacgctccgaagacgtttttactataaaaaacgaagggcagcacagcttgaccggcggaggagcgttgaattgaaagcatactgagcccatcgcgcgtctacatcgtcggcaacacccgaccgggagacacaccaaaaagcgaacgcagcggcggggtgagtgaggggaaagctgggtggcaccgacgcgcccgcggaagcgacgttgggggtagcccaggagcagctcccatgataacagaaacctggggttaaagaagccgcaccggtcgatcccggtacctctttcattctaccgcagcttccagtgtactttccgcgtcaccaaagcggtcagtagaaccaggttcgagctgctgttcagtttttttgacgatcgacgcgtcttgcctttactgttgtgttcgtacgaatcagctgccgtttataggtaggcatca

SEQ ID NO: 3813 - DNA, 4308 bp, Toxoplasma gondii
aaacatctccggtcccattcaatcttctcagtaaggtgatgttgtgaagtccgcgttaggcactctcctttttgtgcgggttgatctcctgcagttaccactgacacgctgctcctgaggcggtttttgcattctctgtgaaggggatgtccgtccccgtagttgtttagaattcctttagttcttaaccacgccagcaagtgggaccgattcattcggaaagagcagtagcaagtagtacccagtacgcctggcggctccagttctccttaggaacataccacggtcctatcaagaaaactcaccatacagaattgccgaaaacgaaggcgacagtacttgtcacaccttttgtatcaattggcatccgaaacctcatccggcgtcggtagaggtgaggcccaacgggccgtcagaggacatcacctgatgcaggtggctaagggctcacgtaggggttgtcgcctcactcgtctgcggtatttcatgtcgggcttgagcagtcagtgaatgctctgatgatttgtggtagtgataaactgaacccaatgatcgtcctcgtcggatgcagcccacaattgaagcggcagaaccccaagtgtagttatcggtggtaacagattcactgacggcctgttcaggcagtccacaaaagcaaacgaatgtctttaattttaagctctctaagttgacgatttggcagcgaaggagaggttgtggtgtctccttcacatacggtgatcagcccgtggttgatccttttgcccccatgtcgagtagtgccacctatgcagacgctgaacaatgcttcgctccactttttgggccatccggcactgtacagacaccgaccgtgtgcgatagtattcagtcatttggacggcatcgctcgtacggacactgttttgctcgattgaaaaatatgggccaaaaggattttcccccagcgtcacggtacacagttgagaggatttgtggttacatctgcacagacgaatgaggcagcttatcctactttgtacaactgtactattactactgctttccagcacgccgcgagccaacgcacaagatgaggacgatgatgaggacgagcaggtcgaacctgaccagactgaagatttttctgaggaggatgaagactctgaacaacagatgaacaaacctgcgtcttacatggagccaagcataagtccggcaggtgcgtttgctgaaggtgtcgggcttaatgtcttacctgagatagcggttctccccaggctttgttcactcgaacaagtggcggcggtttaggtaacgacattagatcttggattcacacatagcttactaacgtgattgatcgaacagggaccgcctcgaccctaccacgcttcgtggcgatactgcgcctgagaggtcatttcgaaatcttgtcagacgtaagtatcttccgggaaacctcgtcgaatatgcaaataggaacagtgcctgtaactgctcgcagattactatgatgtcacagaagaaagctatccgaaacccgaatgataacacggagaacgcgtggagactgactgctcgttaagggaacgcatctcgcacatggttgttatatgcctggagttggtgtgtgatgtcctcgtagagacgactgcttctggcgtgctgctgtcacaactccacacgcaagcattgttgttcgacaaaaccggaacaaaagagtgtactgtggttcgccggaagagcgacgtgagtaatgcaagtactctctcgagtgaagctaagggaggcgactgccgaacgccaagcaccattctgcttctttaccttgcatctctgccaaaatgttcctaccctttgccctcgcatttagggaaccactgaagaacaatacagagccgtctggtccctgcttgcggtaactggaacgggtgctagggaggtcgaaaggcgtagtcgcactgcagctgtttaccgacgtctggccaaggacaacatttctataaatcatggtttaacaactacaaaatcaccatatcagacatcttacgatcaccaaggcaacgttaacactaactgcacgcaaaacaacgaagaccaagacaagttgtcattggtagccggccaggcgccactacttttgcacaggaactctcaggaggacactgcagtattgtacattttccactgcttcaagccctgaatcagatgaggatcacgcaaggactttgtgcatctgattgagcgaacatttgacctgacttttcctcgcgcgtgcccctggaattgttttcctcgggtactgaagtgtttgcgtgattggaatggttcagttccacacaaatcgtaggacgtttccagcccgcagcagaaagtgtcttcgagtgacacatccctcttagaactatgagttgaagcatactgtgacttctgggggtgtccgacatccctacctccagcaaaaaacgccgacgacggacgcatttgtgactgagccctcgcggatcgaagtggtggaccatttcgtctgttttagtacctatttaccaccactgtgccactgcttaccctccattccttgtttccaagtcgaactgtagtcctggagcctggtatctcagacaaactgaggaaccaataacatgggagtctaatgccagaaacagtttagtaataaaaaactaacgcctttcagcagctactcttctacgactcctctcagcagcatcacttgaaacttcagtttttcttgcaacaatcgctagaccaacaagacttttgcatttcgtgttgcctctcaggatttacgactttcagcagggtagaccgctgcgtatgacttcttcaaacttgtcactctacatggtttcgttattgatggctagacctagtcagagacgtacaatggaattaaaaagtgtggagagccagacgttcaagagatgttgacagtcacgcggcagcatgaagctccttgtagttcctatttccagggtgactcctagtctaaatccacagcagaagtcgatcacaattccttgtctacaacgcgacgaagaaaatgtttttgcagtgtggaaacaacgggaaactgatccagtggatacataatccaaggacacacagaaacactgagccccgtcgagccgttggtggcagcaccgcgccgccaacaccggaaaatcaccacgcacccatcgccttctcgagagcggcgagtgacctgcgcataaaatcatatctcatcgaagaacccgaaaaactaacaaatgaaattccaattgcgattggaaacatgtgcggaagtgttctcccgaaaaaaacggaaggcagagtgtgccttcaagcccaagccagtggaatcgtggggtaccatgctgaccccctggggtccgactgcttgggtaattccgtgcatgcaccggaagaaacgtcgcatgggcaaagcacagccgcttgtgcgaacatttccttcatttcgcgccctcgctaaaggaagtgtccttggttgggagcggcggagctgaccaaggaatggtctagattcgcgtgccacttttagcgccgtcttttcctcctcggactccttgttcggggcggcgcaaagcttcagcctttgcccgctgcttgttaacccgttggtccgcggacttcttgtctcttcagttctgagcagggtgtggcttggctcaaccgtttctttccattcttcgtttcagccaaagcgcaggcgcgcacggatgtttgaccaggaatgcaggagcagcgacgtgcagctgtgcgcgtttccgtccggtttgcagtgacgcgcgtttttggctctaaggggtgaacaacgagattcgtacactttctggagcttcctttcgtttcgagtttgctctttcccagtttttttttcgcttctgttggcctggatcggaagcctgcaaccctcgtcactgttcgcttttcgtcctgtcgcgcgactcgcattcgtctctgtgcactccgcaagtgtcccgaaaagtctggaacctctcaggttcccccgctttctgcaacccctgctgctcgtcaggatccatctttgtctgcgtggacgcgttgaggatctacttctcgtcctttctgtcggctgccttcttcgtgaacccaggcgcattcgctcttctgccgccctccttttcgtctgctctcccggagcatttctgctccgcgccgcagggccgcttctcagcgactcgcgtgcaggtgcctcctgcagttcctcgtccttcgacaccgctgtgtgtcttttctcgccgtcacgtccctcccctccactctactccagttgagccaaca

SEQ ID NO: 3814 - DNA, 1674 bp, Toxoplasma gondii
aaacagacgatgtggagagcggcaagaaacaaagtcacatccagacctccgttctgctcctctccaggtaggaaagcgagaggaaggagcaggagagagaaaggcggagagaagcgcaggagaagagacaggtgggtccggagaaggacgacgaaaagaagagaaaagacaacttggagcaaaagaagagaatggagctgagcggaaggcgaacgtgtgtctgttagggtgtagagaggagatggaagcagcatcgacgacggaagcgaaggagagaactaacgcgaaaaagcagctggtccgcaagaggcagaaagacgagagagagagacggcccatggcggccgatctcccgagacacacagaggtggagacgcctctgaggaagttaagacctcggtgcctgcagcagacatcgactctctggagagacgcatgcgcgagcagaggaactccttctgctgcgtcgtctcttcagacgcgagagaaggaaagaccgagacgacgagagcacagagaggaagaattgagggagagagcgaggtctacggcttcgtagccgcagtcgtagtggcgactgcggaaatactgagaattgcgctcgcgagttcttcggaccaagaatctgcgtaaggcgcttcgaggaagagaagaagagaagaagaggaagagaaaacaagacgaaatcggcgcgaggaaacggagatatctactccaggcgaggccggggctgtgcgacaggagacacacaacgggcttcccgattccttttacggaggaggagagacaacctcgtcgtcgaagtggatgaaacctggggagaacattgccttctgcgcgaagagcgagaaagagcagaaaagcgtcttttctgtcttgcgactggcgatctcccgggtgcgctgcgcatgcacagttttttagaacaagacacaggagacaggcgagtctccggtttttccgcttcctcgccgacgcggaagttggactgaagatgtatcgcaaaaaaaagcagataaaaagacgcctcgatctccgtcccgatctccagtttcctttctctcttcttcctgtctcaggcatgggccgcgcctttacagtgtgttccctctctctcttgttgagaggatcaaagtccagcgaacaccgcagcgcgtccgggcaccgagagaaaaaaacggcgcagctggagagactcggaggagggccgttcgattctttgtctttctcttcaaatgctctgcatctctgaaaaggctgagaagaaagtcggtttcgaaatctccactgcatacagttctgtctcgcgctcacttttccctttcgagtccaccccggaggatctgtgatttgcctgcctccttgctttgtcgttttcttcagcgggcgcggctcccgtggcattttcgtgagtttcaacttggacgaaaggttcctttcttcctgatttctccaaaagtcctttctctctcatccaggagaggagaaacgcgtcttctcgcgccgtcgccgaacctccgcgcggtgtccccgacggtgccggttctctcaacgcatgctcacggcccggtgtttcagctgcgtcgtctacgctgcaggaattttgaatcatcctcttttcctccgttttcaaattctccagagttcccctgaatcccctcctaaacaccacca

SEQ ID NO: 3815 - DNA, 4223 bp, Toxoplasma gondii
taccaggtgatctaaaatcgcaatgtcggtttcttgtgcctatgaatctcattgattaatgtgtcacaggcagtccatcttcagtcgccgtctcactgatatttccagatacgccaaggaacagccacaacctttcaagtggtcgaaatacccaggcttcgtacaaacaacacggaaaaaagagatgcagagagacacgtgcgtctcggtgaacgcggctcaaaggcacccgagtgtgtgtggcgagtatatacgttaatgacagagtgtacgcagaaatctggaaaacgcagtcgttcccatggtgtgtgggggcactgaccgcaaatgtcgttgctcttacacacagagacagacacgtttcccttggagactgctgtcgctcgtctttgcagcgacataaacgactcggcagaccctcgtatactctgtaacatcatcctggagttttagcatctcggagacatgactatttgtcagcgccttgtgctcagtagaggagagcgacgaaaccttctgctcctggatgcacactcaacagcatgcatgcggtccggttgaatccctaaaaattttttttcttactgcattgtattgttccctgagctgctgagtctcggcttggagactgaagttggagtcttccattctcgtacagtgctcacaaaaaacgcgtctttctttctggacacgtgaccgtcaccctgtgacgcgagccgcagaagcttggcgtcttcggtggctgaggtgtgtacaagaggttagtccgatcgctgagtcgaatgtgatgagagggacttgcagttggatctcagaagactgcgctgttcttggtatcttttctcgaatttgcagccatggacacggctaacaacgactgcgtcggctggagggacggcggagttcgtgcgaggaaatttcggaaaagaaactccacggctctctacgacagcgctcgatgcaggggaagtggtgggaattctggccggatgaaagcagacgaaaacaacagaagggctgttgcgagttaagaagcagcgtctcggtcgaggttccccgtttcgcgaggcgagctccgtgcaggggaaagcgggaaaaagacgagaaatatgaaagcgaacgaccttccagacaattcgagagactcacggacagggaagcccgatcggcagaaactaaaaattcacaccgtggctgctgtcgctggcgttgacgactgtgcacaagacacaaaccgcggtgaggggaaaagggtggctcgagggagacttcactttaagaacgactgagaaacacacagaaacagaagaccggcgcttgagtggcgttcagattcatccgtcaggcgcagaaatatcgtcttttttcccaacataagtatccagcatgcaagaaaagaagcgccgcacgctgcctctccgtctgcttgagagtagatggacacgaagtcggacaaacaggtgttttccacttttctttccaatccggatggcataactgttctcagcggacgtgagggccgagtggaaaagcttcctctgcaactaggtggaaataaataacaagtgccgccctgtttgtcgtttgttttttgcaaaccatagtggttcgtcctttccccggtgcacgtcttcaaaagagacaaagcggatatgattcaacgaaaacgtgagaaaagcggttcgattatccaccactgcctaaccatctgagacatatacaacaacatgaaagccagttctgacaaccgcggtcagtgagttgtatcgtctgaagaccagcatatatgcacagcagtttaccagcaaattaacgcacggacaaggcacgtttgacgatgcattctcctacctacaaaaaagacgagaataccgcaattccgttgtcagttgtgttccacagcgaaccactgcagatctgaaaaaactatatatatatatatatatatatatatatatatatatatatatgcgtgagacgcggagaatgaagcagacgctctccatgaaggaattgcacaaggcggtggcggcgaaaaggcgcgacagatgaggggaagaaacactggaatttcttgaaaattatctgtttcgatcgttgctgacaaatccttttcttaagctgtttgtagttcgggcgcctcctcacctgtttctgcgtgcgtgggaagacagcacatggacgcatgttgaagtatgcaagcctgttgtaacagaagccgttttcttcagaattgcaccgggcgtctcttcagcccacgtgcagcatgaaggaaggaagtctgttattccctcagggcaatcgttgtttactcatgctaagtggaacgccactccttgcgcatgttgcagaatatagcaaacagaatgctgcaggtgcccattcaagttctccagagagacagagactaaattgagacagatgtcacgtaatgccatgaaacaaaccatcttcgtagaccgcgaaaactagtcgcaacgttgacgtgttttttaccactgctggcggacagccatcgctacgaaataaaacgttctgactgtcattatctgagttgtgcaagaagcgaaagaaggatgaacgctaccatctgcagctggtgaaagtctgctacttccattgaaaggaattctctgtccggttctactgtagcgcctcaatgccaacacaatctcacatgtagaacacgggaatccaataaccgacgcaaggggagtttaccctcgaggatgccttactttagtgcacgtaatgtttgacctattcagtcgtgtcgaagtgcttcagatttctgtcgtttctttcataccgatcctaagaaaggagaaacgccctccccaaagtggttaactcgttgtgaactcttcctacggacacgaggcagcttgcaccgtcgttagtttcacgctagaaagaggcttcctctctttgttttccactgaatcgtcgacccgagacgatctaaaactttgtccgcaacttacatccacaaagggacataatgaatcttggaacggtctatagtggtcttcctcctcaatccaagctgaactgtggttgatcaggactgaagtcctcagaactaactccgagctgatatctgccggagcgcattcagctggaggtgcaaatgcgcaggaaatgtgcacgtctatttgcgtttgtagacactcgtttatatccacgtgcacgttcatacgaaatgttctatgtccccgtacgtgaaagttggcaactgccacggcagcggaaaaaacaaagagatttctgctcaagagcgagtgctagcctctctccggagaatggaaatcgtctctttcttctgtggtcaacgtatccttcgcatcgagattgtttgcaaggaagattcccaacggtcttcagcgcatgcagataatttcatccacgcggttcagctcgaccaggcaacatttggatgaggtcattccaatgagtcaaatggcctgccacttttcctgcgggccaccgcgtagaaccagatcaaaaacgaatttcatctcgctgtttatcctggtttttgcgaccctcatcgtaagtaacctccgcgatatcgtctcctgcttttccgcgctcgaagagccacgcatgacacacgttccaaaaacggacaagcgagacactgcttcttcaagtggagattttctagatttccaagctccaattctcgagacgaagaacttcctctcttcatttgcttgccgagttaagacgacactcgtgccaaaacagttcttttgtctgcaactgcgcgaacccgcgagttgtcaagacggctgcgcgtcgattccgggcacagtttgacgattgcgttccagttttccctcgtcttttcctttttgctcgcgacagcgcgtctcccttccttcatttacatgcagattgctttcgtgttggacaagtcctggacgaaatcactcaactgtcacaagacatcgcacccgcggtgctcggtgaggagcctcaccatttttcttcaacttaccgcagacgtctgattctgcgcgtgtacatgcacgacttgttgtttccctccctatctactgtgtgcctgcaacattctcatccgagcaactagggcctgcaggctttcgcagtcgtagattcgcttcccctctctttcgagctgtcaacaaaccgatatagaccagtgcatgcacccgatgtaggcatcctaacacgctcgttttacacggtggtacgga

SEQ ID NO: 3816 - DNA, 4308 bp, Toxoplasma gondii
tgctcaaatgtttgttgaaaggattccgtgcatgtgctttttagagagatctgtccaactgggcgtcccagggcgaacacagtgaagaagagctttccgagcacgaggcaaaacgacggcacagcgaatcgtttgtgggtgaatcaaaaatgtctcaaagagtggaaaggaggggaggtgggacagcatctgcttggtgaaaatggcagcgggtccaggtcgagacactggagtacggagcgaaggaatcctcgaaggaaattgaaactcgcggtcacaaggttttgtagtttctcgggcagaaagggttacgtatactccggagaagcgacacaacgcgtggcccacagagacgaagaacggcttccatgggatgagtgaagataaacgaattcgtgtgtcgactttaagcttggaaaaccacggaaaaggcacgcattcacgcaagtgggcatcatgaattttacggcctcgcacgccttggtagatggcttatcgagaggtcatgtatgtgtcagtggtttttccggctgctagcgggtacagtttcgaggattacacgaagcaacgacggtgtgtcttctcttacacgtcctcggatgcgtgcttagcatttcttgtctagatttcccaatgtaaaggctccctctcacacagaggtccagccacaaaaaaccacgatgataggcaagttctgttggcagtgtgacggccgagtggaaaccagtggcagaggtcgcacgtttgtattttcgagttggacgggatgtttcgcttccttttttccagcttcaccgagggcatcgcaagcatcagacaaaaagggagcttgtgggagatccgcgaaacagctgaggcgcaggtcgacctttacacacacggggtgtagatgaatttgaatgaatgagaaagttccttgatgtgaaagaaatcgttttttccatatagggcacctcgaagtggttttcgcttcgacacggaaaccgacaccggcaaaaaaaagtaccgtaatgtcgcttccaatgtacttggcagttcacagttctctttgtcatgaagaacaaagtggatcgtcgtatgggatttctcaatatcgcccactgggcgtgaagaatccgagttcttgttcaaaactcttggttcttggtggcggtctgacccgaatggagcggaagttgtaacatttcaccccgctacgtaatcgttgtacagataacgtcacctggcgtccactcatgcgaagaaatcacaaaagcgctttcagtcgcatctgtgcattagtatcgagagggaatctgccgcgtatttctctaatttcaaagcccgatgcactgcgtgttggtttggtaggagagtagaaaaacttcctgtagacgctttccttgaagcaccacctaatgtcacggatgctttccaatataccggtcctaagttcttgagtgtgctggaaccacagggaacaggacttgtgactggagttttcgcatcgcatgcgcaattctggtgcacctgtttgtgctgtcaaaagtgtgttcgacaaccagggacaagactcgaattatagtgcatggacagcgtgcagtaggtgtgcttttctcgggatatttcccactgttcgaagcggtaaggtatcgctagcatttctggggtgccagcggcacagtaaaaactctccagaaacttcccactatttgaccaaatgtcgattcaaaacaggaaaaacagttgggccgcataactcccgtgaaagcgttccagaggaatacactaacgttcaacagaaaaaagaccgatagacagggcagttgcatcaaaggactggcatccacgtgtttacgacgtgcagctgtccaagcacgatatacaggtgaacagtccgttgcagatgccctttgtccttcggatgtaaacaggtggtgccacgtaagactccgtgggcaacttgaactctttcacatccactgactccggctgtctttggtagtacgtgccttgtgtgtaggctgctacgggtacgtccacttctgttgatcggagcaacaaacaaaagcacagcgcaggtcgtcagagagcacatgccaagggtcagattgccatatttgcattcgttaacaaatggcacaattatgggggaagcagcgacggcgcgtcacagcatttacgaaattccctatgcctcgttcgcagagtgttctacacaaaagtcctctcgtgaaagccgtgtttccatcgttgcgagacgggggtggggggagagaatactgcgataccagccgagcaaacagaggcatgcattcataaagacactgggtacaatcgtcgtctagagaatcgcctctacgtcacctacagagctttcttaaaagacgtggattcagtatcctacagcgctccacttttttctgggaaggatatgctacgagttgaacccgcacttccctggcaaatcgcgtgacttctactccactgtgatcttgtttgagcagcaacagcgaaacggtaccagcaataaaacatgtgcacacctgtggtcagtctgtgccctgaaaaaaaatacacatttcctgattaagagataacgtaccgatgttcctgccgtagaacgcggtgtcttgttgggtttctggtaagaatgaagtccatcgtctgatctctgttttcgtgtgttgccgacggagtttatcccagtaggtgaagtcatgaggttcctgctgttcagtgtcgcctctcataacagcccaggtctcctcaacttcgtcctccataggcagaattgctgacacgccgcggtacaaagaattagcagccctcgaagaagatcgttggtgcatcgctgtgtgcaccggctcgggcgctaccgtcggctcatcatgttcttctgctgtgaatgcataaacgcagacattgcagactgagatagtcgtcattttttgtcatatgcgaccagacgaaccaactcttcccaagagttgccaagtcacaatccagaagcaacgccgagtttcttgtggaaagtacaaggtgaatccctcaagacacacgctttgccacaatcttcgtgcacgtgactacgcaatttcctatcgcgccgctgcaaccttctaccggttacacccatcgtctgtgaatgttggataaaaggtactcatatgaagctttcagcgcgaaacctagttgtgtttcctcggacctatgtcatatgacccttcgaaccgacgactaagcaccttggctgctttcaggggaacggggaacagctcgacccgtcccctcctgctctctgttaccctaaaaacatgcaacggaagctcgctaactctcccacttctttattctggtgtgcacctttgtgtgcagttcattctttccacttacacctgcatccattttgcacgctgtcgccaaccgggatagtggaagcggtttccggggccggtgccacaccggggttgatcgtgaccaggctggctggacttttcacttcacccagcccttgaggaagtggagtgtcgtctgccgaaattgtaaccgacactgacgggcagttgatcttgaaagttctgtagactgggatttgcggagggttttccattgtggaaagacgagtggggatctggaggggctagccacacgcgtgcaagcgagcaagctgtagcactggcgtcgatttgtgccttgcagcggtcaagatgaccgataacctatatacctttggggggaaaacaaaagaaatccttgcagtagtagggacttctggaatgaaggaagaaacgtgctgaaaggaaaaatgaagtgtgccaacacagcactcctgtgccaacaggaggcagaggactcgtgcaggcaggctctgctggcttttgcctcccgtgcgcgggagagaatcggaattccttcagggacgggacgagcgaagcgtgtgtcggttgtctccatcgacgcatctttcgcgacacaaccgggctgcacatgccgggcgtcgcatagcttgcagcctgtgctcaggctttcccggaaaaaccgttttcgcgttacggtaacatgacggttagcttctgtcatctcttcatttcatccttcatcacggcccgacctctcctggtattgttcgtggttttcgttgctacagaagtgtgtagtcggacgggaactcctcgagttgtgtgaaacagttcactcggtcatcggcgagtttcggcgagtgtgccttgcgactgccagtgtcagcacaaagccgaagtgcttcacgagtatccacggcagcgtgtgcagtaaccttcctgtttaccccgccttccacaccaaaaa

SEQ ID NO: 3817 - DNA, 1678 bp, Toxoplasma gondii
ctacattctgtggacacacaagtacggaaattcatgtgaacgaacacgggtatttactgtccggtcgactccacatacccggagattcggaggcaaacacggaaaccggtccttgccgaaggcgattcacacggtcttcctcactgggggtgttgctttcgctggtccctgccggagagggcagcaacgaggacggcggcaaaccgagagcgatgccaccatcgggaaggaggagctgtgtgggcactgagaaggaaaaaccctctgaagaccgagaagtcgcgagcaagagagtggacagcgacgactggtgatacaacagtggcattcccgagaggagagccgactgggagagagacgacgccggcagtgaaacgcgaacatgcccctcagtgggagctggggcagcacccgtcgccattttcacgcggaaacacactgcaagtacggcgtagaaatcacgctcacgaggcggccccgttttgtgtgaaacgggaaacgctgacggggacgttgaccagcactctgcgaatttgtctgaatcgttgtactcattgacaaacttttctgatacaggcggaatgaggctttgtatgtggatactaaagaagaagcggatgccctattcagacggagagacgtgcggattctaccgtaggaacatggaatgcttcatgaagcatcactgcattttacgcttttccttctggatcggaaaccgtcttcgcaggtcccattcaaacacacgatatcgaggcacgtgacaccggcaacaggtccatgtatctgtcccgtaatgcgcgaagcgaatgcgtcgcctcgacagaacatcgcatttttaaaccatcgtttgccacggaaaacaaggacggttactcctcgtgcccgctgctgttcagggcgagcaatcgtctaccaaaacaagggaagccatgtttctctcgggtgaactccctttggactctaccttcccacagcacgagcgtttccctttaccccgtcaaaacggggaaaaatgacgcacaaatatttagaacagtacagacacaaaaggacacctcttgtgcggcgccggcgcgattcacactgccggtccccaacgcctgactgtggagatcaaaaactgagagaaaaacagaattattcctctgacaaggagaagcatgtgtctcccactcgctgtgggggtgcgcaaagcaaaagctgctcacttcgacgcgaggggggctttccacaggtcgagtatcgtgcgcatgcgccgcctgctgacgatgagggaacttcttgtgacggacaacgtctaggcggcgcatgcagagcgacgggcgattgaggggagatctttcttctctaaaaagacgaagaatagctggagataccgctgttgctgcaaaggatcgcagtttcgccgccccgaggtcatctctgagtccctgctgaagcacaggttttgaacagcgaaatgagtgctgttcgtataaacgccgatcagagagaaaagagcgagaaaacatgcctttctcggccccacacgaacccgcggcggtgctggtggcctgcatgcgacagaagaccgagtgacaagtctcatcgcccaggcgcggatcccgcggagaacggccgggagtctctttccagaaacagcaatgcttttctcataaacaattttgaatcaaga

SEQ ID NO: 3818 - DNA, 3072 bp, Toxoplasma gondii
actcgctttctctcgatttacgtcgtttctgttgctcctgtgtctttcttcgacggactcttcttctcccgccttttaactgccatctcccttttttctctcagtacgcttctgcttccgcgactcgctcgcaacatgccttttgcgcctctgctcagctgtgcgctcgccgctcccgctctccacatgcgccacagagtcagcgacgcacggaagagagagaagggagaggcagacttcaaccagagtcagaagctggaaaagcatctccgcgaccggagtggaatcgtctactcaaagctttactctctacagtgtgagtcgaccctgaatcctctttgttttccgagcgttgagcgcggtgtgaggcgctctggtccgttcggcctacatgcggttcttggggacgcccaggtggcgttcgcatgcagcggagagagcagcggcgattttgcagttcgtggaactggtgatgcctccaatggaagcaacgcgaatgaacgcacacgggtcgctgctcccgccgaaacgcatctgcccggtctgcgagtatcccaccatgacgtagctcagaggcttccccagagcgtctgcgacggctgaagaagagcagcaaacagatggagagcgtccactccacaggacgtcgtcgtcgctcaaactctgaagcgacggaaaaaggctgcggtcaagaagttggcagtcgaagaaggaagcagggacacagagaaagcacggagaaagaagaagcaacgagacaggggaagaaagaagagcaagaaataccaaagagacggaggagggatcggggaagttagacagaacagagattcgagtaaatccgtgagcgtgaagcaaactggcacaggagaaacgcagaaatcggggtcgtggaaacgtcaagaaacagaaatgacagactgatagacgatgaagaaatggtggaggagagaggactgcagagagggagagaagaagagaaagacaaccatgcttcgagacacagtgcagagaaaactcgagttcgaacagcgcgcttgcgacggacggatgtttagcgagaaaagcgacaggaaaaaggtacacacaagggtggcagaacaaaatggacgcgggggaagaaaaaacaagagaaagaagtcaagaaaaaagtcgaaaagggactgtggtgttctcggcctctctgtcaatgaacatacatgtgtgtaacatatatatttatatatataaatacatatataaatatatatatatatatatatatgtatgtatatattgcatgtcaagccaggagacaggatgggtgtgtgcattttttccctgagagggttctatcgtcaaacggtggcatcttcgttgcttttctcgctaaaaacccgtccgtcgccagggcgccgttggaactcgagttttctctgcattgtatatcggagcattcttttggaaacatcatttgctctcacctttttcggcgtccttcaagagggcgtcctgctgcgccggcgtcgccgcgacggggcaaaagatcatgcacttgggcattttgtgggggaacttgaaaggtgtgcgaagagaaagagacaaaaaaagtcagagcgacccggaacgcaaaggggtgaagacaccaagtgaattttctccggaggactcctgagtgcaccggtggcggagacgcaactcgcgcgcgcgcgcctccgtctgtgcagaaagcgcgggatttcagtcgtctcgcgttcgcggtttcttcgctcaaacgagaaggcggcgactgtgaggttcacggcgccagcttgtctcgacgcaagcgcgcttttccctctgtttcagcctcaaaaacgcgctgctaaacgctagacttcgcgtctgtgtgtctccagactctagtgtcgatcgaaagagccgcaaatgcgacccccccccccccccgcggaaaacgcgcgcctcaacaggcgggaggtcgagtctgccagaatcttctgcgtctggcgcgactccgagagaagctgtctcgggcgtccgttcgacgcagacggtcgctctctgctggtcaccaggaagacgagcttttcgagcggaggagagacctttaaagagaaagaaccaagaaatagggaagatttgcggcgacgcaggagtgaccgtggacagcgtaactcgcacaccgctccggacaggtaatccgaaggccttcttgttgaattggggacaagtggcgacgtgtaaagaggaaacagagaaagacagagatccagaacgcttcaggatctcaattcttcgtcttttcttcggctttttcttccgcttctgtagagagttgcgaggagttgtgtctcaacaaccaaaccagccaccgacggaaaaagctccgagcggcaacagcgcatgcgttctatcagcggaggagcgcaaaggtacggagacagagaggccgtttcggagaggcacaaaaccagacgccctatatgtgaggttactctcgccagacaggggcgcgaaaaactgtagaaaacgcgagaccaaaaggaagcagaaggcgaaggacttgtgtcgcaggtgcagaagaagctagaaaagcgagaaggaagaagggtgtctcctgggtgcctgaaaaaacttcttcctccagtgtgcgtgtgaacgttggcgccacggcgcgagacgaaagtcgtccggtgagagaatccacgcgagagcacagggcatgcatcgtttcaggtgacccgttttcctcgctttcttcacattttcttttcttctttcggagtggaaggcagtccggtggaaagaaggacgaggtcgcgttcctcctgcctcgcttcggtgttttctcctccgtcttcctgagagaggacgccctgcgcgctgcctctctctcctctcgccccgccggtcgaccgtctctttcttctcccgccttctgtgtgttgcttcgtccacctctgccgttcttcctcctcctcgaggcttctctctgtctccgttccttcttcgtagtctccccctcgctctctgtctcttcgtaaaatctccccctctgtcctcgccttcttcttctccgcgtccctcgcacca

SEQ ID NO: 3819 - DNA, 1790 bp, Toxoplasma gondii
cagtaattttcctttttgcaggccggtgacgcaacgcatgacgtgcacatcagaccgcagagcagcaaaggagacgtggagagtcaagcggatttaatcaagtgattactcagtgaaatcgctgctctggtggcgcgatgctggcaagaatccgataccgtatcctgggggttatgcggagcgggttgactgaaagggcatagtgaagtgtgtgagcgtctcctgaggggagatacactctttgaaaagggcgttctggaagcattacaggttttggctgggtaggccgcttcgcaggcaccacgttagactgtgtcgtcggcacgagcacaatagaggcttccacctagcgttttgttcagcggtgcttgacacgggcttatgttactggggtagagaacctcagcaggcgtattttgatagcatttcgttcgaaggggctacatcagcatttgatggattccccctaccatatgtgactaagcgcgttttccgtgatccgcacacccttctcatctcgtggaacttagcgggcgggggggggggcgtggatgtcctctgcatgcaagagtgtctttggaggctgttcttatttcaatatgttctctggtgatcttccatacgtgaggtggaagaaaagagttagcaaagcagagagcggcaaagaatggctggtccgcgcgtgctgactgctgttgaacttgatgtgaacaactgggtgtcggaaaatgtcatcaaggctgggagcgtcagcagcaatagtgatctcgaatgacgagcagtggggtgcttgacgggtttccataggacacgtacccgacttgccgacacctgaggggattgtgctagggaagtgagaacagtagcgggcattgtagctgggtagcattctttgtggagctgccatacactcaggatagccatatagcatacaataggcacctttccagaaaaatatactgtttcccccgtaagtctcactgtagcctttttcgcttcgcagaaggggtggcgactttgacagttcgttgctcaacgaatcgcgggtacgggttaagtgctgctcgagggaagactcagtttctggatagtgtgtaataactacagccttttcttgggaaaacattcatcaagaaccacattctaccagaaactttgtgcgtgaggttgcagcgtttatcggccgcagtcgcagtgctagatgggggggccggacgcgcagctcctagcaggcagttgtgctgcagaacttccagtgtacgaggggtttaagcttgtagaactccgaagagacacactcccccacagcacgtccttttacgtcagtgtgtcatttcttgatttttcgccaattgtcgaatgagtgcatatgttcactctccagtgtgacgtacctgtggcgtgggccccccgcgacaacggccgccgcagagcggacggtggtccacaggaacggcacccgatgggcgcctggtcccgtgacgaaagaatgcgcttccaaacgcgaataataaccaaatttcgaaagcatttttgaaaccccaccgcagtactctgtgataaatctcaagatctggcgtcgaacctacgcagtacagcatgccttttattttgtgctcttctgatgtcgtgaagcatcgattgaggtgtcggcagtacagcctgtgctttgattcgcggttacggcgggcggaagcagcgcggccgcgcacggggttcacacaacagtttgtctgcttctcatttggcgtgttgcagcgcctgctttgtttcgtttgtcttcttaagaa

SEQ ID NO: 3820 - DNA, 2090 bp, Toxoplasma gondii
cccgttattagcgtttttccgttcgcttcttcttccctttttcgcagcttcaacttcagaagctcgatcaggagagacagcgacagcaggagctcctctacgccgtcgagttccagtctcagttgatgcagaggaaggtcgcgagagtcgcggggctccgcggcgttgcagagaaaagagaacttctcgcaaaaatttcgaaacttgaggaggtgtgtgacctttctgccgtctcctcctcgcgaggtgacagaagtgacgcatgcgtccttttcaatgtcgcgagctgtgtaaagtttgtaaagatttttctagagcaaggcgatgaataaaccaaacacatcagattgtgaaaaggcatcaagctgtgaaaaaacaagtgtgatcttgacatggagaggcctggacagaagaagacgacgcatgctcttgggtctccttctcacagattctgacgcaacagtgccagcagtgtcagatgctgaacgcagaaacgaaacggctcgagagcgagctgaggtgagatcttcaaagttttccttcgacttcttctgaccactgtccactccgttgcttcgaagctttttttgcattcacatgcatcgctgcacacacttgcgtgcatgtcgaccagcgtagacagcgagagaaggccgcatcgacgatttgaggggagcggcaactgcatgcgtataaagcacttaaacagttatgtatacaaacgtataaatgtgcacagatataagcagatgcatgcatatacatacatacatatatgtatatatatatatatataaagatgaacgtatatatacaagtattccacctgtacatatagatatgtatatagatatgtatatatatatatatatatgcgtgtatgtacaagtagagcactgcctagcacagtcaattctggtcttcgctggtgtttgccttctatgtggaaggagagctcggtgtttgcgtctctgttgtcgatttgttgatttcagaaagtctcagagagccctgcagagccgggaagccgaggctgcagctctggacagcactgtggctgatttgcgattagaatgcgacttcctcaagagagaagttcagagcacacagaaggaaaaagccatcgtcagcgtggaacaagacacgctcaaactggacgtgagtcgcctgcgtctcgaacgctttttcgatctctccggtttgccctaatttgcatcgattcgctgttgccttcctctcacgggatgttgcgtctggccttcactagactctcctgaacgttggaatttctcctttttctcctccgtttccgaaaatgcgcgcgtaccagtgaaacacacctcttccgaactctgtccggagatgccgcggaggcgacaacgccgccgacgcggattctcgttcggatagcttgatgcggccggaggtttgggtcacggggaactcggtcgaaattgtgtttcgcgcatgcgagttcttctccttctccttcctgtcctctccacgcaaggagacgcctgggcgcgtaaagcggtcacccacagggcgcgagtaaatggctttctctctcggtgctcagacagcgcgacagctcgagtcgtttctttttttaggcgaaccgactgcgcgcccagttgcgagaacagaccgaggcagtcacagcagcggagaatgaaaaactgcagagtcagcatacgatcgaagaagaaattctcaaggcagaacaccgcctcgagctagccaaggtcgcagctgtaggtacacacccgcgacgagggcggaaacgcatcgcggccgggagacagacgagaaagagacgaaacacagagggatgaagacgataaatggaagacgataaatggagatgctggcggcctgaacagtctctgaaacacacagattatcgcagatgcctctacgtgaacgcgtaaagagtgccaaagctccggaagccgttgcagccggagaggggcggtgaagggcgatctgcgagtcaacgcgctttccagaagttcttttctgggggaggtggaagcaaagacagacagcttttcgacgatggaccaaggaacaaagaaactcaccaaata

SEQ ID NO: 3821 - DNA, 2706 bp, Toxoplasma gondii
gacctccagagaaagcgaggcgcagatccagtcggcttgcactgtacgtacacccggcgagagacgaagcgaggagtgaccgagccgccagaggccggcgaagacatcgcgattcacagatcagtgaaaggagcttttccgttctcggacggaggaggcgcacagtggatttccttcgctcccgcaggctaggaagacgaggcgaactaaagaccagcgcgtcatgatggaggccgacaggtgacactgtcgaattccagcggcttctcccgggtccgcatcctcccggcggagagtcgacacaggagtgcagggaacgacagagaacgacagggaacgagagagaacgacagggaacgagagagaacgaggaagaagacgaagtgagagaaaggaagcccaacgcgaaaagcgaagcaaaccgccaggcgggggaaagggaggcaaaaggcggaaaactcgcggggtctggagccgtttgtggggtgtctgtacacccgaccgcggagcgcttgcgccagcgcaacagagttctccacgactcttgtcgacgagaaggataaagcggtgtaaaaaaaaagcggagttctggcgaagaggcaatgtgactttggacaatcgaggaaaaaaagcgaggcgcgcctaggacccagacacggcctctcgacaaggagagttgcggcggagtctgcgactcaaacgtagagaaaacgaaatgccaaagatacacgaggcaagcctcagcttccctttcttcgtcgcgtcgctcgttttcttttttcctgcgcggttctgccgttgtgcatttcctccgaagcctccacggcgttgctgctggcacaaccgcgggccaaggttccctgcgctgccttctgggcaccgattggagacgttattttttctgcagaaaaatgagcagttcaaacaggccaacagggatccttgtcgtgctcgggcgtctctctctgtgtttggcgacctcctccgcccccgtctccggacaccctggggacgaggaaaagcctcgttttgcgggtggaaggaggcagtgttgagggcgcgactcgcgcgaagactggagaaaagcgacggcgaagacgagaactcgagtttgacggagaccagcgacccgcaaaaaaagagaaaaaaaagacggcctgggggttgccacggggaagccggggaggagagaaaaagtcaatcgcgggcggacatgcgccggccttcacagacgctcgcgatccgatgttctctccttcacaagcgcgatgtgacgtcaaagatgcagagcgaaagacagcgaaaagataattctcaaccgacgcccaacaggttttcttcagctacgcctcgccactgcccagccaagctccccaccgacgcatgctcgcgtttgaaaaatcgagcaaccttttgcctcgcggcccgcggaggtcgaaccctctgtcttttgaagtcttcaccagctgcctccggcgcttctctgcagcgacgagctcgccaggaaaagaaaacacccgccaccgtcctaaattgccgacggaaaacgggaagacggaggagttggcgcaaaagcgcccgagacccgtccgcagaaaagcaagacactctccgcgacgttcgccaacagtctgcgctgcgcatgcgaagacctgagatgcagaacgcgcatgtcgccgacggagaggaaatttgtcgaacggagagacggagaactggagagcgccgagctttagagagaaaaagctgcgcgactcgctctgaaaaactcttagaggatagagcgtcgaaagcagggtgcctgctgcccgtctttttgaggagcctgcaggtgtcacaggaaatccgtcgcgcgccctttgcgcatgaaagccgacgcgtcttgaggatccctggaaagccgaaaaacctgtttcgaagtgtgcacggtgttctttgcgccgagagcagccgaagaactgggtcgaacgagacttttccccggcgacgcgtcttaggatccgccacccgtcggtgtctcgtagtctactgaaaccttgctggaggttctcgacggaaagcggactctttttcaccgtggttttcgccttgcctttggtctgccgactctgcgctgtctgctctttcttctcacgccatttattttgctctcccggcgtctctcgccttcgttcgcgcgagtcgaaaaccttgaccagacccgccgcgagccggaagcttgacacactctttcaactcggccgtacatacaccgccagttttcgcgcttcgggagagtttggcatcctggccgcgtacggcgcctttctctacgttttttcagaggttcccttcgttttccttcgccatcttttctctgagacatcccgcgccttggtacagacgaacccgccacctggaactacggatgcatgcgtatggatactcgccgtttactcctcttgccttgttgtctgactctcgtcgacaccgcgacgcgtcctgcagttccggaactgcgtttgtaggtctccggtctctgcctgagtgccttttcctgcctctgcagacgaagaaaatccgaccaccgcactggtggatctgcaaataaaggactgtttgctcgttctttccttttcgacgcctccgttcctccactctgcctctccactctttttttccttcgctacattggctttacattggctttcttccccagcgccacaa

SEQ ID NO: 3822 - DNA, 1916 bp, Toxoplasma gondii
tggtcttcttccatcataagaactcttacgcgcggctgaaataagggtccaaccgtatgtctggaggtgtttctcggctcgcgagctggcagagcaatgtagttggtggtaacggactttcatctgtcatcttgagctttagatcaagatgcaagtgattgtgctcacacaagtgtagttcgtgctggttttttgtcggcaaaaatgtctgtatttcgctcacgagttaatcttgtgcgttgattggcgtaacaattttcaacccgcccgtgaaaagtgccgtataccagaggaaggaatgtgctccatcgtcccctgttgtgtcttttgagaagggaacggtaggtaacagaatagtacaggagcttaaaatgaatggacgaatgtattgggaccagacgttacgggaccttgactgttgttcaagtggtccaagtttgaagctttagcagcaccctatcacgcagtccacctcgtcgttgaaatgagaggtggattatgctaccatctagtacgagctatcccgtcaacagtcatgcttttctcctgttgaaacggaatcgaatgtgacaggagagatgtatattacgtagagtctggcacgatacacttgaatgatgtcacagccgatagatgtttatcgaatcacttccatgctaattccatcaactgcaagtacttgtgtaaaggggccgggaaatattgtggcagtagtatgcacgaataactgcccgccttcatactagcgaggcctcctggttgtgatccctattgtaactaactttggttttgtaaatcctgaccttctgaatcatcgatcacccccggagtcctccaacggaaagtcctcctaacgacaccgaaattcccgaaggctagcagtgaaaagcatctttgctacttttgccttttagtagtgcagtaaattatgaagctcgaccttcgacattaaaacgagtgacgggcagtattagtggtgtaaaaacataccacactgttgttgatttcccgtagaaaggaggagaggccaaagagtttcggtgttcctgaagtgttcaagtggtgtgatctacagatacaacagaggagtcggtctcaccttaaaaaccacagcatccttggagagacatgcttctggaggttttcaagcaaagtgaagttgcacttctttgatggcagcaaacaattcaggtctacaaaccgtgtgctggtggagaccgtttggaaagctgccgtctatgcagctcgaaaagcagtcctaccgtggagggttccatacagatgggttggtgaggcctgctgttgttgcgacttcacatcataccgatgcttcgatatgtgtggtgggggtcatcttttgcttgagttttattactttgtacatcttttgtgcgctgcattcgaagcagcgcaacaaggcagtcgagggtttcgcatgcaggggccacggtgcttggttttataacctaagcagttctttggcctcagaacgggcgaggaaaacctcgcttttccccaagtgtgtggcgcgcaaataagacaaacggtgtttttgactgtagattccaaagttatcgggcccatcagaggggagagtgctgccgggtggacccgcccgcttcgtcgagaaatgttttattccaagggagagcggtgattttctgcctttcgtcaaacactttacgtcctagcattcgcccgctcctaatccgcacactcctatttcgactgtgacaaactggtgcggcattcatctgattgacgtgtgaaaaacctgtcggtcaaggaggatttgcggtgtgctcctggcgactcttccacgcaacagctcagctcgtccactgctccgggtctgagcctatttcttccacatcgcgtattctcgtcagtatcatgttgttattgtttcgtcctga

SEQ ID NO: 3823 - DNA, 4381 bp, Toxoplasma gondii
ttcactccacaccggtcagccagatgctggttgtccatggactcaagctgagtgccactcctgtgcttaataaacacgcagcagggtcgtggacagcagaaccgacaggaggcattgctacagtctgcggcctagaacttccagcattagcccgcttgttatgcgcgcctactagttgaccattaccactacattttcaagaacgtagagacttcaactcgagcaacaactgcttcctctgtgatttttgacacaaccgcgtctctggagtgtgctctagggtttaactgaaatagccgccctcggtggctgaggcggtgcgtaggctgagacaaaggtttgagtttttatttggaccgttttcttggtggagtcacacatttgggaagctcaaaaacactcaggtttccgactgcggggcagtgtcgctctcgcccttcgaggacttgtcgcactagccccgtgtagcattgcttgtttgtcacgcagttgccgcacttcgggatgagacaggcgagaggacacagggatagaaccgatgtctgcagagggaagcgagaaacatcggatggaacaccgctgcatgcgtgttctgccatttcttcatcgcggaatttgttgtttttgtgcgtgccgtggctctgtcctccggcacactcaggacgcttcacaacgctgaacgacgcggcagtggctggacgtcttctagctcggttcctgatctcagagaatatgcttttcgggaagcccgagcgtgtctccgctgatctgtctgccgatcgcgaaaacggagagctgactggaggtgccgagacattctaaaaacaaagagatcgctgacactgctgaaaagcgtgcgtctgatcgatgcatctgctcaccccgagccaatgagaacatacgatgaaaaaaactgtctttctcaacataaacaaagtgactggcgatccactgaaacagtttgcaaacgggataagtatgggcaggggactttgcttaccaaaccagacacacggcacgcacacccatcctagacggagttgccccgacagcggaacaaaagatcagaagggctggtgagaagtgaagcacgacagtggagtgaaacgtggcataatacttaggtactggcaagcactctgaacaaacgtgaacggaagaaaaacaaacactggagcagaacgaaaaagggctgtctcgttcgttgtgaagcaaaagctgcggaatcgtagacgttccgcggttggtgtgacgcaagattcagattaagagcttttcgtctcgtggatggacggagtttcgtaattgtttcctgcgtgggcctttgctgccgtcgagcgtggcgatccggcagaaatccaggggttttcgctaacatggccgttgtacctggagtacggctgcgcaatggaaaacgggctgcaggctcttaggggggggcgtctctgagagagtagaaagtatgagactaaaatgtcgctcgctttccggtgcaacatgaggcactagaaccatttttctgatttgtgattgcttcctggacgacatctgccatggcagacgggtcggggtgaggtcccattcgcagattactctcaccagcttgtgtgaaaataagtgggtggaggatccgagagaaacgtcgaacctctttgcactttcgttaccgggttttctttccccttttgttttgaggtgaatgcaaaacactgtcgatgttactgagtggatgcacggattgccctctgtgaaggggccgcagtcaacaaccgttatgcctgcatttgtttctgcaggggaagaaagaaaggcacatccaccatcagaaaagacactgacgggagaaaagacgagaggagaggtcagctgtgttcagccattgtgttctcgaaaagttttcgaaagaaaccgcattcttggcggtggcatcggaccagagtttgcagagcagtccgggggagggtaatgctagttctgttactcgaaactgctatataataagagatctttttcattaccctagacagcgctgtcagggacgctgagcatcttgctcgactgttctttgcggttcagaacgtccgcagaagcatctgtatgctgatcagctttcatgagaagtgaaacgcctatggaaggtacacacacgcgtcaaattcttgctgtcaagcccagccggtggtgggcttcgaaaccggtgttctcttttggtagcaaactcggagacgcttcttcctggtttcgtcttttgtgaacaggagcttggggaagcaaaggtcactgcatgtgttgctgcaactgccgcagaggagacattatagtatgtaggatactgaatacgactgcagttatgaggtacagataaccacgttctttccgtgcccagctgaagggggcaggctcggggcgaaagctgcggcggtgtgcaatttccttgtaactgggcttccctattctgaaagtcaaaaccgtatttctctgtttgtcgtcgaaatatgtttgtgccaatgcagtttggagtgcctccgccacaaccaggacgacgcggtattcgtgctcatgagcagcgtcactctatgtagcgtacagatcacgtgtacacaaagacatgtacaactcttctaacgcagaaaatcagtgtttctccttttcagaaaaggcgtacagctccgtcgactgcagcaaacctacgttagtcagaaggctcttcaaaaatccgtcgcgtcgtcgccggatctttctacacgcctcgtatgagccgtatgacggaactttgtatagcagcctacgaacgccagcagtgctgaggcgacaaagtctgttatgaagcagtacacggcacagggtgtttcgactctaaagcaaagacttgagaccgagtcacatgttgtccatggttttggcgtatctgtgttgcgtctgtttcacattcgaaactgaatcgcgactcttcagaatggagccctccgggggagtgcgcttgcaattgtgtgtgggcacaagcgggttcgtccagtggggaatatccgcctgcgttgcagtttaccggagatgttgtgaagggaaggcgcgctatgatggcttcggcctctcttcgggacattgagatggagaaagccacacggatttcacgtacgttgttcgagttgcgtacgctggcggatcccagctcgctcgactgcataaaagaaacggcggtgcagtgcacggggagctgtcagatgctccatgaggaacaataaacgagaaatgcgactttgtctggttaagatcttgcgaaaagacctactgaaagcatgcgacgccgggggaaatccggaagaaaattccgtggggaagctgctggtgacacaaagcttggcgtctgcccgactgccacagagcgcccttgcctaacccagtggttgtggcactgtcgtctttcccgagagttgagtacaacatcagtgtgtgcattttcggatgtttcttcagggtttcctccagattcccctgtccgttttcttccggaacaaggggacaccttgatggagacagtgtgaaccgaggcagaaagcacggagctatgaaactctaacggggagccgttctcttgccacttcgcttgcagtgctctcggatcgctgccagtgaggtaccggggggcaatcgatccgcggcacagtagttggctatgacgtcgacccagcgatgaggcgcgctaggcggggatcaagtgtgcgtatgtttcgcgaaaagagtttgctcgactttccttttgcgtttcggtcgtttcagtagtagatgggccttctgttttctctgctgttctcagcgcagtgtcgcgaaacataaccgtcgttccggctgtagcggcactaaccgggctccggcgagggcacccacgggagcgatgaagaaaccctctgtcgaagcgttgttgtgactcggcgtctcccggactctatagctttttcacacgcagcacactctcttgtttgtgtcagataccctacccaacagtgccgcttgctgcgcccccaggactgtttccccgacgcctcgccagctcgaaatcggcagcggcgtcagtctctcatacgtccgccggtttgcgaaggccctctctacgttctgagaggaacttgctagcaactccagggtttcagttgctagctgcgcagttgtctgccagagcgactcaaccttaccgcgtttcctccagtctccgtactcccggcgtgtcgagttccagtccgggggcacacagttcccgacggtgaaaaggttgccgctccccttgctcgtcgacaacgagagaaaaagattgattcgcagagcatttccgtcgctccggtcctcccctcccgcggatccttgttctccgtcgtttcaggcaaga

SEQ ID NO: 3824 - DNA, 1917 bp, Toxoplasma gondii
aaacaggaggagaaacgagagaagaaaccaaagagacgcaaaaatccgaaactaatatgctcagaggagggccaaaacaaataatggaaatgaaatgagtcatgtggcagttatctgctgcgtttcgttaaaaccatcctgggtatcaacccatcacacacgagtagacttcagaccgcgagagaatcggtaaaaaagtcttaattggccggtcgccttcagtgcatcgttcgcgagacacttgccggtcaactagtcccccaaagcaaagcagttccatcctctcgtaattgtttttactcccccttcgcaggaaaaaacagcctctttggagtcttggctgtggagctggcgggtccgcggggagcctcgcgcctcgcagtcgggtcctcggagggaagtactgactatcgaggaaggaatcggggagtgaggacacaaaaggacaacttgccgcgagaaatacacggcaaagtgcagacaaaggaagcgaggagtactgaaattaaaaggagatttcaagggagacggaagagacgaagcggaaaagtcgacgttcacggaattcatacgttgacggtttgggcggtgactggcagtcgccgcctcctaaacaggcatacaaatgcagcgaagaaacgtaacctggaaacacgagtgtctgtaaacaaagggagaccagaattaggcaaaaacagggagaaaccagtgtgaaatgtgacccgtacgcggaggatctctgcgtgagcagcagcgatttcgcacgggggaacggacactcagggagagcaacgcaaatctgaggctgaaaacgaaagagttccagcggtggtccttgtgtcgaagccctacgcatagccaagggtggtttacaaatttggacggcagttcgtgctcctcatttcacaggatccttttgccatcctcgcaaagtgtgccggtcagggcagcgagatggacaaccggcggtacatgtgcgccacaaagcgatcaactcgcttcgacggtttgtttatttcgagcgaggaacgcggaaaccacgctgttgcgcgcattcgcctggtacgatgtttgacctgctgaaagacaaatgtactgcgagcgccagtcacccgcctaaactgcatgcggaagtcgatgaacctcacttgaccggtcgagctggaatctgctctcgtcgagcaaaaagcacgcgcgtcacgtgtgttccacgtggagcacggcatgtcattttgccgcgcggttggttcacctcgagttccgcatcacctttccgccactttcttcccggaagcctcaagcagcggcgtcatctggtctttcattcaccccctccgttcggattcgaagcatctgtcgggggatgcacggcgaaactctcgaccttccgcgtacccgatttcggccgttcgtcgagcgctagacgcgagtgtccgcgacccatcagcctaactgaaaaaacatctcccatattaactaaagcgtgggaaaacagttgctttgaataaggtaagacgtcttcgaactggtaaaccggcttcggttcggccgccagtcttcccccgttgtccctggaggcgtagtgggggtggctctgtcgatcgtcgccacgcggcatcgctccaccgttttgcggctatgcttgagttatccagcgttttcgcacggccttccaacaaacaacagacctcttaccattcaccgctcagctgtctcgtttggttggtacctttacgaggtccgtattcgcctgttttttagtcgttctgaaaaaccgtatagctgcagtgccagcccccgccgtcgccgttcggtccgcggtcgaccgcccgcgttttggccagttttttctcttgtctccttgggttttttccagaaagttgtttgtcggaaactagggtccactggtggaaacga

SEQ ID NO: 3825 - DNA, 2884 bp, Toxoplasma gondii
cgctaattctggacgattaccacgctcaagttccgttacaaacaaagcagacaagttagtacccagactggtgaagatactcggcaaaggccaatgccgaagtcctgctgtttcccttgtcctgttccttctcctcatcgtaaagggcaatgacgatagagccattcggggtcttgatcaagtgcgcgccacccttggaccgtgcacacatggtgatgtcgaaggtgcagtcgttgtactcgaatcctttctcctgcagagaaaatagataacattgacaaatgcaaccacttggatactggagacaaaaaaccgccttatctttgcatcaactttgttccctcggcggtaatttctgctagtaagatcgacgtgatagatacaaaaaaagaagaaacaaacaatttttgacggttgaggaccaagcacacggagcactgtatgtcctgacagatcttcccgatccgagctgctttctcacgcagtgcgaccccttgcgagatatgatacttacaggtcggacaaccttgtacttctggccgccaatccaaacaccgttaggggcactgccatcgtcaactgcagctttgatcgtggaggcctcgttgatcgacaccttgccgcacgcgttgccatcctctccgatagtgtcctcctcatgatcatccttgtacagcttggaccatccgtcatcatcatcagccgccgcggcgaacacaacaccgtcctccgcctaagagtcgagcgcaacagagagaccaagtacattcgcatacagagctgctggctcgattacgtgaccatactatgatccggggactccggagggagtataacacagtagacgcaaggaaatggtaaagcacaaaaatcatacgccgccgcgctgagacacgaacagctaatcatgtttcaggagcctagttattacctctgcgggagggcacttctccctcaggcttcagaggcgagcgacaattactactacctattagcggattctaacactgaaagaatgcaaggcgtcacaaaggattctcatccatagaaggatgacagtcaaacatttgtaggcacggctagaaccaacaaagaaagtagacgccgcggagcgacacaatccgctgttgagcagccaaaggggatgcggcattgattgagatgcgcattagtacagctacgctgagacctccgactttttctgccgcctttctataacgattggtaaccggatagaaactttacacgagcaaactgtaccggaacttctaaacgtctagccggcctcgttgtatttcccgaaaactgcgaagcacgcttacgttggcgatgccgcctgcgcagcagtagcctgtgtcaacaagccactccttgacaacagggtcccagtcggacatcttggaaaagaatggaaacaagccgcgaaagaagcgaaaaagaattctataagatgtagccgatgacctgggaggaaagaaaataatgcaagtaacggctcacacaacgggctacccacctttctcacaccgaggcacacacactgtcgctgccgcatcaccaccactcccgcgatcagcacgcgctggccaggagcagcatccagcgcaagcgtgcgcatcccctgccttaaaaccgtcacgcgtaccgagggtccgatgcagggcgcgtttcgtgagccgagcttggtggccgagctggggagctgctaacccactgttgacagggcgtggaagaagagcgcgcggccaccaccagtaaaaggaggccgcggcgtgccgatcaccgcatgtagggaagggcgctgttgcagcgcagccattacggctgcttccatcgtatctcccgggggcgaaattaccgcaccatctatttgggatccaggtggaaaggtggaaacacgtatccacccgctaagacggacgtgccataccagaaggctacacagtagatgacatgcagacttctctcctttgtttcaatcgcaaatgtagcttcctggtggacacattctacacgccctacacgaagcaaccgagcttcaaacagttccagcgtagccggcactcacagagcagaagccgcacgcgccgcgtgcgcgacagcaacacggtctggatgaaggtaaaacagaaccctactatgactgtgtcatggcagtcacgattgaggacaacgaaatgttgggaacaaaacatgatagataatggagaacgatagagaaaatcgtagtaagaagcaactgtatccaaacagcaggacacagtggtacagtgctcgctggagcatgcagtgtttggttggaagcgggcacacaataccatatgcagggtgacagatgtgaagtccaacaatatgctcacaaattaaagctctgcgtccagagccgaaggaagttgctagatctcctggtaacggcgccattgctgggctttttaaaaatggcgtcccccttgcattactgattgagattcgtccattccggggcgcgcccacacggacactgatccatgccgacgcgtagactctagtaggttgaagctctgtttcctggcgttcgaaatgaaggtaaaaggaagcggatgacctcagttgaggctccacttcgtctattgtcctgccttttttctttgtttcacgtggtgacgccccctgttaccagtgggtcgatgccgaacggcgtacgcgacgcctccgtgctgtttgagggcatggtcgaccctgaaaagctactctgaatgtgcaaatagcgtttgtggattgggctgctgctctctccaactcaacaatacacttgaagtacctgagtcgatgaccagctccgagaggggctagataacccgtctggtggccgcgatacgcgaagacgtgagatgttccggcaaca

SEQ ID NO: 3826 - DNA, 1891 bp, Toxoplasma gondii
ccgcaaaagctctgtgatcctggacattgctttgttcgcataaataatatttacgcatatatatatatatatatatatatatatatatatacaaacatctagaaacgcatacctggatatatatatatatatatcctgtatagagtcacgcaagttgaggcttatatatatatatatatatatatatatatatatacgtatatgactgcatataagtatctatatatatagtgtatgtgttagtcatatgcagttttaaggaagtcagtgctggaaggaagcggcacggttgccaaacagatcgttctgttgagaagcacagaggccactgcatatgcttttcagagccacactgcggagcctaccaagcgcgttcacaaatgtgtagaggtagaaggaggtcgagttatgtatggatacgcccgtagcgagatgaagatgaggaaactgctgctgaaaaggtcgacttttgtcgcgcagatagccacgtgtgtaagagagctacctgttttagagcctgaacacaaagtttttcccgcaacatgttgtcttcttggagttcccgaaacaatcttctgttgcctttccgaaaatgctttctttcacgcatttactcctgtgacgacgtcttcgcggtcacgagggggatcctctgtctgcaaagcaaccttcctcttttcagcaagcggaacgtagcgattgaccctttgcttttcccatttctgcatctgttgcccgtaggttgatactccttcccccaccataagatctgactgctctcttttgcgcaaggaaacaaatctatgaaaaagcgaaagtgcagtcactccaagcaaactggtcccgactcagcgtgctgcgccgaacgaatactttttttgcatgcagcccccctgcgcccttcgaccgagaagttgagtttcgagttgaaagcgcggatggaaaacagacaaagaatgtttagtgagttgacttcgaggtgatactctcttcctcaaactttccaattcccctcctcatttctttgcccttccgttaaatccaggaaaacctgctagtccagagcagcggcacgggcttgagcaagagcgcgaaaacggatggcttggttgcccctgagaggagcgaaagtcgactttttctcgcgtttttttgctggcttctccttctccatttgcgtggaaggagatgtcttttgtgtccgtgtagagttcgttcaagcgagaaaccggagtcaaagcaggaagggaaaagtcgcatgcagcaaaaatcgacggaaaacgtttttttcgaagtgtttcacgcctttgtctccctttcgtctgccccttcagaacagattttcttgcctgtttttcctccgtccccgtctgtcttttctgtccctccaatttcttcggcagagggcgaggcccgagtgacatcgcatggagagacgagacacggcaacgcttcagagtgtgctcttttctttatttttttctccttcgtcaactcctaactctctttcttgctcttttttgccactcttactccttttcaaacctcctggcgaagctgctcttcccccgcgagtctccctctgtcatctggtccttctgtaccgagtgtaaaagaactttgaatcacttcggccttttttcgacacaccgatctcttgcccgtcgtctctctttccttctcttcttgttcaagtggtttctatcgcgctagggtccgccgttctttctcttcgtctccgattctcccatctcccgtcacctctgcggcttgagaacctgtcctggcccagttccccgttgaagtcgtgaatgcatgaacagacttccacggaccgcgtgagagacacaggactcttctctggacttccaaaacgctgttcgcctccaca

SEQ ID NO: 3827 - DNA, 2932 bp, Toxoplasma gondii
acggccatcgtaaattcagcgtccagagcgcagagtgggaggagagccgcttgtcgcgactgaggaggcgcggcgtgatttgctgccccgtgcatgcgtttgcatcagatgaaacagagaacagccgtggaagcggcgctggcagtgtggcagaggagagcgactggagaccggtcgggcgcggcgcggccgctgccttcgctctctcttgggtgaatgtactctccgtagtggtgcgcagatcagttagttgagagagcgctgcggttttctcggactgtctgccaggcacggtttctgtcttctggaagccgccatcgaaaggaatgtcgcgagcaagtctgcagtgggtgtgtccttttccgtgtcagggtggcgcgtccagttctgggacgcctttgtttctcccgcagacgggccgtgcgttaaactgttccgcgcgtgtgtggtagaatggggagtcgcgcatgcgtttggacagccggacggtcactttcgttcctccggaagtcgctgctctctctgtaaaggtcgctgtcaattcggcgactggcgaacgaacgcgtcgttctgtggtttctctcgcagccctgcccgagacacctttcggagtcgtgtgctgcctttctctgcggctctcgcgcagttcggcgttgtcgatcgtggcgccgcggaagcggttcacgacctctacaggcatgcatgcacatggaactggcgccgcgacatccctgctgccaccaatgttttcccgtgtttggtacacatagaagaaccccaacttagcttctgtctttggggcaaagtccttttaggcttggcgagggccaagctgctgaaaccattttttgactttttccgctttatgcaatcttttctgcgacttcgtccctagtgggcggtagaaaatcacacacaagcagtggcaaaaatgccctctgcgactgactagagcgctcgtggattgatgtagaggacttcccgacacttagtgactaccccgccgtccggcttccaagtgtactgcatttcgaaatgaacgcatgcgacttagtctctacacatctcttggaaacactcagcgctatgtccacgtgtggagagtcgaattcgaatgagtgccttgcactttcctcgcgacacagaagtgcctggtacacgatcagagtaagctgactaactgtctggtctagcgaagattggataagctaacatttgcgtgccgggtgtacgaggatcgaaatattcattttgggagtctcagccacgtgaacgtccttcgatggacttgggccgccactcgaatactaatactcgaaatcaaagagcctttttacaagaaaaaatgacaaacggagatctttcgaagagtttgttggtgaatgagtgtcgatcagcggctgaaaatgcatgattattcgtaaccgattcacggaagtacatgtccacaatcttaaatgagtcacacaggtgacagagcactagagaaccggtgagtgcgggtcctttggttacaacttctgacgttactgacatttagaccattcaacactgtattggttgaaattaacttattgcagatcacggcagcgagaacatgtctaccgtgcaaccgtgtagaattcaacacacctggatctgatcacatttcatgaactcagcaagcgccgccgccgggagaggtacatctccgcgcggtttccatacactttcattctgcctcttccaagaatggatttcgtcgaaaaagctggttgaggaccactctagcttgatttttgccctttgtttcagcctctcgagccgtgcagtactgaagtggtgttaacttcatatgccaccgtaatggtccctagtgtatcaaaaagcgactagagagctgccgcatgcatgtgtgtgtttaccataaatctcgagcaaagcaaaaacacgcttggcgaaccagccacagtttgtggccctttgcgctttccatcttcatgtgacgcttgtttgtcgtttatacaaatatggtaatgcctgtcaagttccttgtaccaattttgctctctgcgtacgttgggccagaccaaagagttgatgctgtttcttcacaatctgcagacgactctctcgttgacccctgcgggctcagtgccgagatgaaaaattcctgcatgcagcatgcacaagaacccggtttcctgcatgctcagtgaaagcgtgctctgtttttataaacgtgtcaaaatccgtgtttaaaaaaggacggtgccaaaacgcattggcagatctagtgtttgctcttactgaaaggtgtacatcatgtgtgcgggttgcggctttcacgcggctagtttgtgtttcaaacggttggcgcctgcagcccgtcagcggtgaagagaacggcaaacaaatcggcagccatttgacgaggcgccacttcagcagaaatttcatggcgcccgtatgaccacgtgtcgagtcgttcattcatgagcgctagcctgcttgtccgtaagttttctgcgcgtgtgtacggcgttgtgtctgttgacatatatgtgatgtccaaccgtgaagcttggtccacgggaacccgttgagagagaacgaaccacgactcatcaagcgcattgttatttcattccgcttgatctaaggcatttagttcacccggctccatttttctgatcgcacaagtttctcatggagcagcgacttaaccgcagttttcgctcgtctgtgctcggcttccagtggtaaaagttcatttccactgagtttttgctcgtgtcctattaagttctgcccacttaattctgtgtgtcgctctcaacagacttgtcaagagggacggggggaccgcactcgtcggatttctcgaataatgtgtctgggagctgcttaggtctcagggtagatgcttctctatacacaccctggttttcca

SEQ ID NO: 3828 - DNA, 2956 bp, Toxoplasma gondii
gagtatctacctcactgaattaggcatgtagtgctgacctataaagtttggcgacgagcctaggtaggagaaacgggaacgtagtcaaaagactccccgagctcctcagtatttctagctggcgaggagatatgcccgcggcgaacagtcgcaaagtgtcgtgtaaaaatacgagctttccgatatcatgtgttgtcgaaagatgtgaagagttcgagctccataaaaagcgagctttcagttgctccccgcatgtcagggggtcgacttgctgttaaccattcgccagctaatgggagaaggaaaaacaaggactaaagcgtcccttattctccaagatattgcccgttcatgtaagcgaattcgtcctgttttatatacgagcctttctcccggtcccgacgccaaagagcagagtctcatggaggaacattgtaggggcggatatctattcaaacttttcaacaagcagtgcagcacagttttggtcagtcgcctgcaggaaggaacatcaatgtgaaattaggggaaaaaccaaggagtctgaagtgtaaaggctgctagcggactaggaaccctaaaacgggcagtcgcgcttggtgtctgtcgcatggccatggacgttgagtgagggaaagtcgccgatttaaaagccctctggatgtgtgttcatactttaaacaggggtgcggcaacttcgtctcatacttgtttgactttgctgtgtctaaacgctttcgccctggttcgctgcgtttttgccggagcccatgtgctcccggacccgttacatgttggaactcgaccaaggacagtccaatgtgcttgtccaacgtaccgcttcacgatgcatggaaacaaatgagtctgtacagcgcagcccgttagtggtacaaaccacctgtgagcagcggccatccgcccataccgaggagagtttttcatcttgttgaaggtccggaccagcccgtgccatgacatggacgagcttcttcgcacgatttttgctttccattccgagtacacacctttggttagaggaaggtcgcactgcccaagagaaacaacgtgttgtttaaggtctctttcgcgtgcatctcggcggacctgacgttagaggcaatcgaggtactgcaagccgcaacaccaccgatgtcatgctttgattgaaacgccagcgagcttcctttcactgtccattctctagctctgccacaggcacaatcttgcgataagttcactcgcatgtgaactgggatgaacttgctttgtagaccacttatccgcttcacacgtgctgcccttccgggaggacgctctagtgaggctgctcagtaactgagattgggggccttacgtgcttgtctaatgagatcgagtttttcctacgctattcttaccagatcgacatcacattcaccaaagaaaaatgtagtcaggtcacgcactgcctcctacagacaggcttacagtcgcgtacggagtatgcggttcagcaggtccagtaaccctgcaggtgcgattcccccgctgaaactcgtggaaattatacacacctagctagactctttgtgccgaagagctctatggcacgcaaaaaagaatcccggttttggctgcgacaataaacagcgttgttcttcctctgctggaggtgtgagatccgcgtctggcaactcggctgcattgcatcacgggtgtagaagacgggagaggagggctaggtttcgcgagtgagtccgcagattgctctacgtgaaaaacactagccttctgtagttcgagatattgttttctcgtacacagtttcgtatggggtcgatttactccgcgactccgttgcacttcgagcctttggagtttttgtctgaatcgcaagaagagaaggtctcgctctggaggaaggcgggacgtctagcttttggagagggcagctaatcgcgacgggacgcttcttgctgttcctttatagggaccgggcgtcccagttttctttctcgcttagttgagaagcagtttctctgcgttcttcacttgcagtcgctttgaacgagagaaaagtgaaacccgtggcttttccgtccacaggtccttgctgcgccaacgcgaccaagagacgggggagctttcaaagctgctccgctttcccgagtctcgagtcagcgtccttgcggttcctctttttcttccatcgtatttcgtttcttcgattctttcaggctggttactgtttctgaacatctgggctggcctatttcgtcgcggtccttctttgttctgaagtcggcggcgcagcagattttcccaggatgcgctgtccgggctgttttgcgccccccgctggcgatccgctttttccacgagaactgctatccgagctaactcttttctctagtatttctgcccttgggatggagccaaatcgtctcgtgcttcgctttctcatttagcagaaggcacttttgaagcggctcgcgctgtcccagctcgctccttgctcgaagacttcagaacgaggcaccgagggtgtcacggacgtctttgtccatgttttccgctgcttctcgtcttcccacttttccccacaaggtaacctccaaagatttttcagcggcccgtcgggcgccctcaacaagcaggtgcggcggcgatatcgccgcaaggcatcccgttcagtcctttgtctagcgaagcacatttcgcccgagttttccagcgtctgcggcactgtatgtacagcaagcagttcctgttttgtgcagcagcctgaccctcgtctcgtgtcatgagttgttcctctccgtcccctgcgaccggactcacctttcgtcttgccagtcggtttctctctgcttgtctgccggccggcgcgcgcttgcgccccgtcctcgtccttgaagtgtgccgccttccggactttcagcttttccccgctggaccccgcccgcgtgcgcca

SEQ ID NO: 3829 - DNA, 2422 bp, Toxoplasma gondii
gagtccgcaggttcctgtacacctgaagtctcgtcctgggtgtgagtcggcgcctcgatggcgctgcctcctgtgtcttccacctggatctcttctgcagttgctccgccggcctcttcaggcttgcgcttcacgctgacctcagctcggttgtccgccggcgagaccggcgaagcctcggaagatgccgtctccccgtccccctcaggctcagcctcgtcgggagcatcggagacctctgagagagagtccgaagcaggagactggaagacagagcttgcgtcctcgctctctacgtcgccgagagacgacgtcgttctttcgtgagaaatcggaatgcagtagggaggataaacgtcaaagtggctctcaggtagattcagcagagcgccgtagtgtctgtacacccagtccactggtaatcttcgtcgcgccaagctcagtccatcggtgatcattttacgtgaagcatcgacatagaaccacatgaagaagcgcgagcagacgtcctccagaaggagttccctttgcttcatcatctccgtcacctcacagccttcgcttcttccccaggactcccaaaattcgttctcccgcccgctgcctccgtttttttccttctcgggagaccctccctggccgtcctcgaagcagtgtccgcgcagccgagtccctgcaccccgagtgccaccggcgcccactctctcggtcgcctcctctctcccgccaggcttccgcccacagtcttctgcagcttctgcgccccagcacaagccgtctgctcgcagtctcctcttgactcgtctccacatgagtcgcggccgagagggcaggtaggcagtgtgcgacagttccaagagagacgcgcggaatgtcgcggccgcgaggctctccagagagacgccccaggaagcaaaatcctctgcggtgctgacgaggcccgacagtgtggaaggcgcaggaaagtgagacggtgcggcacagggaaagagaggcaaaggcagcgaaaaatacaacggagcagacagaggcgtctgcagcggcttctgtctctccccttctccactgcctgcctcgtgaagcgaatctacagtgccgacagaggccgtctcggtcccgcaaccaagacgagttgagccggccccgcgagcctcttccccctcggagccccccggctggagatccatggagtcgaggtgagagaggagaaaggaaagcgccaaagagagccacggagaagaagagagaaaaggaggaagggtgcagtgtttccgggatgcacagggaaaaaatcagggtgtgcgctcggaagaagccttcgcgagcgcctccgcagctacatggaaagagtggcgggtattgcagtgcaagaaacacgctgtgactcacgacgcccaggtgtacgtacaccgcagcattggatgttgcagaaaaactgcgtcgcgcatgggaatgcgttttgttgcccgacgcggaacggctggcgggcgaggacgaactgcagcttggcagcgaccttttaagtgaagttcgtgcatgagggcagcagcatttttacctggtgagcagcaccgcacccactgctgatattttctggggaaaaccgcgcacatggaccggggaaaacgtggttatgcaactgtccgagaggctccttaaaggtccagcagaccacgtgcctctgcaagttcctgtccgccctccaggcggcgaaacgccaccgttggcttggtttagacggtacccacgagctcgattgtctaccccagcttctgaactcctcaatttgaacgtttacgattgacgaacagaagaaaacaagcgaaaaaccagcaagacagcgggttcggtttcccctgcgttaacagcgttccagtgcaaagacaacaccagatgcttcgtctttgatgtgaaacgaagccgacatgttccacgcgggacgcatcgtcccctgacatttacagacgatgaaacatttcagaacgaaacttggtccgtcccgacgtaaaaaaacgctctttctgccacgccgtggtacgaacaagcacacacaagtcagcgaaggagagggtggtcacagacacttgcccgttggcaacctactctgaagacgagcatgtggagaattcggcctatattcggagcagcagctggcgctgcgcgattctctgggagggcatgcgaccaggcgggtgacttttttgcttcgactagaagctgcgaagaagatcccgtgatggagaggcgcgtgcatgtgcgtttctggtcggacagtgctgagacaagaagagggacagagatcagctgaaacgaaacgagcattttttccaaagtccatgctgggtttctcccctgtgtctagggagccttctttcgacctttctctcagtggaacgccccctgcccaactatccagccacca

SEQ ID NO: 3830 - DNA, 4753 bp, Toxoplasma gondii
ggtttctcgaaatgattctttttgggagcctcgctcaccttttctctgtaggagaaaggagagacgcgcgacaaggttcgaacccctcagagaagcgcagctggcgggcagccacagtgacaacaacaaaaagaagaagaagagaagaagaggcatcgtggctgggatggaggagagaagagctgcggcaaaagaaggggacagactgggaagcagcgattcggagaacgaacgtctcctcgctgactaaaggaagcgacggacagaaagcgccgtctcgcgtttctgagcagtggctatcaagagacaacaaggggaagcgggggagaggaagagacaggtttggagagcagtgccgttccgctcctcctgagaggggaagcccggcctacagaccccgcagtgcattgcacaactcgactgcagaagggggacaagcagaacgtggtgaggaacgtttcaattctttttcaggactttgttccagctgcagcgccccccttcggtgtgcatcccctcttccctgttcttttggatgtactttctcgagtgccttttttcatgttcgaccttctggcctctgtgcactttgtcagcaaaaccgtcgagacaagccttcagtctcgcgcggtggagaagaggaggaacgagaggcagagtacagctgagaacccgaagaagacggccaagaaaaaagagaacggtcagatccaggatgcggcgacaccggacagcacaaaatggagaagctgacagtctgcaggagcagttcagaaaggagaggaggcagctggaaaggatttttcaatgcaatgtctcggcaacagggctatcagagagcaataaagatggactctttcctcaacggcaagtctttgaccgcagcatccacaacgcaaaagtcgccggtaaaaacgtttggtggattgctggaaagttggcgcaagcgcaagacgacgaaaagatggaaaggcgctacgccgtcaagaagaaaaacgaaagcgcgggcgagacttttgcagttgggacgcgtggacgaaagccgctgtgtcgagagtgaagggcaagaaagcaagacaaagcagagacaagagtggaaaatccgacgaagcgaaagagacagaaggaaggagacagggagacggagacacaaatggccatttccggagacacgggtggagttcgaggaatccagctgtcattataaagagaatctttcctctctgcctcaacacagaggcatcccttggggagaaatcaagcgggcatgcttttctgtatgagaggaaacgagagttttcgtcaaaatgacgagcagagcaaccgtccagatgcgcggcgtgtttatttctcggcacaatgccgccgtttacagtttgaagctgcatgcgcacccagagagctgtggatggcttgcagaaggaagccgagcgtcttgccctggatagtcatgaaaggagaactaagtcgccatcgaatgtcgacgcattccccactcccgcagctgatcgaacctggaaataaacctgggagaggtgacgaagagtcgagaaagtcgagcctctcgcgcaagttgaaagtaagacagaagaaagacatgcacatggaggcccttgttccgttccgtctgtaaaggagacattgcgatcactgcagaggaaggagatcggatgcagccccttgatctttttagcggttttttcttttgtggaatacagaacacacactttcgtaaccagacgacgtttccgggttttttatatttgcaaagatctgccagtcacgttaacaggcgacagtggtgagacgtagagagcacgcgaaaaggggtttgcactccacatcactccttttcttggtacaaggtgtttcgcgctgtccaccgtgctgttttttctcaaaaggctggtgtgtgcgaaaatcgcccgcggccctctacggggctcaaagtgcatttgcctgtgcagggaaccatcgtgttttctcggggtgagctgcgctgtcaggttctgagaaacgacactttcgtcatgcggaaaaaaagtgaggcctgagttgctggccagaggctgttacaactttcttgcgcgggttccaaccgcgcgtagtcgaactgaggtgcaagattgctactgactgctgccgttttattcgagaagaaggagtctttccatgcccccgttgtgtgacgctcactgcggttcgtgaaagaggggtctgccagctgagaattctctcgtttgctttctgtgtctttgaagacaagttctgcgtgtttgtcatccaaacgcgaagaagaggggttgctcacagggtttgtcgttccacagtttacccaaggatctgacagacacgcatgttccgtcattttttcttgtcgcctcgtagtgtgactcaccaggtggcagatcatctttggagttctattcgctgatatcgtctaaatcgatttcgggaagttcagaacataaccgtactttgttggtctgtacgagcgcgggtggaagcgtgatgctgcggagcatgtctacgtgttgaaaattttcattagctggaaagagaggcttggcaatcctgtcagctaaagagatgaacgtgaacagactcgaagacgagaaacaatgttaggtccaacggcatcgatctagggaaaggcccggaagtcgaagtctttcttcaacttaaaagaacgcggggagatactgcttctgggctttagatgagatttgtgcaaggaaagctcacggaacaggagacgggaagcagaatgtcaaggcaattcagcgatgtggtgcttgaaccgtagtatcgcacgacaatatccagcagcatctcagtcgtaccgttcacttccgccgagctgctaaccctatcatcagcaaaagaagtcaacaatgcgagcgcttctgcttcgaaggagattagcatgctaaaaggagattagcgtgctacttgccagtttctgtggcaaaaaagattaatctttttcattttcagtctacctggtgacaggactcggtgtatttgtggggttagggactgcctcgctctctgtggcacagacacgaactctcgtttcaagtgagacttttcgtcagaagctattcgacattgcgtggaaccacaaatacccttttccttgaacactcgtcaaacatcccctctgcacgaaggcgctggatctctgcaggcagacttagtcaaccgaaatcccacagatatcttcatcacacacgaacgtgagtgcgactcagacgacgcgcgatttttatcagagctgatcaatccaccccgtccggtgcacattttccctaatgtgtattgtttcaaagaaagacttctctttgcggcttctgtggctcagggtacacacgacggcagttgtcacgcgttaattcaagtgtctttctcccttgctcaatcgcgaaaactctttttgttccacgaagcacgagctcaagtcgatgccaacacgccagctgcaacaaatgttgcaagagaggttcagaaagaaggcgcaacgcggaagcagagaaaaggagagacgggcgctcttggcttttcagagaaaaccacctcggagaggccaccgtgttttttgcacacagaatacacttttttctcgtctcttcaacatgcggcgagcatacggaagacagtaggcgcaaagagttttttcgttcagaagaagaagacggcaaacaagactacgaaaacgcctcctctctcgagtacatccagggctcggcatcgggcacaaacgggttgcatgcagtttggagcaaaagggtgaacagccaccttcacgctggagtggtaagacaagaaacctttgaagaaacctattttctctcccccactttcgcctacacagatcttagagaagcaggcgacaccagtctttgactgcaacgacgctgttctgtgcacatgcgttttcaaaacgaagctgagatagaggctctgtgagtcttgtggaagataaatcgaaccgctttttttctctgaaaaactgcacaggaccagcatgtgtcgtttcgctaaaaacgttttttttgtgtgttagaccttccagtgtttctccattcgcggtttgtgtacatgccagttggagttcagtggggcagtctgtaagcttttctcactgcgttcttctcttctgacgggtgaacatcgtctctaatctttctacaaactctgcctttcttccttttcgtctgtttacggtttttgcgtacgtgaaccctcagtcgaagtgaaggagttctttgtggacagcgcataccggttcattcaggagctggggtttcgctgtgtcttggcggcttaccagcctcacttgcccggtttccatgctccctctctgaccccaaaggacaaaggccgccggtctctgtttcttttcgtggcgcaacctgtcacctgccgttattttcgagttttctcggctcagaacgtttcactgccacccgtttctctgtcgcgacttctacgcagcggtcacgagtcggcacacctggcaaaagctctcgaaaaacagacacgacttccaagacaagggccgcacacaagttcacccttgctttactcaactcagttaagtagcaggactgggtttgatgttctgtgccagcccccatcgcggtgatctgctctgtcgaaaaacgcgaagtcggaaagacagcttcttcacgcttacagttcagctggctttcgttcggcgcgtcttcgcttctgtcgggatctccacaga

SEQ ID NO: 3831 - DNA, 3712 bp, Toxoplasma gondii
ggtttcggcgagtagaattagtcattattggtgatcactccgtgtcgtttctttcaaaagacgaaacgccgggggttgggggtggcgcgatgctcgctgccagcagtgctgagacacgcgccctacggagtatatactacgagcttgaggatcagttcagctcttgaaggtttaccgaacgcaagttatgtgagcacagcagagaggcggaaaagcctcaccgtgattcgcgcgggcgcttctgttctctggcgtctctgactccgcaggtgctgcgttcgcagacatctgctgagcaaggacgatgcacccgtgagttcgcgacggcatctgcacggtataggggcaaaggaaggagtgaggaatgagagaagagcgcttcttgcttttgcaatcgagatttttgtctccgtatgcctcgttgggtccccgctgtcatttgaaatcgacttcatcgtatctgatttcacctgcgtggagtcggggtgtacgtacacgtgttcgttgtcattgtacagggtgcgtcggccaagagcgatcttgccaccatgaactcgaaaagaagagggcctttatttttgatgcgttcgttggatcttgacagagttctgtggaagattcatcgatttgtgcatgctcagagcaaacaaagctaaacggttgtcaccttttcaccgtgcaacaggcactctgcagcatctccctttacactttcccggttacaacacagtgaaaaaaaagggggggaagggcgttgagagcggcgcgctggcgtttctctcacgaaagcgccgcactcttgtgccgacacctggatccgaaccggcacagaactgggataaattgaaaatagacacactccacaaggacacaaaccaatacacgacgcgatgagttgccccagtatatgtcgttgccatgcatgcgcaagacggcgaacgtcgtcagggccctgtcccccgtcctcaactctgtgctaaggtcccctttccctgacatttccacttaggaatgtgcacgcaaaggggcatgcagaagaaccacacaatgaacaggtctccagaagagttcaaaatatgtaacagcatgtgcgtgattctgcagaccgtgtttgccctgtggcatccctaacgctggggtgaaaacgcgagttcgactttggcgggaacgccttttacttacactgcggactctttcctcgccacggcttgccgtggaaaagagaaggcattgcctgttttgggatgcttttgtttgcttgccgttgttaccccggctgaactgattgttggacgggacccgctggatacgtctcaagcctggtctgggtcacgatgcaaatgccagtgccatgaggaccttttctggtgtcgcctgcgtgcgccttctttttcccattttcatcgaaactcgccctcaagggagaaaggaggtttcggggaactcctagtaacaaccgaataaagaggatacggctttccactggcaacaaccgactcactggctggcttcaagaaaggaaaaagtgtacgacgacagtagtcgtggcaccaacagcaccaatttcggcgcactgtggacaggctcgaaggcttttgtacggtgaaggatctagactaggattagtcagagaatcctcacaggtttcgcaaggtgcctataatgatgaaagaggtcatactctaacgcccaaagactagcctacccactgcttgaatttcgagtcgaaaactgtttatctgtgtcaactctcggggacttgagggatcatccgccagtactacgctaagcggccaaacataaatcaagccaaagagaaagacggacgcgacagggaaccgcacaatgacgcacatgggctaagagctcctacacatcttcacgaatgataaagaacgataaacaccgctgaacccgctaatttagacacattaccgaccaatcccagtcgacggttgtgcgatgaaaaagagagaggacttcgctacgcataaatgaaccaccttattagctctcctccgtcagaattcagtccacctagcaaggcatatcccaaagcaggggcgcacacacctatatatatatatatatatatatatatatatatacatacatacacttatgactctcatgcacgtacctgccgcaagctgcaggagtctttcgtgttagttaaggagacgaaaacgtacactgtgggtctacgttgcttcatcagtttgactttttcacagtctaatcacattttttaaagctgccgacgcggatctgtagaggcgccaatgctgaacgtcgaagggggtgcccgaaagctctttttgcgtccctgaggcagcacttgtaccacgtacatttttcattttgatctcggttatggcttctttcaaccatgcctgttccagaaccaggagcttttccccctttcctttcgactgaatcgtcctttgcagctgagctgacagcttcgttggaacaggggattttctcccgtccttgctgcgcgcaaggaagcgcttcctctctcgttccttgtcgattgcgacagctgtcttctcttggagcaccatgagcatttcagacttctctgtagctcctagaacagggggcatgtctcgcgatgcgcctgttcatgcagtacaacgtccctctcttctacagacatctgtgtacctctccctctctctgtctgtctatgtatataatatatttccagatacgtacccctacaattaactgaccatctgtaacaatttttatttttaattcactgtggatatgcgtgcacgtgcgtggtcgatagtgaaaaggagtttcgtgttttctgctcagagatgcatgcacgagttgcttgccaaaaagaagggcagtctgtacacctctgtacagagaaattgcagatgaatatgagacatttcctccgtcaccgtttctcctttgagaccctgacagttttttctgttctccggactcactcacacgcattcacacgcatgcatgctacatcaacggcgaaaaacagccgcggcgggtcctcatttgagagcgtctttgcggcggaattggcgattctcagcactcagagaaacccttgtcctccttcgtcccactaaatgaagccaagagaggaactgtgtctctttcttttcctttcgatctctctttctctcgattacgctcgcgcttagctttctctgtctgtcagaacgtggttgtgatctcctgtggccggagagcagcaagccgtcgtccatttttttgcaggatctcagccttcaacggacatccactccaaggaaatgagacacacagaaggatttcggtgactgtaaaccgagtctgcctgtcttgcggaactgtcctctttttcgcttgccattctcgttctcgcctcctcgctcgctccgctgtggccttcgtccgcctcctgtcatccgcttcgtacctcttggcacttctattttcttctcgcaactaacataagctcgtcatccttgctgttcaccgctttcaccttcctcttctcgcgtcgcctctgtactgaatattcttccttttaatcctcatttcagttgtcgtccccgcgcctccgcgatcgtccatcacacagaaaccggcagaagagcgagaagaaaagaggaaaagaggagagacgcgtgaaaggcgaagagaacagaggcatggctgaaggaaggaggtcaagttgggagagaaa

SEQ ID NO: 3832 - DNA, 2783 bp, Toxoplasma gondii
gaagagcagtctccgcacaacaaagcgagaggctgtcgtcgtacttctccgctcttcgctgctgtgcttgttgcctcctgaacggagacaatgtctctgctgctggaaagctctcccgagagcctgcgccgcgaactcccggaggaagaagcgaacaactgagaccgacactgcgcaggcgcccggcatcgcgctcgcagctgtctatacacctcaactgcgccgctgccccacacgggcacagaagaagaagaagagagaccagacggtgaagaagaaagagaagaagatgacgaaagaggagaagaagaagaagaagaagagagagaagacgaaaaggaggaagacggcttcgctgccggtgattctggccgaggtgtcttgcctgttgaagaaagcggttgcgagttttcatcctcgagtccgagagaaaaattcctcttttgttgcctgcgaacgccatgcagggtgcacggcggggcctgcagccgccggcgcggctgcagtgaggccaggagagacgagagagaagagcagaacgaggctgtcggagctggagaggatggaaagctgtggggacggtgcagtggacttcggcgagatagagggtgtctccgcggccgggagttgcgtcgggggaagatgctgccttgagaaacggactgcttttcgttcgcagaaaacgcagagagagtgtctctgatctgccaagcctgcgagcgaaacggcgaggaaagacggccgtctgaagccccagcgctcgggcgcagaccacacgaagaggaggagacagcaaggcgagaaaggagactgtctcctctcaaaacggcgtctcctccaacgcgaacttctgtgaaaacgttgtcccctccaccagtgtctccttcgaagagggtctcgcctgttgaatcttggcgcgaattcgaggggtctcgcattcgtgcgtggagagccggcgcagacggagagacgaagaggtgagatcccggacaagccgagaaggaaggaaaaggacgcgattgtgaggacgaagaggaagaagaaaagaaggacgagtgagaggaagaagacgccgtctgcagagacggagaaaagaaggaaaaggaagaggcgtcgtcacgctccatcgtctgcagttcgcctgatacagagaaagaaagaacgggaggggaagagaggcacaaaactcagagaaagtgtaaagctctggagagcggagaagaggagaaggatgacggatgtctgtacagagagacgctgagtagtcgagaggagggagaaggagtcagtgaaacaagttcttggtccctgcagggccgagaggagatcttttcctggatgctctgtcttgccctagaaggggaacggcacaggagaggaggatgaggaggcagaaaaacgaggacagtcgtgccgcgaagaagcagaggattttcggcgatgcgttgctgaactcatgggacgcgtcttgccgcagatgagcgtaaattccaaaagaaagaacgacacagctgcggtgtcgcggtcaccgcgcgccgcgacggccttgcaccctctccgcgaccctctgggagcgcggccatttgagcgagtccctgcgagccgaagaagcttagagagaacgacgagaagagacggcaggacagggcaaaagagagaaaagaaggagaggagagagagaaggaagacagagaagaaacgagaagagaggagagaacaagcgagaagagatgcatgcggaacgccgtcgggtcgacgcgctggttcttccgcgcgccagaccaccagacacgcgaaaaaggtacgaaaaagaacggggaagaaagggagattcgctgacggatgccgaaaagcaaacaggaaatccgcagtttccttcttctccatgacctctgtcctgcggagagctcggggaaaagaggcgcagatccggagttctctttcgctgtgctgagagagagacaagatcaggagcgagacaaatcagggagtggtgtgcctggtggatgccgagacaacctctgcgactcggagatggaactttcgcgacgattcttctttggaacgcagagaagagatttgcggcttccattagtgagttgaagaccggaggcgacggacagggcgtttcttctttcctcgcggaaaggtgaaaaagtctctgtcggctggcttcgcgaccttcgctgcgacaggtcgccgtgtgatgccatgatctcctgagaaccgtggcgctgtcaccaagttcttctctgtctttttcttctttgagtaccgcccctcgtttgtttctcgtttgtttcgaacgcgctttcctcctatcctatgcgctggacatccttgcgtctcatcattctcacggtctcctcgccttcagtctgcaacgtcatccctcctcggccgtccgtctctcctttcgctctcttctctcttcttctctcttctctcttctctctcttcttctctcttctctcttctctctcttcttctctcttctctcttctctcttctctctcctctcctctcttctctctcttcttctctcttctctcttctctctcctctcctctcttctctctcttcttctctcttctctctcttcttctctcttctctctcttcttctctcttctctcttctctctcctctcctctcttctctctcttcttctctctcttcttctctcttctctctcttcttctctcttctgtctctcctcttctttcttcttctctcttctgtctgtcctctcggttcccgggcctgcgtctgtcgcttgccgaa

SEQ ID NO: 3833 - DNA, 5015 bp, Toxoplasma gondii
gttctgcttcccttcaactcttcttcgttcgtgcccttccttcagcaactctgcagcaccgttctggtgggcaccgcagccaccgcggcttttctgttttccttcgcctcgactgaagttcggtacgagcacgagcaaagtacaggatgttgcctcgacacacaagtccagcgatcgagagcgcctcggtggagcaaagagagaagggaggtagcgtcgcggattgacggtcggcaccccagtgcgcagagcagacggaaagtgaattgcgaggttgagagcaaagggtgcatgatggatttacgcgtcagtcgagggtctacggtttagaaacctagaacccgccgttctgtgtctcggagagagtgagcttgcaaatatagaaaaacgcctcgtggtactagggaacaggagaaaggaaaaccgaagtggagagattcgccgccctcttacggcgggaaacctcgtagtgcgtcttaacttagacaggctcgaaagaaacgcgtaaaacttgaccggtccgcaatttgctcgagtctcgtcgctgaagtcgccacctttccacctgcggtttaggtcggggatccacggactatgtgttgcagatcgacaacgtctgggagcgagaagcatctgactcgggaaactttggactggggtttacggttattcggtgggtgctcgaaaggaaaacggtttcagtcctacggcagtttttctgttgctttttgtctctgtacagaaggcgaggcctgcagcagctgtcgatttgggacgtccacacctcctgaacgaggaagaaaacacgactgaggaaatccctcgttgaggaaatctggaatccgcgttccttttcgatgtgctggttctctccaattttttcgcctccctggctcaccgtagagatacgtcatttgcaacgtgacacggaaacgaaaccgttgcttttcgtcgctcgaactcgttgttggctgccttttgaccgtacagggctgtcaagttttggattcaacatcgtagggacttcaatgctcgtgtgtttcctatctttgtccccggaaagcctttttctttctccggaggctccttttgtctcgcgagtgaaggcaacctcgtcaaattacttgtgttttacgcttcagttcgtctgaagttttccttctctaggctaaagcacggcacgtggacaacctagaagtcgcacggtcgattgacagctactccataagatacaaccatccaagatatattgatctatcgcagtttcggtcgaaaatcccgttacattacagagaccacttcgcttcaggtactttgagaacatactgacgacgagaacggaagtgcgcttcacggaaaaggcgcgttttgcggcgattttcgcttctaacggaactatcgcgtgcaaaagtctggcggaaatgggtgcgcataaagtgcatagtagaaggaactgctagtgaaagtagcagaaagaattccgttgataaactactgcacatagacccttaattccttcggagaaaaagaacaagaaccactccacgctccccgagacttcactacgacctgagaatggaccttcggctgtatctgcacccgcagcgtctcgctactgaacactgtccaaacttcgatctctagcatcccggccgaacaatccttcactttgaaacacacttcccttctcgcttagagcttactcacagaacatcgcagaaaaagtccatcacaggtgtggacagataccgtcgtccgcgcgggaatcgtactgctgttcgtcgaatatagtgtcgcctttgtgtgcagaaaaaacatgcacagaaaatcggaacacatgctcaccaaccgcattaattcttttggtgaaatggacccacccgtgacacgctccgaacatgtttcactttgtgccgtgacctgcagtctgaaattccgtcggtcaaccgtacctcccaaaccaaccagaagaatagtcttttcgacttcagtctcacagtttgtggtgtgcttcagtgttgctccttagcttgtaccgtgacattcaggaacatactgttatatttgacgctcttgtgtgttcacgttagtataacaaatcggatgaacacagacattacggttgctaggatactgaatatggctacagttttaaggtacacgcaaccctgtttttcttgatactgaggattcaagatctcctgatgagtagtttcgctgtcttctgcgacgggcagggctctgtctcagcttgtcgcttttgcgcctttgacgaactccgcagaatgcaaatgcgtttcccaaccagctctcaattcactgtgtgcggccaccgacagaacacgacggagtcaaaatttgattttcgtctggaaccttttacccatctctcgtttcagtttcaatctgaaggacaccgtcgagttgaaccgtgtaagagtccctgaacgtttatagacctggacgtaccactcgactttgttgcttccgtagctatcgaagcaacaagacgattttccgccgtgcatgaccaggcaaatgcgactctcgagtggttgcctcctgcaggcttgcctgcctcaaactaattgttaccttttccgaaacaagtagaactgcacaggacagtgtcacagttcgctgaaaagcatatcgggtgtctcctccaagcgtcaccagcaattgccacgcaatgcacgataaccgcagagggcatgtggtacagaagggtggactcttctttttgcgttgtttagccgaccactttcgagtttttcacacgaccggatgctggttcgcctcgggtgaactaaggatcgggcggcttctgttacacctcgaatcattgggatgtatctttcagccctcttcggcactgactggcacaactcccccacgggactgtgtgttgcgccttgccgttccttcacccgtgcgtaggaaagtggatttccaccgtgtcgcgcttgaaagtgaagagtttacagcgagacgaacgcaccccgtgcaaatcgagcagtccccggggaccggtgtccgagcatttcctgtagtgtccaggcactgaaacgaggaacgcggatatgcacacggccgctggcaaccgagggcgtgaacttccaaaaaatccgctggttgccaggaggaaacagacatttggggatatggccttcgaaagtgtgtaaagcaagtcgttgctgctaagcggccccaaaatacaagccgtgagtgtacagaagttctccggtcccggacctgtgtttttcctcagaagcacagagctacctcaagtttctagccctttcactgtcttcgaggtcaaacccctgtagagaattctttctaagcgaaccccgacccgtgaagaaaaggaggaagcccgagtgtagttgcacttgccctcttccacgtgtcttgctctctgccacgacgccccatctccaggcctcgcgaacatctccacctgttctcctggactgcgatttgtgtcctcggtgcaacatgtttctgcggcaagatgcggatttcgctgaaaaagccacttggggattgcgcccgacagaacgccggccagagcaccccgggccgagcagagttttcctcgagaatgcagacagctcactgagacagcgatgaatctcgcgtatacgccgaaggttggaaacagcaggcggcggggtgcgacggactgccggagtagtcgagtgcctctttggcttgagaaacaaggagaactccgagctcactaccccgtgtgtcgcgtcttctttccacgccctttttctgctcctgcggcttagctgtttctcgcgtcacctagcatgtttcgtgcctctttctctcgggatcggcttaggtcttctgcacctttcctccaggtagagagctgagactcgagtggccaggaactcccgcgttccactcgttttgcggaaactcgtcccaccagacggcggttctcacccagcctcgatttcctacagaggtagcggcaggagttcccgcgccgacaagacagcgggcggaacgcgatgcgggagaaggcctcgacggtgcaaatttcccttttttctgttctcctgcatctgtgcagtgtttttctggcttcctcgaaaggcgggcactttctcctttctgaaactcgcaaccgccatgcgggcaagaccccagaaagtcttgcgctctccatacgtgtctccgtgaaaaggctgtcgagtcgtttttgttgagaggtctgccgttggtatcgcctttgtctttttgttctctgcctccttttgttccccttcgggaaaggcgcgtgtttcccgcgtggcaatctgtcgaatgtctttccggtcctcgtctccacgcgaggcctcccgctcctgtccccggcgcggctggccttttcaagtttcctcgtttcctcgtccgtcgattctcttcgtcttggctctttcgcaatttcttgcggtccacgcgcctgcttcctccggacttccccctgatatgcccagtccgtggctgctcggttcctctcgtttccgaccggcggtttcactcctcccgcgggtcctttctgccctcaaactctgcggcatcttgccccaagtcgctttcctcaggtttcccttcgtttgcagtctctgtcaccatgtcatgcggtgtcacgcagccgacggtggtcgctctccgaggttctttaccttgaccgactcgctgtcttctgcagccacacttcccaccttgctcccgcgtcacactgttccgagcctcgctcctttgtccaagaaatccctcttcccgcggccttttcccctgtcacaaaaatctgcccgctcaggcgtcatccgccagcactcgtgccctatagcacgacttccggtgtacagacacactgtttctcggtctcgagctttcgtgcagagcactctccttttgaacgcgtttttaactttcctcggctccaattcttttgaatcttttaaatcctccggcggctttcctccgccacacctcccacaacactgcaa

SEQ ID NO: 3834 - DNA, 1517 bp, Toxoplasma gondii
agagagttccatcacaagcttgtgttgcagttgagtcgaaccagaaaaaactgaacgggacttggattccagtagaccccgaccagcgggacaaaggccacttgtactctctagaagaaagagacacatcgatatctgtaggcactaggaaactttggcaggcagttgatcaattcagggttttgaactgcggcactagttgcagcagcaagaagccacttggcagtgagagatcccttgttggagtttcgagttccaaacgaatgacggaaaaacaagatttcttgccgttctgctggaatacgagtttcaagagggatgagtaggcaagtcacgatgagacatcggcaagtcagtgcttgctcgtgcgtcactcacatgaggtatttgtgcgacgactgttaatacatgaccacttaaaacacgtcgcacctttatgcttttcgacatcacaactatccatttagactgcacttgaatggactttcgtaacatgtgcggttttacaagtaatgtcatccaaaacccgtgccaaacatatgcatatcgctttcttcaacagcgttacactctgtagaaccgttacgttgacggggaaaggaattatgttagtgggaaccacacactcatgttatgtcgtttattgttctagatcaaataaatcctggttgacctctgtgcttcagacgaatctgtaatgaatgtgtgagctatcagctgccctttggcctctgtcgtcgattcgagcgctccagactctactcaaggaagcatctcgcttcacatattttaatcagaaccttgtcccgtgtcggaaccatattttttaaagtcgttatgaattgcgtcaggaccaagggtgagaaaaaagaaggctttgacccaacatcgtgggacgaatacgtaaaaagtccgcgttagacaaaatgcaaagaataccaacgataggtgtctcgtaatttctgagaggtcgacaagtcccacgagcgacagtagtaggggggaaccgcggcaccaaacaaccaatgcagtattccttttctttggcatctctgtttcttccgaagtgacaaagtccacaaaagaattcaatttcctggaagagctgtttagatggcatgcgcttctgcccgctcgctggctggacgtctgccgtctccgctatagggtctgtcgctcgtgtctccgtcgatgacggcatgcggtgaatctttttcttccgctcgtgtgacccttgtgttcgttcattatagagcgtggactgaacctatgtgtttttatggtgaatttcagttttttcaaagcctgatagtcgcagtacagcgtcgtcaggcaccatttctccgtcgcgaatcgcacctgagtgaccatggcacgagagatctgcgtggcgaacagctccgtttttgtgaatactcgctttaccacaaacctttccgcggcaacttagcaacttttcacttcctctacgtgttagaaagatctcagagggcagtagccatgatgctcggatctga

SEQ ID NO: 3835 - DNA, 1575 bp, Toxoplasma gondii
cgtttcgccaagtatgattctcgctcacgaatagcatatcctccaaccacgtacagctaatttggaggccccatgctgacagtggtcgttgactaagaattctagagcgccacaacgatccacgaaattgggctggttaccccgcgaaacgggttgaatgacgaaacaatagttgaggcactacagtgaacacacggatactaagcagtatgtgagaactctgtgcggagccaacacctgtacttgtcgaaagcatattgagactgggatccacatatcacttagcctatttgtactaaccagaatgataccatatgatgtaacacatcggtttcgagacacttgagctaagccttgggtggcaggaaatcaattatacgcaaggtctcgcgtaagtgaagcaaacacagattgaaggcatccgtctgttagtgtgacgtcagcgtgccattcggttcccttgtatcacggatttcctccggccacggggttctccgaaaacgcctctttgtggcgtcgactgtgccagtcttctttacagagaacagaagcattcttgtcacgaatagtcaaaagaaagctcgacgtgttcgtccggttatccaggggataatgcccatcgcaaacctactctcgaccgacgagagaggaaactgagagaaatgcagacagacatcgggtgtctgctctataccgctggcaaaagacgaaaatcgttttcatgctggttagtatatcacacgactggttgagtcgcaagacctgaccggaacaccacgactccatcgtctgggctatctgttttgtgtgaagtgtgtggttagtctgccggaggttgcatataaaggagtggcttaaacaaatggccttttagacgaacacgccaagagaagtagaacgcatttttgctccgcactgtctatcgtagggctgaattgtttcgctcactgacacgtcacctttcgtcttttgtgctggtgttcagagcactctccgacacaatgttcgctctcttcgtgttccagcactcgtttatgcattctttattcgcatcaggtgacgcgaaagccactgcgagtttttcttacttccgctagtttcgatttcgcacccatccatgctactgtattgttctgtcttcttgttgtgctgtatagcaggtgatatgttccatcggtgcttgatttatcttccaggttcaccaagtgctaaaacaaaccgaatcaactgtaaggatcaggaggaaaaggcaaacggcagataagcatttttcagtgggttgttcctgccgctctccacaaacgtgagcatccctggttggggtcccctccggtcagaggaacactttctcaattggcaggtttgcatctcaagtctctttctgcatcgacagtgtagccttcgaaattttttgctcccaggagtttcaagcaaaggtattgctttctatctcagttaccggagacggttttggtttaaggtggattcgtctattgttccccacgttcggggtcgtggtaatcctctatctacttacgttaaacggttagaaccgcgatttttgctgcattaaaa

SEQ ID NO: 3836 - DNA, 2596 bp, Toxoplasma gondii
aaaactgaagagcgaacctcgagagctcatggaagtctaacaaggttccccggctttcgatgctctctctgaaagagccccttactctcgacaagtgccaacctacacacaaatatactcatctatatatatatatatatatatttatacatacttatatatatacatatttatacatatatatatatatatgtatatgtacatatatatatatctgtatatctatatgcacatatgattgtaaatttatgcatgtgtgtgcatgcggtgtggacggtagaagagagagaagagacaggttgttttcgctctgtgtgtgaacttttttgacgaggatttgcgtcggcgaagcatctttgaatgtagtgtgaagaacgatgtcaacgcctgtcgcttcggctgttcgggacctggaagtctgtgcagatcaggttgcctcactgcagcgcgagcggcgtttgcctgttgcttgatttgtgttgtcgagtttctacgtgaggaaacaggtatgagtcgcgagtgaactccacagagttttgaccgccagaacgcaagcgctccgtttaatgcgcgactttctttgccgtcgagaacggccgccctttccgtgaagtctcctggcgccgcgtccgcgacagacggcgacacaggcctgaacaggaagtctctgtccagcgcaggactcgactttccagacaaagaaagtcccccaacgcacacctgagcggccgtgagtcgcaggcagtgcagaacgatctcagcggaaacccgcagcgaggcagcatcagtgaagaggcgctccgctctaaagtcctgccgctctcgaacgcgaaggagagagcgtctcgcaatataacgtacattcatatatatacatatatatatatatttatggatatttataatgtatatttatatatgtatatttgtgtggaccacagtacataggccacaacactgaatgcagacaatctgtgtgtagacgtttctttctagggtgagacgcatccgttgtcgtagttcgcgccttttattatgagctcggcatgtgtgagggtggctgcgttggcgcttcatgtttcttggagtgtacgcatgggcgcgcgtatttctcgaccttttcacaaagaaggcggcgcgcagatttttggaaggagtaaacggaagttctgcctgggagttgcaccgcctggacgctgcgccggcgagagtgccggacggacccatcgacgggcgcagcttcaggtcgaaacaagaagagaaactgagcgagaaacagaagcagctgtttttctttccaccggcgaagttggacagagagaatgagccatactgcgtgtagcgtttcggggagtttggtcggctgctgccgcgctttttctcgaattggcccggcaagagaagaaggaggcgattttcgactcgtatggcgcggagtctctctggctgtgtggacgcgaatgcaagaaactcgacttctttctcgacctttttgcccaccagttttgtaccccgcatgctcctcgcttttctcccaagaaaacatgtccactttcgacggtcctttcgcgcgaaatcacgagttccgaccgccatactcccggcaccaaaacacagccagcaagccatgcgcgggtgtgtgtatcgcgggcattatagaccctcgacgctgccgtggtaactctctttttcgcagagttcgcggcggcctccccgttccgcgctttttctccccgcgaaggcctcgcgagtttctcggaagtttggtctttgctgcacctcgctgtccggaagttcgcctttcttgagaagaacgcgaaaacgcgcgtcctctgccgcgactcgcggccatcgacgactcaccaccgtatcgcgaagctcacactcgacggcgcgagcgcgcgccctcggctttttgctcttctcgcgggtgcattcttctcgcagaagaacgcgactccaaacgcctctcgacaatgagcctgtgcgaccaggtcaacgaaaacgcctgacacttgccgcatgcatgagaactggcgaagctcgactacctctctcttgtctgctccttctctcttccaaacagacagaaaaacgcacactcgccgacagcgacgccgagaaacgccttttgagtcgcaggacgctctccagctgtttttcctcctctcctctcctcttcttctctcctgatgtccaaaaaaaatgaagttgctctgctgtccagggtagtcgctctgtgactctctctctaagcgcggaagaacgacttcctggaaggcgcccccgaggcaacggctcgcaacggctggtcaccacaacttcgtcaaccattctttcgtctgaatctttttgtcctccggcgtttcgacctcgcctccaccctcgtcctcttccactgtctaccttcctctcctctctttctcttctttttcctctgcttcttctctctctttctctgcttcttcccctctctttctcttcttcttctcctctctttctcttctttttcctctgcttcttcttctctctttctctgcttcttttctctttctcttctttttcctcgaatcccttctctgtttctccttcaaga

SEQ ID NO: 3837 - DNA, 2188 bp, Toxoplasma gondii
ttttcgccagagactttgtttcttcactggctggcttctcttgacaccaagccgctggcctcgagtctgtctgcggatgaagggaagacgaaaacaacgggaccgctccaagttctctctctccagtctcctcctggcgttgctcgacgcgttcatgtcgtcgtccccctcttgctccaatccatatcttatccagccggcggactgtgttctcgcagtcacacagactcacccacaacgcgccagtggccagggcgagaagcgcggcgcgtctggcggagcgtggaagctctcgagacgactcgcgggaggtttgcccttcgaggctcccgccagctggactggagggcagcggcgaccagcctgtcgaaaatccatgcgaagagacacgaagagaggcccttcttactgaaggaatataggggagaccgcctcgaaaggcgagtgaagcgaattgacccacaagcgtcttttcgtgcgaagagctgaacgcgaaagcgttttcgttatcaaccgagctattcgaaccaaaacgccgacagccacaaaaaatggttgggcatattcgttgacttacacggaatgagggcacgagcaccatagctgcagaaaccgacgacaacacgcggcaacgagtggaagaaaaaccacctggatggctgcaaaagcgtagcgcactcgttgattcttgagcgcgtgaaccagtgaaaacgacctgcgatgtttctataggcaaagccgagctcaacgagcttcggccgagaaagtgacgcgaccgaaagtgacgatatgcggatcgcgttcgaggagacagacgggaaacaaagcgaagggcagactctggcattttcatagttgagcgaaaacaggagtcgaaacggaaaaggggcgggaactaggcgacaggagagtagagtggattggtcgcggcaactgcactcttacgatgaccaaagaaaccgtcatttcttcaagacaagcttgcttcttcgagacgcgcggcaggtcattcagaagcaaaagaaacataccgcgaacagatgagtcagcataagccagttccacgtgaggctaaagcgaaagcacagcgagggcgtttcttgtctgtacctacgccacaagttgtggcacttctgtgttggtactgcgtcgagatctaccgtattctcaagaagttgcgatggaaaactgtctctacgtgtggaatgcggcgcactgtgcatgcatctcgccgctgtgtcccgaggacagcaatgttgcagtttccgccgcagtgtgtgtccgtgtccttttaacaggcaaaagccatacgaaaacgcaacaaactgtttctgtccaaatatggagaatcttcgtcaaagagcgtccgtcttccatctgtacaaatacctcgccgttgcatgcgggccgaggacatacacatgcagcggagtaaattttcgaaacaggagataaggctcgcgcgtttgtaattttgttattccacatgcgtcggttcccttttccataacttgcctctctttctgccaaatctttgagacgctggtgagagcatgtgctgtcctgcaagacttatcgcaaagaacggcagagctctgccttaacgtggcgcaacttgatttcggaaatcggaagcggcacaagatcccaagactctcgaccggaggagacacatgtgactaatcaggagtctctttttgcgttgtcgtaacaagagattcttttcttgcccctggtgcagtcaacgtttacgtactcattcgtcgctggcatgttcttcaggttccgctctaaattcgttgaatcatcgggtgtctcaggttccgcttccgttaaaacgcttcgtcgaagttcctgaaagccgatccatccctcatgcccggcacctgtcgagcttcgcctattcgtttccgccgcgcgttccactctagcaaagaacggcaatcctctcgtcctcgacactctgaagcgtgtttctgcagccacaaaaattctacgcaaacgcttttcctaccctcgaccctttcgttgcgtctcacgttttctcaaccgcacaccgtgaccacggcgcctctcgctgctccacctatccgacaagttgggaagcacggcaagacgccgaacgcggactggcagtgtgtcttcctgttccttgaacgggagaattcgccatggttgtgagccaaga

SEQ ID NO: 3838 - DNA, 1804 bp, Toxoplasma gondii
ttatacgagtgaaggccctcttccttgtctaaccaacacacatgccgcaagcgttgttccccattttgcgacgggagtcacaataatcatgcaggaggcgtgaagttttgtactctccgagctgcggcaggatacttttggacctgcaacacatctgtagaagtgatgtagggtagtgcattctctgaacgaataaggttccctgatggctgcttaatccgcccaaaagggataataaagggatgatgtgtgctgcggttgtcgatgacctgaaggaacgatcttcgatattgtacgattgagcacgagcaaccacgtgtgcactagtgaacgtcagtcaaggtcgtgaaggtcaggaaatagtaaagaatgcgtgaatgaaatgcgcattcactttgctcagaacaccagccgtatgtttggtagctgcttgttgccgcgtctgggatacgccctctgaatatcttagtttcgagtacaagtcaattcaactgcgtcactgttatacgtgaatcagatattatctagtagcataggggaacgatgcgttatgattggatctgccagtttgtcggcgggaggcgacattgaccaatcccaaaatcaaagtgaatcagtcacatgcttccagctcctcccggttttcattcgcaagacaaaactgtgaaccagagtattcgacgactcatacgggtgagagccattgatcagacgacaccaggagctgctcatcaattcgactcctcactgcttggaaaacggggcaagcttcgattcgttcggcttctggtaaagcagaacgtgtaacggacaccgaaggtgcgttcgttaatgtaacgaagtattctacattctggaatactgaaactctcacaactgatagggggaatgatattgcgacgacagcggtaacaaagccactagagtgctttcactgactggcactgagttgtctgctgccaccggagttatgccctggggtgctggtgtatgccagtaatcgttcgaagatgttgacttccgtgagaaggttcgccctttcgtcccttacaccgtagcaatacggaagagtacttgaaatgctacattttgtcctggtgtgttgcacgatttgctgggacaaacaatggcagccgtcccggggctttcgctatttgggatggcctcgctttttggtgcccaaaagacttgctcagtgtgtttccaaggcgacagataggcatttttgatggaatagaagagcatttttccccgccgaggtttgatagtaggtaaaggcgaaataatttgcttggttaagccctaaggcggagtcgctttctctcattaactctattgcggcgatagggcggccgtgtacagcacggggcccctcagcccacagacagaaaaatgtgacgaaactgtgaaagtgctcagtgctgcatgaggacgagtagatcttgttggcgtccataaacacgtgtatctgtccacggctccgaaagacaatcgatccttttgctgagcccaccgtaacattaatactcaacgctgacgcccgctacgaccgtcccctcccgtttagaagatttgcagcagcgtatgaaggtaataaaaggaaccgatcgaagcttaaagcagcacacgtttgagttgggccgacacaaagcggcgcgcgttttgaggaacgaaagctggatatccccagggatttgtcaataatctaatcgactcgggtagttgatgcaacgatatggggataagctcactcacagtccagggtgctaccatttgccacatttaataaagcattgaatcagca

SEQ ID NO: 3839 - DNA, 1290 bp, Toxoplasma gondii
gcagcggcaacttgtggcggaacacacctcccactggttttattcgacaccttttcctttttttagcatgcgatgacaccgggtattagtgtttgcgaccatagtagtgtattcttgaaatacgagtacgcgtgaggttcccggctgtggtgtctgtaaggatggcccgggtgtttcgtttccgcagtagcagtatctctggacactgaatccacgagtgtgaatactagattcgtgtttgtattttcacaactcccaatggtcgagggcatgcgtgcatggccaaatccaccagagatgttccgggttgccggatgcaaatggaagttcgcatgacgacgcagctgaaagggcagggggttgaacaggtcaaagttacacatcgatgtgcccacggtagttttagataaattgagcgctcgcgcaggtgttccgccgccgcaccgatgcagccggaactccaagggaggttctacatttcagtagacgcagaaaaaaaaagtgaagtttctgccgcggctccattagttacagattgttcagtggtcgtggcttcataagtgaatcctatgaggccataagaaagcgcggttcattgtggacgcaccatttctgggcagctgcaaagtgcacctcatagtcagggacgcttctgcgcagcaggtgtgacattcgagctgtacgattgacaaatggctttcgtgaaaacgaacatgccaccactaccactcttgtagtatccgctgcagcaggccatcgattgcttctcgtctgacatgtctagcttcaatgctacaaagagcaccgctgtgtcaaagagtcgcgctaccttcactagaagacatcctgctccccttgagttccctaccagtagacctttgtttatctcactgcggccatcttaccattaatgtagctacatgtggcaaataaacttctgctgagactccggcggcgccacttctcgtcgttctcgccaagctcttgatggtcacctcgacacaaccgacagcttcgcgcaataaatggccttttatgtccagatcgttgtcttcaacagatacttcgcattcgtggatcgacacgcgaatacatcccattgttgtacgtgttttgatgacagcaatcttatgtggagttactgccgcgctgatgtctgagtgaacttgccatatgcaataatgttcgaaggggaagaaataccacgtggcagcgaaacgacactgagacaagatgatacgtgcacagcattcatttttgcttaccctgagggataacgaacgaattcca

SEQ ID NO: 3840 - DNA, 2417 bp, Toxoplasma gondii
cttctgtggagttcgaaaccgtccttcgcgtcaggctatctcccgaagctgcgcatgtcgtctgctccatctttgcttctctctctgcttctctcgcgctttttctccttgtaggcactcaggacctccccctgtgtctctttgccttccctctccgttctctgcgtcctgcctcgtttcctcgcgtctccgcgcgcgcttctctctcttcgcttcctgctgcggctgcgtcctctttttttgtcctcttttgcggcctggtctggctgagttgtcgtttacaagggcacagaggaagacgcggaacagagtctcggttcggcctcgcgcatgaggagaagccgcgggtcctcactctgagcactggctccccggcggcgaagtaggaaaggcagatcgctttcttcgccagttctccgcgctcgcgaagaagaacagctgctcagagagcttcacagtgccggcccaggagagagaacgagagaagagaagaaggtccaggagaggggaaggaaaacggaaggagacccggagaggacagaagaatacacacagaggagagaagaggaagacgagagaaaaagacgaggaagaagcgaacgcaggaaagaggaaaggaagaaggcaaagtgtcaacgtgcagcagtgggctttgtctctctttgcgtaggaccaaagttcaaaaggaagaggcacaacacagacctggaagagcaagagaagcgcgttctttcgaaggcttttctcacgactcgtcctctctctctttcctcctctctctctctttcctcctctctctctctctttcctcctctctctctctttcctcctctctctctctttcctcctctctctctctttcctcctctctcctcgtcggttgctttcttgtctcggacgatgacttcgtcgactctcgcagaggaaatgcgtttcgcgactttggcggcgttgccgtgtgttcactggttcacctgcttgcctcgcgcaccgccttcgctgcttctgtcgagatccgccattgtctctgagcagctccgcgaggcgggccggggtgtacagacagccgagaagcgcggagtgcgagcttcttcccggcgttcaaaaagccgaggaccgcagaaggattgtctttttggtcgagctgcgtctgcagaagtcgcaggtcaccacccccgtctccccgcgagcgaagaaaactgggagcgaggaagcggaagctcagggagacttcctcgaggctggaggaggcggagcgcagagcaggagtcgccagaacaaggcggaaaatctcaaaaaaacgcgtttcccctctcctcccggtctcgcctttcgacggtgtgcgcagctggaaaagagggagagagctgcgaccacggcgccgcgaggaaagaggaaggaaaacaaagccggcgcaacgccttcgcgaggaacaccggaagctgcggccaggaagaactctgaaagagaaaaagctgcggcagagcgacgcttttcagtccgcggagatgatgtgcggtgtgtggagagagtcgtgacgctgaccgagagagagagagcgacgcgcgagcgacggcagtgtgtgatgcttgctcgcgggaggctctcttcttactaggtcagggggggggggtggacctgcacctcaaaaagcgtacagattgtgtccgctgtttgcgaattcgcattcgctgttgctttctccatttccttcaaagcaagaggtcttgaacaacgtcggagagaggcgaggttggcggatcaaaagcgattttccaggcgctctggtggtggtgccgggcgagaagcgaagtcctcgcggttcggtgtctcgacgaaacgcaccgccggcgcggcgtctgcgctctgcacagactcgcgcttctgctcctctgtgcttttttccttctcttttcgttcgcctcttcaaacgaaacgcgcgaactcaggagaccctcgcgcaacacaccgcgcgcgggcgcaggaaggggaacaaacgcgcttggccggcgttctctcttcggcgcagcgttttcttccaccacattctgcttcacaggtcttctcgccttcgtctcgtccgcgaaaaaaacagcgtccagagtctttccgtccaccaaaggttccacccgtcgctttctcctcgttgcattttcttactctgcgtactcgtctcgtacacctcttctctcttcgagtttcctcgtccgccgtcgcgctcgacctttctctccgttccgagcgttgtctccgtcctctgccccgctctcctgtctgtcttttcgttttccccttcgccagactccaccgtcgtcttcctcgctctcttctgtctcccccctcggtgcctcgcctcggcctggcctcgtggaagcgttgccgccgcgtccgctttcttcagcgcaagagaacgacca

SEQ ID NO: 3841 - DNA, 4873 bp, Toxoplasma gondii
gtcaatcaatgcaagtaaactgcatagaagtctacttctgaggacatctgggtaacatctatagcttagtttaccttagcaagtatgtatataatatatatgaatatatatatatatatatatgtatatttatgtatgtgttcgtacaaacttgcgcttgtggggccagaattatctacctgaatatgcgcataagaacgtgttgtgatttgccttcgcatgctttgtgcgtctgttggatcgcctgtagctttccttaaaacagtcagcgctcttttctcgacgacacatccatctaatgatgctgggcagacgagttcaaccttgctgcctccaccactctacccagccttttcgaccgtcgaccatgatgaacaagccgacggtctgggtaacgtttcttctacatgtcagagcaatctctgttgatttaaccctctcattttcagggccggaaccttgctactctcccgttcactccggctacttcctacaagaatgcaggcgacgcttcaaaacgtcatatggtggcacacttgattctgttcatattgcatacgagacttggggaaatttgaatgcgtctaaaagtaatgcggtccttctcacctgtggactgtcggcgtcctcccatgccaggagtagccccatgaatcctgaaagtggtccgtccccattccagaatgtttcgggggaaaacagcctaaagctacacggactctagatttcaacctttcacatgccggctagtgatatttctaaggaaaggtgctgtcattctgggatatagtgataccattgtttatgaggcttattctgataaccacatagtttcggctcttccatgtatctttcttacaaccggcatgcattgatatttaactgtatccaacttgtgataaagaagggcttcaagctttcaacaggaggaccatgcgatatattcggaacatgccggtgtagatgttcgctgttggtttctcacctctacggtttcagtattttaccatagaagaggtgacgttgaaaagtgccactggccaccacacatgctgccgaacgatttgttcctatgtgtatgtggacgcatcgtcttccaggctggtgggagagctttattggtccaggtcttgcattggacaccaacaagttcttcataatctgcgtatctaacttcggaggttgctcaggaaccacaggaccgagctccttcagcagtagaggcgacgggaagctcatacgttatggtttggattttccgatgttttcggttcaagatatggtgcgaatcatgttccgcgttgttggtaagattcatcaatgagtacggtgaagacgatttaaaatggtctgtttgtagctggctttgcacatcaccacaacatgtctgttgcagggtttaattctgcttttctctacgcgttcacgtgtcgagtatgttgtggatcaccagcaggataaatctacacgttgcttccatgtgtcgaaaaggtttgctttagcatccttaagcagactggcaagttgtttctacaatacataatacagtagaagcgcaacgggcgcgttgcgtctgggtacccgtcaccgtcaatgacaataccagtagctacatctggcacgggagtcttgcgatgaaacaagggaaacacttgtctttttcccctgtttcgaatgtcaccaaagattcggatagcccatctgcttccctgcaaatgcagaccacctgggagtagaaactctacatgctgttgttggcagcagcctgggtggcatgcaaagcgttgccgccgcggccatgtacccagagagggtgaagcgccttgtcagcatcagcggtgcggtaaccagttcgcctctctcaattgccctccgatatgctcagcgtcaagttctcgtaagcccctgggtagaatttttgtcgaaaactgcttggtgaccctggtttcggggtggacgagggtgtgtgcaaaaaacggccctgccagcagttcgttcaagtctctttgtccagggattcacgtgtcgctgttaaaaacggattagtatggcagaacattaattattgattcaaaaataagaagtaaatggagagatgcaaacaagcccttcctcgcatattttgaaaaagagtgcgaatctatctagacagggccactaacccgttcagtacaagtctaaagtcacttgaattttgtcgatatggcgccatctgcgagaacttcgaagtgtagtgaacatggtgctacgcagtgctctttgttctcccagatggcagatccccgtttcaataatggcaactactatgaaaaggcatacccgtttaccggcatgaaactcgctagggaaattgcaaccattacctaccggagtggacctgagtgggcccaacggtttggacgccagcgtgttcatcaccatcttcagagcgaggaagcttctcagagtgaggaacgcccaacaaactttgacacaaaaagccgatacgaccatcctcctacgctggccccggactttaccgttgaggcgtatctggagcatcaaggcaagaagtggtgccacctttatgatccaaactcgatgttatacatttcgaaggtgagacagtggcacacaacgtcagcaggaattagacggacggtatcgtgccagagtttcttttcttctctacgttctgacctacctgctgcgaaaatcgtttgttttcaagggaagagtcaagctgctaagagaaaacgtcaaggaactatctaatttccgtttgcgtgtgtcaggtgactccacagggtcagcacgaaacactcttagccagcgtgatgccagcgacggtcgtttttgctgaagaaaacaagatagtccataacatcttcatgtctggttctacgtggctgtttcccgtgtgctcgttgcattaggcgatggaccacttcactttggaagagcctttagggacgaccggagagctttctctagaatatggtctgcgccgagtgcgtatgcctgccctggtcattggcgtgaaaagcgatattctctttccaatatggcaacagaaacagatggctcattcgctgcagcgggcaggaaacagatctgttgcattttacacccttgattcaatttatggacacgatacattccttatcgacgttgccaacgttgggggggccgtaaaaggtcatctagagcagagccactcgtagttttcttttggtcgtgctaaagcactcggaggaagcccgcttagaaagcattcaacttcaacacctcgtcaattttcaagtggtcgtaacacgggacatacttcatggacaggtatttagccaggctttgccctggatccctgcacccctgcgtgttctatttgtggaaaacttcctgatgggtcgtcatgaggtacctccaataatgtggcctgcctgttcttaatgtcaccatgggcactgctagggttcattctcaaccaaatcacaggtcggccttcatcgcacgaacgcgcacacacgtgaacaccttacacggtaattacgtgattctcgttcatgcagcaccaaacagcgcaccacagcaacaagcatacaacagcaaccagcctgacgccaccgctgaaaaattagccttgttacactcatgtagattcttgtttcagccaatgtttgttgcagctccgtctgaaatgctgcatcttgttctggtcagtgcagactggagtaagagcatcagaactagaattccctagtagaggggctgtcccgttggcaccctcatgggggcaaccactcatgccgcactgccaaggaaaatatgagcgactctcgcacaggcaggagggtatatcccagtcagatcttctgaaagcctcaagaacaaacggaacgttattcgtagggacttactgaacttctgtctgccacctgttacacaggaaccccccttcaaacccaccaaaggcaggcaccgttgcatctcacactggagcacgagacatgggggggagggggggggacgagatagacagggcaagagcgggaaggttccttgaactgcaggaaaagtagtgacgccctgtcagaaagaactaacgctctacaaccatcatctacaatgaaactttctttattccgactaaaaagatgttcctgcgtttccatggattcaaccaaccgcttctgtgcagaagttcatttacgctggctactgcatgctgcggttggtagtggaactggtcgtgctccattattgtataaggcttcactgggaacacaacatcagagacgacatttcaacccttgaggatgttagtaagaccgggccaggatggctggtctactgtagccaactagatggacgcgcagaccacacgcagcgcttgcgctttcataacttttacgcagagtgcggctcgatttactcgcgattcgcggctgcactgcgagcaagcactgctccacagcacattaaggatttcccatagacgagaaaagacagcacacaagaattgcttttcattagtttcaactaattttggcacaacatcgtcaaagcccttcccatctgcgtgttccacccatatggttggacgttacagacatgcatccgtaggcgacctcgtcttctgcacctcattccaagaagatatatccgaaaagcttgtgtcctatacgtgctatgtcatgttccattattcttttcttgaaggtgtgtggtatggactgatacgtgggcctctttagtatcgtggcacgactacgcacttgggggggcggggtaattgctctgggtcgtgtgaggactccttgttaggcacccgggcgttcggttgtcgccaacaggtgcagtgccttgcgacggggaagctgtgagacagctggca

SEQ ID NO: 3842 - DNA, 1707 bp, Toxoplasma gondii
ttctttttgagttctggcttctccgcagtgtccgagcttgagtccacagacaacactgaaggctcggtccctagtttcagcgacacgtcgccagtgtcgtccccaccgacgagctccccagacattggtgccttgctgtgccactgtctgtctctctggctcttttgatccctacttcgccgctctaagaccgacaaatctccgagttccgccagggaaacaaccggtcggtgtctcaggcgctgcggactgaacggaggcgacgttggtggaagttcacgctcagcagattcccgctggtgaccaggaacaccggaagaatggctaacctcatgtctgcacgagtgcgactgcacatgccgcacagaggaaggaagattctcactcgttggaagagtctgtgagatgaaactccgttcatttccggaggaaagggtcacttcaccgtcacctgccggtcctgtgtgtgagtcacgggctttcaaaccttctgaagcgctgcgcgcggctcctgtttcagcatcctggcaaccagagcgttccgtctgtccgttccagcaacgaagacccagaacggcttcgggtgtcagaccccgattgttgacggaaggcagactccgaagaacaccggacgaacagtcgacgtcagacacatgtgcgttcggctcccactcgccagctaccccggcttgttctgcttcgttcagaacggctcctgccttacccgttcctgagacgtgtacacctttccgagcatgctgctgcagtatcagtttgatatgggacgcgcaagtccagaaatccctcagctgctgctcgactgctgacaggaagaattggccatgggcgaccaactcctgaagctgaccaagagacagctctgaatatgggacggctccgttttcctctgcataccgtgaacggtagacctcgtccgctgcatcaccctgctgcatgatgctctttccccattccgtctccgattctggaagctctttttccaggttgtcgagacaaatgtgaacagtggcgtcgccgttcatggaatcgcggagagacacatacggcactgcgaacaaacgccaaggtccgtgtttcggctggatggcagggtacatgcgtctcaggtctccgtctggggggcgatacaacggatcactgtcgacaccgtcgaacataaatctgtggaaaaactcgtgagttccgacgtgaacgacagcagccagcaagtccggatgttccagaggcttcagtgcagccgcggcggctgcgccgcctacgcgcacaaggcattgtcccagagcttcacatttttcccggaatttatttttgctttttatgcgacaacgaatagtacgctgaagcgtcgaattcgacgagctccagaagctgtggagaagagcgcgggtgaacgcgcggtacagccaagcctcctgctggcgttctaaccgagaggtatcttcgcgagagtcaccgtggagacggacactaggagcgaagctgctggaagcggctgtgtgcgatgccatgatcactttagaattttctcttcatggcaaagtgcaggtaggaagcagaggacacgggtaacgtattgttctggcgggtgaacgccctccccctccgtcattcactaacactgcagacagccgaggcaataaaagacaggtggcaaactggtcgaggaaacactgtcacccctgtaaa

SEQ ID NO: 3843 - DNA, 2148 bp, Toxoplasma gondii
tcgtttccatgattcgtctctccgtgaggctcgacggtctggccaagcgagcgctcacctcgctctcacctcttgcccataaaaagcagctcgcgtcaacaggagggagaagtcctgtgggctgaagagggcagcgaaacgttagattgtaccccctggtagcttttttccgatgacgcaatgctctctcgagtgcatctgtcttcgcgtctgccttgcatgcgcggcgttgccccccctgaggcaactggctcgttcgctcggctgtatgtacaccccagtagaatggggtgtcgtttttgcgttttcgaccttcgtataggcagataaatgcagcgaagggcgtcgccgcctcagggaaaggagagagaggacagttgcggtttcgcaataagaccccgagagcttcttctgtcgcagcacagataaactcgcgttagctctttcacactcgccgctgcggctctcgctatcgggaagcacaaaagacacgcgacatgtcccttttggtggaatactcacagactaccatcagagtcaaacaggggtcctagctatgaacatctggacatcttgattatttcagcctgatttctaataccttctttcgtctgttcctctcgcctgcttccttttctctcttccagtctacactctacgctctctggctcttccgcttccttacctacagcgagcagacacaatctccctccattcgtatctcttcacgaatgtaccaggctcgcctcctttctccacgtcctcctttcggcctctctgtctctctccaactcagtaccgctctcttcctctctcgctttccctgcggctatctcttcttctctctctgcttgtctgcctacattttcctgtttctcggcctcgctgcctaactttccttttcttctctttttgcctctgtcgctgcctctgatctcgtttttcgtctcgcttcatattttttttagtctcggcttcatctcttagagcgcatctgaagagatgaatctggcagagccctgtttctttctctctactcggccggactttcctgcgacgcccaaaatgcgggactttacgcggttctctggattttgacttccacacgtggtttagagactcacacggcgcgcctcaaggcatttcgcgtcaagtcggagacctgactaggcaggtgtcttcgtcttgagaaaaagtcgcgtgagtttcgtggagacagaaaaaacattaagaagagagcttcgctgcgagctccgttcgaacgctgaccctcccccccccccctccccaaggcaaatatccggtgtccgtagcagcagagcgggtgagtatgcgaaccgcagcgtttcagagaacgaagaaggaaactgagggacgagacgacttggagaactaggagaagcgagagaaaaccacaatatccgcaagagctgttctgcttcttttctctttatcgagctcgctctcctgtctccctacacaggctgcttgtcaagtgtcttcgccgtcgctgtctccgcacccagcgaaggaacagccttcacccttgaagcctttcaccctcctgagcgaagtatgcggtttgtaacggacagagactctgaaattttacgttgcttctctggagaaggaaacgcttcttgctaccgaccctgaagtcggcaggacgacgacggtcttcgcacatcggtgtgagagcgcatgcgaatcggacaagacatgcgcgggacagacggcgatctgttttttcaagcgaggacacagaaagtgactgcacatctacagagattcctttttgtctctgccttgcgaaaaggaaggtgtctctgtgcttctgtgtggagcagctgcttccctctttcgcaccgatcgaacagaaaacagccacgaggaagccgaccggccgccgaaagtcttgcgtcattttctacttcgcttcgtctctcctttctctcctccgacgtgcggtctctcctgtctctcctgtctctcctgtctctgtcggcgtcctctctgctgcgagtcgtcctcgtgacctccgaggcgcgaggcgagagaaccgaagaggattcctgcacacagagacaaacactgtgaagcgagggcagcgacggccctctcgaggcgcgtctcgcggggaaacgaaaa

SEQ ID NO: 3844 - DNA, 1881 bp, Toxoplasma gondii
gacggcactcttcactctaggccctgtactactgtactgatcactttaaaagccgaaatattctcttcgtacaagtgatcggcgatccagaactgccgtagaaaaacgagcacatgcaccaagagagagcctcttccgcgatatacagatatgcacacatatgcagtggacatgcgaacgcagacgtgcgaagatacagataaatgcagatataaatgcgatataaatacaacatatatagagaaagatgtatatgcaaagagagatacagatgtgccttcggttcgacggttgggcgtagtcaaggagctcagatcaggaaagacttcttggacttgctctgaattgtaaacaacaaaaaagaattttcgtgaacgcagttccacgcttgcgagttcctgatatgtgagtcaagaagaaatcaggcgcaccgactgataaacagaaggaacgacctggaggggtgctggcggtttggaaaaaacggattttctgtgagagagaatcgtcggaaagacgaaaggagaggccgggagcaaaaggaggctctgtggtcactttggaacggcgaagaaacataccgggaagggctggcctcagtccgacaagtacgtttcctaaaggacgcagaaacagaagcagactctccgagtcaggccggagaggaagtgtttacgggagaaaaatgtggacttgttcggtcaaaaacggaaggaaacgcgtggcagatgctgcttttttcggtggctgctgtccagctatttttccagaggcgatgggccgcgaaattccaagattcatctggtcacactgcgcgttggcaaaagtccattccggtcacatccgcgaagaatttcgggtgtatgtacaaaggagttctcggactttggcgggcgtcttctcggtggaaaaccggcatggcagccgtcggaacggtcacaaaaaggtcgccggcggttttttttgagcaagaagagacacccagtgtcgtttcagtcggtcggcatcttcggcaaaaaaagaaaagtcaagatgaaaaagcgtttttacgaaaaggagggtccgcgagactgggcttggcaaaaagcgcgattttcgccgccatgcatgtgtgtgtgtcgaactctgaccgggacacggggaagaacgccgacgtgttcgcttttgcgaatgcacgtcctttccctcttggtttgcctttccctctgaatctttcaggagtttttcccagaaaagtcagtctttccctgtcgctcgccgcgggccgagcagcaggcttctcagcgaccgcaagtcttcctcgctgcaccgatgcttctgttgatttgcatgtgtctcggatcatctctcttcgtcgtcatagctgtcggtcattcataaaataggcatgcgtcgcttttttgcaactgcatgcgtcaacaggtgtataggtgtaggcgggatgaagcacgcaagacaacttcacagatatctaggaagagtgtgtaaatttatctacgacaggtagaggtgtacgtaaatagagaggcagaaagtgtgtagacgcagatttgttgatgtgactctcttgtttttccaagctggctagacaccttctccgtctcccagtggcctgtgtagagattttccggtctagtctccaagctgctgtctggcaggtgccgaagaagctggtcttctctgcatgtcttcgttttcttacacgcgaacttctctcgcgcctcgacgttcctgctgggtgttcgtgctcctctctcctctgtctcctggcccttcctctcggtcttttactcctatctctttctgctcgccttcttttctgttttctcttattttcctttcgtctgttgttccctttctttcctctcgcttcctcgaaaa

SEQ ID NO: 3845 - DNA, 2134 bp, Toxoplasma gondii
ttacagctgttacgctattatgtactctacctatcttaacaggtggattagttatgattctattagatttacaagtgaataaaggaatctctgattctacgttgaacatacgttcagaagacaaatccacatattgttgctaaggttgctccaggagactgtgtctgttaagataggtaaatgctagcatatgagctgtaaagataatggatcagatgtataaaatagaagtttttgctcctttctacagctactctaacgttgatcaaccaggattcaactttgaacggaagatgcagccggaagacctgaggcagtactcttctcaagcacagcgtggtgctgtctgaatgagcctctttcagccgaggcataggggcaagaagggaaacatctaatgtcccaatgctcctatgcaatgtgaacatctacaaaggcgcccgttttttcttcgtggagctccctgcatctgtggtttttacagggatgttcggaagcggtttagagtggggccaacaagcgtaatcaccgtaccgcgcgaacagcaagctcctgttctcggcagtgatggaacgacgtaagacgaagccgcgtttgtgtgtgcaaagctgggtagatcgcatttcagtagtagcattaccaaaacggcgttaagtgaaaacacgcaccgtttcgttgcagctttcgagtgtgcatgcacgcgacgaagcacgagatccgaaatcgatgagctacttctgagaacgccacatcatactacgtagagggcggtaatggaaccgagtcacacacgacggccggacacgtcgtgtgaccgacttacaagggcacgatgacgagcggttacaattaaacgcctctcccactcttgagactggctaacccactctgtaatgacaggatacgcgctcgcgttgcgggcttggctgaacgcagtaactggaccttgacagagaagaaaatgaaagaaccttcccttggcgccactactcaggaaggtcagactctgtttcgcagtcgtgtttttagatgtgctttgacaagggccatgctacacgggttcaagaagaacctgtatatcagttgtgatgcgaagatggagtagagagaaaacaaactgaagatgatcactcaacacccagcagtgtggcaaagcaaatagcagcgtgacagcagaccgacacaagggtccttctgaatgtgccagcggaccggcaagcccgcatgctagactgtttccaacgcccactaacagtgtgccgtctaaaatagtggacacatgctgcgaagatacaaaattaatacagctggtggtcccaagcgcctcaaaggcaccctaagaagaaacgataccaatcttcgtgcgccacaatcccaacatacgctgcgacatcacttgcaagacgggcaaagcggcttgtgcgttttcccctctgatgacgatcttcctgaattttccttttctgttaacaaagtccgtctgaaaaccatgggggaactctactgtctaggccatgcgcaagctcccattccttcgctgacactgatataaaaaagtcagctgtgatccgtccgctcgagccggtgctgtcagcttggcgcgggttcgacgcacgtctctttctttccccgcggctccatcgagtgaatcctgtaccctgtctcgacagggcattgatgttgtgtttttcacggcctttctctggctctgcgttgccttttccagcggctatatcgcggattttctcatgtacgctgcgacagctgacggtgttcgcacgtctcctgcactgtctctacactctccgtcctcctgttgcacaggcctgtcagcctttcgtttcgattgctgcttgcagggtccactcttttgacggatttccagtttcaaagtgttgatgtatattcgatgtgctctgacacgttctgactcgtggtcgtgtgcgggaatttcgctgccggtgtcgtctgtccgttttgaccggtccagacgttgtgagttcttgctttgtcaccgagagaattccaggcaagccgcggaccttttccgtactgggcgctcgtgcccgtcaggccgtatggctccttgtgcctctgtgacagaaggcctgagaggtgagtgaactcgcagaaa

SEQ ID NO: 3846 - DNA, 1855 bp, Toxoplasma gondii
ttgagcagacgagcattcgctttcaacaaggcttcagagaagacgcgtcctcagagatccgcatttctcgagtacagcgtctccctctgaaggcgaggggagataatccggaagtctcagaggacccgcatgtagctcctgacgattccctcgaagaaaatagaagcaaccttcgttccattggtttgtgcatccccgtgtgacgtatttccttccagactcgcaccgctttcaggcaattcttttctccctgctgacctctgtaaagaatcacaatgattgctttaccgtgaacgagacgaaaaagttacacttgctctctaacgcccacttcaagcttccagagaaaaccactggcgcaaacagacatacagttgcagtttctatacatacagagagaaacatatgcgtactacatattcacataaacactggcagatcaattggtatacatctctccttttatgtcacatacatttacgcccatagtcgaatatatatatatatatatatatctgtatatgcacatgcatcactatttatacatatgtataatccggggtgactgtatttatacatttgcatttccctcttatatcaaatgtgtacacatgcttaggatattaacagtgtagatgcatgcatccatctagatgaatttgtatctacatatatatatataatataagattgagtgcgttttgaaatgtgtgagtgtgtacgggatgccctttattcgctgaagtctagattttggtgtattttgaatttttgtttggagcttcaatcacgcttttcgtaggtatgcagcatgttctcaagactggacacagctggcatttctcttgtgttgttctacgcgcattctttgggtcgcgaagtcgcggtaaccactgtgcttttgtcttcttgaagacggattcttgcaggggaaatctcttccttctgttttcttcagcgttgtctctccgcttctcagtttttcttgcgactcgccccaactcgcagggcaagtcctgcagtcactcccggaatgaagacggaggaaagttgtcacttccgtcgacaactcgaaaacaatcaacatcgcctttcaacgctcgagtgagagagcgagaggcggcagggaggtcaaagggaaaagctccagcggtgctttctagagaagcgttcaaagtgaagaaagagtgaggctccccaaagtgaaaaatgcgaaaggaaacgcacacaagactcgaaagaaggctacaagaggaaagagagagttcaaatctctggacaaccaagggtgtgcgccgcattagagaagactccgcaggtttcttccgcatgcagtggatatatagcggcgcaaaatcgaagactctgccgcagcaccaccggggaatttcgggtgtctagacagttgaacaaagaaagcgagaagaaaacaggagttgcgcgaacgatcttttcccctcgatagaaagtggacattcgttgcgagacaactcggaaaaacgcacaccgctcaccagcgagacagcgaatggtcgcgagccaagacacactgggggaaagcgttcaacggaccttctgtaaaaagttctttctcaaatgcagttttcctttcgcgctgctttccattgcttcaccaacctcctctccgctattgttccgcttctcctgtgcgaacgcaagtttctctctggcgccagattgccgcaagcgatgtcggcgcattttggattatgtaggcaggcctctgtaggattgcagagcgacgaaatacagatacatgaacaggcagacatgtggatgctgaagaagagacgtttgtgcgcactggaaagctgatgtaggacaacaactgtta

SEQ ID NO: 3847 - DNA, 4278 bp, Toxoplasma gondii
cgtcatgccaagtaaccggtacgcaagtgcgttttaaactgcacagcctggacctccttcttctgtccgttcttcctttacaccaacaggaaagacgatccgttgggagagcggcgggacgagcactgacacgcttctcagttttgaaggtgatcagctatcgagatggtcctcctctacaactgcgttacgaactgttgtttcgttggaatagcagttaaccgttcccgctaactgaagtgtctctctggatggctgcggtcacacaggcctccattctccaaagctgctcacccatttcgtcggcgacaattgcgccgacaccattgaggtaatggtcaatgagccagagaaccccatcttcctggtatgagtggagcacattcccagcagagttttggacgccctgaagtccccgaatctcctttcgcctcctttctgcgagtccactttcaacttgctgtctccgttcgacggaggagagaaacgaggacagctttgacaccagctggttcacagcgagttcatcgtccacctctccagtctcctcttccgtgtcaaagtcttcagttgtgtcccacatgttcaccccggcaaagaatctgaggcaacgctgagttctaaaccagatcggtaattctttctgttggttcaggaagcgagagcaagagccttgcaaggcgcactccggttggaactgcgcgttttgtggtacagaccaccaggaggggaaaagcaacaagttcttagaggtcgcgagacccaactgataagagcatttcacatcgaagaacggggttgtcaaacagtggagggaaatgagtaaacatcagaagcgttaagcagaaacgatttagatagtcggttcacaacgagcgaaagatcccagcttctcgtcgccctctttgccagggtaacatcggacctgccttggcaaagcttctgcagaaacgttcacgcgacatttttgaaaaggagactgccggatttattaattgaaaatcaacgtggctttagcagtgcatacaccgggagcttttcctcgacgaaatatcacagctggcggggaggttggccggctctggcgccacaagaccaacaccaaagatacaagcgcaccagtacggaacatgtggaagatggaactttttcaagacgtcggttaagtcaaatacgaaagagaaaggagattcctcgagtaaggagacaaaaccagctgaattgtcttggtatcgactcgcctacgtgttctattaacgcgtgcatgcactgaaacgcttgtgtcatcttgtgagagtcaggcaacatcgatagcaacgtctggggaagagtgcgtgtatgttaagaaaattggtaaattcatcggtgacgatgcagtcttagtgaaaaataaatgggggtgtctccgttttttactgcacacgtggttcatcagttccttcgactaccgagccagttctttgccttgtaccctcctttgtgcactgaatgagtccctgcacgaaaaagccgttaagggtgtttttgcgtttaaatgatcgacgatccccgatatatcgctttgtgcaaaagaagaaacaggtatgtacggggtgaaagaacgggcttagttctccaattatttcctgtttctcaagagaagcatcatttggactgttacagggttccgagatcctcgcccagtaagggcaaagcctcacacattgcctagctagaagcgccttcagctcacaaaggaatcataccgatttcgaaaggaatgtgtaactgcatcgtgtccgagaatcgtcgaaggcggagaaacagcaagtcgcggttgtgttccacaggctcacagccaattcagtcggaagtgactgcgggaagcacttctcaggttccgagtttgtgtccacaaattattccccagtttcctgcaagatctcagagtttccttagcaggggaaacaaacttcatgtataaatactttcagggttgattttgaatctaaacgcatggtaccgctcgtgttcagtttaggcaatggtaatcgataaacttcatacgaagtgatttctttgctagcgtggggatcgcatgcttccgcggcaccctgatttggaaaaactcggaagcaggtgcatctctgcacaagttcttagatgcagatgcgtgcaagaacccttccgcatgcctaagattgcaaaagtgtcccagccatgttgttcatagagaaggcttatgggaaacgcggcaaaaatccgctccactctactcatcagcaaatgtcctgctatgcggagattttggtggcaacacaaggagtcctttctttattctggaacgacggaaagagacgatttactagctgctctttttcgcaacgccggatggtaaacggggattttacctatttattgtatagatggatactgtttacagattcagagggaacgggtttacgacgaataaaggaggcatgacattgctgttaactgtcctgcgaattagctctctgcgaccttttgcagaactattcaagaacacaagcagcagccctgacaacctgtggcagacgtggactttatataacaaaagttacagctctgcaaagcgatgcattcaacttccgtccgctccgatgtttagatgcctttgtatccggcctcaaagtctctagacaaccccgagtcgtggttctagggtgaaaattttccaactctccgagtgagcgaaggcaacgaaagggcaaaagatgcacaaacaaaagccttcagcttttctagatctgttgccgaataaccacccctgccacactcttcgaccctgtagaagccagcacctcttcggccatcgaacctgtgtcacttcctgtggcaggcatgtttatggcaagcgtagtcgcaaaggccgccaaagtccacacggcgcttactccaagtggtgtcacaacggggttcgatagtgaaatctctgccactagcacctacgcttttcggtaaatgaatgctgcactggcatttcaaccagtgccacggagttacgcgcagcagcttctcgtggaggatccccatcaaaccgtgagataacaacccccgtttcgaagttttgactttgagcctcgccgagcagtgtgtcaagcggaacggtagtgacggactgataaggtcgtggaagcagccgcagctcaaaagcccgccatttgaagaagaacgagtgcgtcgggattcgaaccccctttgctgcagacagtctctaaaagacgaaacatggaggtctgtgaagacttttacgagaaaaaatgcaaaggtgatgaggaggaaggagagaagagaagcatgatgttttcttgtctgtttgtcagcccttactctccgcgtattgttgcgtgtttcagcgaacagtaatcatgagacgtgtggctgtccggtgaggcagtagcacacgacgctaacacgtgcagtgtgacgttgcatttccttggttagccaccccctgaaatgaaagaaacacacgtttgaactgaaagcggtgtcatattaaaaaacacatgacgaaaaagcttccgcgtcatcaccgcttcgaactgttacctgcatgcgcttgtgttcaagaagctgaaccctaccagggggtccgagaaagagcgggcgtgtgaggaccaagttgcatggcggaatttgaagtgccacataattccttttcatatgctgcaaatggttacaacgcaaaagcagatctgttgtgaggggggaccgtggttgcgtcgggaacgtgtgcaaccgggcgggtcgccacgtgcagctacatcgtcttaatcgagtgtagatatttcgccttcgttgcccgcttcaagatgtgccgtaattggactcacgaatgtcgcgtttcagctgtgttttgtctggcgcgtgtttgtcgccacaagacgcctagttggaggccggttctagcggtctagtcagagcgtatgtgcaccgaatcccgccttgtggctcatcagatgccgcttcttcgtttcggctgctgctcctatgcatgcggccgttttttttagctttccatctattcgtcgtcgttttgtcggttcatgatcgcaaaacataggttctcattttggctctggatacgagacaccgcgcgacgtgctgattcgtgaatcccttgtcgcctgaggagtgaccatgccattccatccttccgacggtttgtgcaaggcacctcacacttcactcgctcctcaggacttcctcccggaggcgcatctctgcgtcgtcccttcatagaattactattca

SEQ ID NO: 3848 - DNA, 1688 bp, Toxoplasma gondii
cagacagctcatctgccttccatatgtaaaggcagtcaccagtggatttctctttccctgtaacagcacttagcattgggcctgctgacacagatgtaatcattgtgggcagccctttcaccttgcacagtcctggagcttccaagaagggacactggactggcaccgtattttgtggcgttccgtccatggtgtcctctctgggcttgtaaaacaccttctctgagtgaatagttatttgggaaggcgatcgcctggtgactgtcgatacgttcgaagaccactgcatcaacgaaggaggcggactgaacttcggtgcacatccagcggtgagaacctcacctcgtttagttaaaaagatggtgtgccacattccgcacgaaacttgctttactggatccggtatcggtacaagctgggggacggacatactttcggtggatgaaaggcccagctgtccatgcaagtttaagccgaagcagtaaacgcggccgtctgaagaaactgccgcggcatgagcgaagccacctgccacgctaacccacgaagaaatattccctggtgtgcataccctggtggggactagtgcgtcttcttttgagttaatgccaagctgcccatatttatttgatccccaagcaagtagaatagaaccactttcatttttttggtcggtccctcctgaatcttcttggtcattgtcttctagggcgaaagagaagtcatagccagcgaaaacgcggatacgctttgaagtacagtcttggacaggcacaataactggtgtcacttcatctgttaagcgcccagttcctagctgaccgtgatggtttttgccatatgagaagatcttgcccgtgtcggtacttaacagaacgtggctgagaccgcatgcaacacacacgactcgcccgtaacatgatagaatggtgtgggtcagagggttggtcacgcgatgacgaacgactgatgccgtgttgttgtgcgcggtatcgtcagaaaacgttgttgagcaggtttgccttccaaagaaggaagagaaaacttggctgttgagcgaggaatccaccgagacaatggtaaagaagtcctcgcacgctgagacggtaccaagaattgcgagctcgcctgacaaagtaggatgttgaggtaacgacagcgagtttccatctgcagccctcacaaaatacgaaagtggtttgctaaaatagcatgggacgtcgctgtcaagattgtcatctctattgaatgaccgcggcgagggctccgactcaggacactctttctgtagaggaatgcacctgcgggagcacgtttttttgtgctccacgcttctcatcacaaacatcggttctccagaaattcccatcatcctatccagatacagaaaagtactcttctgtggcgtccaaacttgtgcttccatattccttgcgaaagtttggtgtttcaagacactgcatgcggggatttgtaaacgggtagcgtgcggtactgtggcggtggtagtgtaactgttcatacaccggaagctagagcggcatacgtgaattatccgctgcgttgtgtggccgctatgcagcgcccaagttgtacaacttatatcctcgtcccctgtgtcgctgaataagcatttatcacagctcttaaaagtcgatataacgagctgtgaggtacccttttcacaa

SEQ ID NO: 3849 - DNA, 2055 bp, Toxoplasma gondii
atgtcctatattcttgctggttgcgtaaagagggtctctcgcggcgaaccaggaaagtgtcattgcggcaacagggggtgtggccgttgggttcatgccgtatttcgtcgaatggcagcttccgtcgcgacatacgcatgtgtcttgttcccgaggtcaaaaagatgcgctcgatcaggtggcacgtgctcgtggtctagaggtctgggtggtgagtccctggttatgctgtgtttctccaccgctgtgccttgtcgtcttttaggcctgtttaaggcggtgtctaacatacatatggagaaagcgtccacaccctttggcttttgaggaaacaccctttcctccatggtgactggagcacaactgcgttgtttgttgttgttttgctagtggtctagcgactgttctatacccattccacaaaaggttaaacactgcaaccatctctaataaggccgttgtcctttgcagaaattccggaacagacattcatatcgcaaaacgcatcacgttaggcgcccaagcaccatcgttataacataccactgtattctcacttctgtcgctgcacgagctgcttgtttctccaacgatatttcgtatcgtcgttgtgtgcccagtggagccgctgaagagcgagttgtgctccgtgcctagttgttatctcaattcatgcagctgcaggggttcattccgaaggtgttagtcggcgaaaagagacaattacgttagacatggcgaaaccagggcaagcacgcctcaatcccagaattccagaaaggtggtttagggtctatggctctacttgaatagccgtaaggctgcgctgtgagttcggtattctggggggccttgcccctgaccgcaagccgatttcaagccccaagcttgcctgaagaagaaagaatattcacttgtttggtgtgctttgaagccatacggatagaatccggtagtctaagcaaagcagtagagtgaggttcactgacctgcccatccacgtggagtatcgccgagactaagctcagaaaactggtgcaagtagacagaacccctgcagccagtcctagcacgccgcagtatccatagtttgcgtatagagcttgagccaagttccaagaagagtaatggctgaaattacatgttattgccttcatatcaaataggcgaaaatgtgtgaggaaagatacagtgccaaaaatgataggtgcccacaaatcacaaatgtctcccggattaagaagaaacagctttcgacgccataactcgtcgttcaggtcgtcgagcaagttctccgttggccactgcagcgatggtgaggctttgagaattcggacaactccggtggcaatcgttagtgaacccgcagcgagtccacagatgcacacaaggtgagagagacgctggacgcggggctcagctgcacttttcggcggcggcgttttcgggtcagtcgacagtggcaagaaggcctgtggagatggcttctcaatggtcgcgtcgcgggactctgggagagacctcggaggcaacacgtttcctgatatcggcgacggcatgtaaaccgttggcgcaccaggggactccgtcggaaggcactcttcatggtcgtacgggaaaaatgaagcgagaccgtacggctgtcgtggagtagagctacacatcatgcccgcttctgtcccgtggaacaaggaagagaacacagatgtcaaaacgagaccaggtcaccgaccgttacgtttaacgtgctgggctacgggccccagggccggccgtctgctgcagtgtgtttccacgcgtctttgctcgagatgaacaaatacactagctgaatactgagaacgcaagctgttcagtgaaacacgtttttttagtgatgctcatcggtacagtacaacagtcaggagcttccaggtgtctaacagggatgggcagcgcatacacccgaggtgcagtggcaaatgcgtgtgaactttcaaagcgaacctgatttctttcacagaatcccacagtgacaattgccagtctaaacgctgaaccagcaggaggcagaaa

SEQ ID NO: 3850 - DNA, 2203 bp, Toxoplasma gondii
gaaggtgacagaagaatacgggagccacagtacgtctgagaccttggcgctggtaactcgccaggcgcttccgcagcagcgcagccgctcggcctccttgttgctctccgcctcccggagacagaaactcccatttcccctccagggcagggtcgacctgcgactcgtacgaggccgcagagtagacagcccagtctgcgtcgcgcatctcccgccgcaaactcgtctgcgcatgcgacgggtgactgccgtctgtcccggaaccgagccgcgccggatctccaacctctggggtctctccctgggcggcagagacgcccgcggctgcgtcggaggcttgcgcgtgcacctcggggagacgtttcgagcgcagagaaggttcgtcgaagttttcgaggtctgcgaggacgtcagaatcttcgtcggggaattcgggaggcccaggagaaggaaaggggacggcagagacgctgagagaaggcgcgcttccccccgacggcgccggcgacgctggcgaggggagcgcctcctcgagggcagaagcctccggatctgtttccaagacttccatctggacagtcaagaaagagaagcgcttcgctggaaacaaggaaaagccagatgcgaagtcgtcgtctttgggccgccgcactttgtagaggggaacggagaaaagggaggacaggacgggggggaaacgacgagagaacggagagatttgccagtggaaaacggagggcgagacctcaggggaggggggagaaaaaacggacaagggaagtcaagaaaacagaaagctagtcgcgaatagaaacggctacaggtgaggagacagtgcgtggaggaggaccagacgagccccgattatggagggtgaaaggaagggagataatcctggagagaaacgagggaaaaagacgaaaacaggctagaggcttgttcaaaattgccgctttcaaatggttgcattacaccctgggacaagaagaaacagccgagaaaagaacgcgagcaaaggtcaactccagcgtagatcaccccaagtcgacagtcccccaagtgaagcgtctatcgatcaggtgcctataaaagcgaggaaatctcgagaaaaactttcttcctccgtggatgcgtaggcagatcctcctgcttttcgctttgcttgctgcttctgtgcatgtcgattgccagcgcgcgctttcatctcttctgtgcatgcgcagatcggtctctggcgggtgtagtgtacagtgccgtcggcaaaaaagcaaaagacaaggagcggtggtgcgtcgcttttgcagactgcgcgaatttcctgaaggaagacaagtctttccattttttccctgtccatacaactctagggacagcacacttctctgggaaaatccagtgaaatgcacgtctcttttgcgcaggaactcgttccggccgatcgtctcgattcccgacagcgcgtgctggatcctctcgggtgtacgtacgtacacccgaggttgggggctagctgtctttcgctgccgtttctcgatttagggggatgcatagatgcttttttgtggcggactttaattacacattgtttccacgctttccacttttgtgtcctcatctgatgaacggcagtcggcggcaaacatcggggtttcgagcgcgagtccacgtcgtatcgattctacccaccgccgggcaaagcgacgctgcgccgtctctgccgtcggtttctccatcgttctggcgtgcactcggcagttttcatttccagtttcccccgcgtttcctccctctttccacgcgcgtcgcttcccaattcgattttcacccgtaaattcccctccagagcttttaactggcgcgtcgcgtacagagccgagaggcgcactgtatccagctggacgggtgtggtgtcgctgcggcgtcgctgggcaagctgtccgatcgcagcttttcgagtttttgaggcattccccgtttcgtctgtttgtgtgtgtattctggttcggatttcacactttggaacaccacgccgagtctgggagtccccgcttcgacggtggtaaaacccccgtgtgacgacgttttgagaccggtagagcgtagaacccgctgcacggaagacgctctgcagacgttttctgcgtctgcagttcgcccaagtctcgactgcttttcttcaaatcttcccagaggttgtgcaaga

SEQ ID NO: 3851 - DNA, 2629 bp, Toxoplasma gondii
gtgtgttcagggacgcgagtgtgcactcatttgatccattgacaaaggccgtcctatgcgatagtacagcgaagtcatgcctaggaaaaggataaactggcggctcttggtttgccagctctccttcctgtttttttccatccctgcatgcacgtcgccacttcaggcgacagcacgactttgcgttcagcacattagtctctgtcccctcaaccgactctggcagacgactgtcacacttgcgaccccgtctctcagttgcatactcggtgggggcataccaatcgtctccgcattcacggaggttttggcactgggtactgcaggcggtttccacttgccgcgtcctccgcttgcttctctgtaggcactcagcaacgtttcctttctttctatacgtcatttgtgagagggacagggaagtcgcctcggtgctaaggtgcccgttcctcaggctgtcgaaaaaaagtgccgtctctgaggctgtctccccagcgtcagctgaaccagcagcatggagacgatgaggcattctttcccgcacacttcgcctggatacacttgcttcgtcaccagttctcgacattgtgcgaggctacagtttcgacgactgtttacgggggcgctactcggccgcgaacaaatgggcatcgtcgacaccaatcctatgtgacctgtggcgaacacgcgaccacctccccagtgctggcggagagaggcgaagaaagtgtgaggaagaaaatgcttacagtcgtcgacttcgcgggggcaacctgccttgccacgagattgtcagtggcccaccacctggactagggaaaccacggcagtcgtggtacaaaccaacgcgtgctaaaaaccggaccaccgcttggagggttcttatcacagacaattcaaccagaaggaaaaacacatccgctgcttcattcttcgataaaagtaaaccacaggtcaatgagcacaagagttggcatgccggtgtatgcttcagttacgttgccgatgtttccaccacatgtcgcgtggccggagacaacgaagacatccagcttctaacagagtgacacctactgtctgcaccgtagttactaagagataatcgtataccctgaaaaaataaaccacatcggaaggtgattctacggaaacaagttcgatacgaaaacgagtgagattcttgagagctcccccttcgtggacggcgcatgcaacaggatggccggcaccacgccgtcgcccggtgtcctcgcgtggccagtgggagcaggtcactcctcctgacgacctagcatctccgttgaacttgtacaagcatgctgcccgagaggaaaaaaacaatgcaacacagcagcttgtcaagacaatctgactcgcttcatcgtttctttgcagtatcaccaaccatcaccccagtcttcaacctgatttctgcaagcaagcctactacatttcctttgtcacgagcgcttttctacctcagatagtcaatctagccgcacaccacgtcgagatgtggcagtatgcgtggtatcaggccgtacagcgtgagcgcagagaaatgagccacaaacccacacacactttcaatccggtgacaacataatctttcataatcgatagtaggcttctttatgctttcaaacacattaaagaacgagccgacgtctcagttggagccttccgtgtcctgaaccgtgggtgcctttctttttcacactacggcactcctgtgattacccgctgcctgcgccgacggggcagcggcgagttccgtgtccacagttccagagggtctgcgtacggtcgtcgcggaggtgagattaaaaacctgggatcatccgtggttcctcttcgcaccgctccaggaccaagtcttttactgatgtgtttctgtcgaaatcgaggtccaatttcctcttgaaaattcggtccggggacctccgggacggcttattccgtttcgcagacgctgccgcgaagaaagtgcatgagattcagggaaccacagtatccccttcgttttgaaatgctcaaaagacgagttaaaattcctagaatttgccgttggaaaaggatcgaaacatgtacctggatgtgaaattgtggtttactgaagtttaggaacaattcctaatttagccttccgccacgcttgtgtcgtgttgctgacacagttgggggtttggtctctccctcgcaacgaaatcctgtcttgcctttttttcttgcgatttctcgtgtcagttgctggttatcttccgagaaactacctcactcgtgtcttggacagtggagttctcgaacctacctcgcaaggaggttttctttttcaaaaatctcagcttcggccccggtgacggggaagtgttttggacgtattcccggtttattctgctgaagaggatctcacaccagatttcatatgagcgccctgtgccaagatttctagtgtcacacgtagtcacaccagggccttacagcggacgctttttttgtccctaagcgtcggtgaggtacgggtaacaccactgcggtgcggctggataacttgcttcattgtagacgatctgtccattcttgtgaccgtacggcaattttcgtatcagtaaacataaagagtttacaa

SEQ ID NO: 3852 - DNA, 1964 bp, Toxoplasma gondii
aacatctccaggcttgttctctttgtgattgtgtctcacggtgtcgtcgccgcctgttagactccttcttctttctcctggctgtctctcgtgctatgcttcaagcaaaatacatcttttttgcagtaaattggcggcgacatcacactttgctacgtaacgaaatctaggcgtatatacggaggcaatcctgctgatgactacagtgccaagcacaaacgtgaacgccgggtcgcgtcttcattttcctctccttcattatttctgtgccttcgtctcctgcttccttctcgtttctcttctccgtccttcttgggtcagaggctctgagtttttcttaggaaagtaaaaaaacagttcatcgaacaaaggcaactctgccttgaaaagcctggaggttcagacacatcactgataaaagcaaatgcacgttcctttcgcaccttcttgcggcgagaatcgtcccgcatcttctcggggtcggtcttctcgcggcttctcgctttctctgcgccttaaagcctctcccggcttcgacggggagagaagcagaaggagacagagagacacagccgcgaagattctccaagaatatctctccttcattctcctctgcgtccctgaggagcctcaggaaagagaagaggcaaccgacccagcggagatcaaaacagagaagagacagcagaacagagcgcaagggagacaggagggagagaaagggagacggatggggcaggagacgcagagacaggacgaaacgaaggaagaatggcgaaagggcaagcgaacaaagaagacagaaggaaaagaagacagaggagggacagccgcgaagagctgaagctagaaaagagacactgagagaggcagcgtccaagagaagtccacagggacagcagagaagggagatggaagacagaaaacaagacgacagaggaggacaccaaacgccgaaagaggcgaggagcgaaaaaatctaaggagacacagcgaatgggagacggcgagagacagcgacagagccagcgacagggccccggagacacggggctggggattgacgagacagcgaacagagggaaggagaagccagaaaggggaaaggaagcaacacaggccgagaatgcggaaacacagggagacgaagcacgctaaaaaagacaacgaagacagagtgagacgaggaaagggcctcaaggtgaaaccggactttacagcctcgcacaagcactgggcgtggaagagaggagaaaccgagtcagcacagggttcctccgttccctcttctgctcataaccttcacgtctcggaacggcacctttgtactgctgttcgtgcctcttttttctgccagaaaaaacgagagaaacccgcaaaaacgttctgtctcattggcgaagccctcgcgcatgcacacacagaaagtcgtcgagatgcgcaaagcagcagcgggagtgtcgaactgcatctgcaaaggcgggagcggagagactctccacttgtcgatatctctcagaaactttctttgctcgcgacagaggcttcagagaaagttccctcttctcacccccatcgtacaagcgcgcgagctgcccgtctcgcctccagcgaacgagacggcgcggaaacgcaggcttcgtccgtttcagtcgagtccaccacgcagaaacgagaacaagaaagcttctcaaagcacctgcagactctgtgttgaaaggagagatacttccttcctcttgtcaaggggagggagagtgcaggggaggcaacgccttctttccaggtgtggtatcttgtagacaggtagagttttttatccgagagctaatcgccgacttccctcggtcggagccagctgcttgtgttcgaatcctttcggagtcttctcttgtctctgcaagtagccgcttcgcgcgtctgtccagaaccgtctcgccgagaaaaggcctctttccccagaa

SEQ ID NO: 3853 - DNA, 1584 bp, Toxoplasma gondii
gtctttcggacttccgacatcgaaagacccacttgagaacgttccagcccgcctgcacgtgctccctcttctttggaagccctcggtatgcctggctcgcccccttttggtttatgtcaaggaaagggaagccgtcagtggtggcggtgcatgatgcacatcatcgtgatggaatattcgttttgtccgcactcaggtctgttgtgtcactttttagctgtctactatcaaaactgatcctccgctacaaatctaattagggtccgtcgggtccctatgactggatatctcgttttccttgcatatgcgaatgtgaagatggagcaagaaataaggacaacggacccccgataaacgcgtcacataccatggcagctattggaaggatgatcgtatcgcatactagcgaaccgcccgtctgattatctagagtcgcaagagtctccgctgcgcctttctggatacatccagcgattcagtcgccgctgaggcgcaggttgttcgtgtccgtcaggagatgtcggcttgcctagaacccaagaaactccccaattctagaactaataaatcatgggcaacggtggaagattgtagagttacagaattccagaatcgagagccgcttctctcaactgaggcaaccatagaaccaattgagaacactcacacagcaaactgacaaaggtgggacgtaacaaaagcacacgtaagcacttttttgtattaacttccgacaacattcatgaaaaacggaggatccagcggtcgtcgacggcgctgtaagatctgccaagagaatgtttgatggtttctacaggagaaatgtctacctgtagcaccccatctacaagattcgacatgctatggtcttaatccagagaggattctcaggtctaaaggaacagaagagaagatgacatgtagaacagctgtgtgcagtctaacatccttcgttgcggcttcatcctgagcaataactcgcaagccgaactccatttcctgaatagatgcgtcgctgcttgaaatcaatactctttttgccatctatttggaggcggtcagcagacggtgagcatggttccaaattctcttgcatggttatggtttaaggtgaagtgtttttttgccagctgtcggcggtgcgcagctcaccacgggattcggaacctatggacgaaactgtgctgatccgaaattccggtgccaggcacctatctcacggggagagacccttgcgactcctgggtagacagagcttgacaggacagggttttcacctggcgattcacaacagggagtggcggtgtagccgataggataattgcagttttattagttacgctcgcccgagaccggccgttgcctttcaggtcctcacggctagaggagttacgctgcatcaagttgaacatcgacggagtttggttctcaaacattacggcggcactcaagccggtccagagaccacacagtactaaagaaatgtacgggagcttatgcccgtagtgatctgtcataacgcacatacgtggtcgaaggttttatcctggcgtagatacgtttttttctaaagctcttcgacga

SEQ ID NO: 3854 - DNA, 2440 bp, Toxoplasma gondii
ttggcagccttacctttgcctttcgctacctgttttgttgcaatttctttcttagaggccggcttggtctccgccggtttagccgctttggcttctttggccgcttttccagacttatctagagctggctttgtcagagcggccttcgtgcccgtgggctttggcgcaggcttgacaaaaggttttttctcgggggcagcggcatcatgacctaggacttttttggcaaccgggactggtttgggtggaggggctttcacaggtccaccgggccctggtttcttcagaccccctgccggtgaaaccggtataagtggtttcttgacgacaatgttcggtttctttagtggtgtcggtggaattaccatcttcggcggagctgccgccatggctgccagcacctagagaatggagagacagcgtgaatgctccagacaatccgtgcggcttatcacaccctcggtaaggcggatacagcctgcaagactctctcaaaggaaggcatgttcgccagtcgaccacatcctcctattggagcgatatcatgaagcctcttaactcgaaatccccgttttaaactcatccgtttgcagacgcctgcccatgaacagtaaacagtgactatcaagcgccagcggcacttgcttctgccttctgcggatgaagtctgccgtggaacgcagccggaaaggtcacttaaacgagctataagacctgacagggaggagatatgaactctcacggatgtgaacccatcaagaatttcagttgcgtaagcaagaaacgatacattgtagcctattatcgacacccagtccacgacacaaggcgccagtatgttctgccaacggcgcagagccgacgcacaagccaaggggttcagtcatccgagacctgtgtgttactagtctttccggagttagacgtaccgccaagcgtaacaatagaaggagctccagaaaactgagaagcgttgaaagagagcgtagctccgtgatgaagagtgaatgacacccttcaaccgttgagctagatctgcgttgcgccatgtacggagtaacaactcgggtttccggccccactacataaagtagacaacggaagaatatccggcagggagacacggagtcataaattcaaaccaacaaagacagcctctgacttcttggaagtggaaggtgaacctgtcgtgaaaaaccgcttgtcttacacgcatgcggccagcgagcgcaagctacggctgttgaagtgtacgcagaagctatcgtggctctgggtcatatgcgttgcagtattgttcgtgtctacagattccatttttatattttgaatcgcggtattttgtcatatgcgccacgaaagggcgaggagtatttccgcaaaggagacacatggcagccacatggtaggttcttctgttgctcattcctcgcagagcacgggtgggagaactcgaagacggcacagaccacagcgtcgctgagcgagaggcggagggttcggcgagcggaattcttgctacaattgtctctacgactgcaggggttttgcgagctccttgtgggcgggattttttatctcccggttcgctgctgttttagccatagttactgtgggaactggttagtactctacataaaagggtaactagggaacacggggggccgtaaacctcaattcttgtgcgtggcaccgaacatgggccgtgccttcccggcccagattcgcccagagagccttccatgattcagcatggaaaaactttaaccgaaactctctatgaacgtgttttccgcggatgagcatgctaggtgcatctgaacacaaacttaaggtgaaattcccaaaaataacgtagtggggctttacccaggcggctgcgcgctagctatctcggcgagagacaaggcaaatcggggagtccggcgctcgtagccgccgccaggactgacgacgggtaaagcaaaaccccctgcttgttgcccggttctccgagcctgttgctgacgggtagtgggcacgtatttccaggtcgaccttcactgtagaggtgtgctcgtcctagcaacttgtttataaacttagcgtaagtcgtggatgcatcgcgtagtgaaaagcgctaatagaggagtgctgctgctcggtaaattttgtagagcactcccctaccgggcttcgtcgattgttggtatgacagaggttgcaggatctcctggagtcatcgagccccacgcttgcgcgagaaattgcggaaaggttcccttgtcatgagaattcgtggagaaattcccccgtcatgagaatatcttgagtaaaacgaagaagggaaaggcgacccagttgctattcagcgagctggcgctgacctccagtcacccccgcagcaagatctgagagacgttaccttctggagcatctgtctcctacgtttgaacagaaa

SEQ ID NO: 3855 - DNA, 2715 bp, Toxoplasma gondii
atgaatctacgaatcccggtaaatatgtgtctgtgtctctaccctcacgtctggttgcaccctcacctagggtacatatatttttgtatggccctcgtttttttgtgatatttcgatgtgagtttttcggtgtgtacgaggctgcgctcgtaggtctcgaggggggagagcactgggattgttgtctgttgatttgcgttcagcgtttcttcgcgcggaccgaggcctggcttcaggctcaccttttctgtgcccttgacgatgaagtagccgccagggtcgaaagggcactcgccgagtctctgcaaggtttgaggatccttgccgtggaggacgcagacgcggcttcggagcatgacggggatcgagccgatttccacatgctttctgcggatgatttcgtcgcctttgctgtactccgcgtcgacgaagaccggcgccgcgtaggtgatttcgcgggtgcggcaaatccgcggtgtgagtctctgcagaatcatgccttcctcgtagcgcggcgttccgacggagatgttgaggaactcgatgaagaacgacgggtcgacgtcgctcttcacgagccgattggaaggcgcgcggagaatgttctgcagctcagtgtccacgaagaaattgtacgactcaatgtgttggtgcaccagtcccttcgccgcgaagaaggccggaagcaagcgccatttgtccggcacagtgcagacaggcttccccgacgcgtaaggatctgccacagtcgcattacaagaagaagaagaatcggcgctcttcttcggaacggaggcaaatcgaacgctcttcttcgcgcggccgccctcctcgcgcgtctccagagaagctggggacgccggaggaacggcagaaggaacggcagaaggagcggcagaaggcgacgaagaaggccgcgagctcgcagaggaacgacccccaggtgggcgacagtaggggattcttcggtcggaaggaacgctcgcgccgtagggaaacctcagcctcgtcgacgaagagggagaagaggcggaggcatcaccagacgtcttctcgctctcgttttgcgtcgtgtctctccagttcttcagacctccgaggcgaggcgagagggaggcaagagggtcaacctcacccgagacgacggccgcaggcgccggagagactcgcttcttcccagtcatctcgacagacggagaacagcgactctccatcggggagaagaggacagagactccttcacaacaggaaatccattttctgctcggtcgctctctctgtccgcgcctgtttccacgcgactctcctgcttctctgctggcgttccaaggacgagaagaagacgcgagaagcgtttttggacggaaagaagcaaacaaagatccgccagcaaggagaaacgaacatcaccgccggtagggacgggagagcgcggttgacaaggtgcggaagaaattcgaggagcttcgagttcctcctcagcgagttttaacggaaaaaaacagagactcaaggcttgccagatggtcgtcacgaaaaggcagtcaaacgccttttgacatctgcggcaaaaaatacagttctcggactctttcagttctctttgagttccttctcctctccccgcagccgcgagcggaggagagacagcgcttcgtcgctcgacgcctcgcccccccccagaaagagggaaggactagagcccctcaactctcaagggagagaaaaacaacaaaaaagcttgctttcgaaattgaaaaacgaaaaaaaaggaacaagtcgtgagaaaagaaacatgaaaggtatcctgaatgtataccgtggggatggcttttatgctcacaccccactgggagtgaacagagaggagaggcgtttcgctttctctgcgctgtctctttcttctagaaccttctttgctcgtatacgaagacctaaacgtttttctgtcttctctccctcgactctctctggggaagtcttggactctaggctttctctgtcctctatttatcggcattccctcttcctttctctcttcctttctctcttcctgtttctctttcttgttctcttcttcttctcctcttcttctctttcttcttctctttcttcttttcttcctcacgagctgggcgcggctgagtgttacgcgttcttcttttctcgctgcggctgtcgtaaatcactcgagtgaactcttgtgctggaactccagcgtctctcgacagactttttttgcagggcaattcgctttctgcatccttcagaatctccttcttggaaggactttttctttctctccccgccctctccttcactgctcagctggtgctgttctggcctgtctcatctgcacacccctgtcagctgcgacgcctttctctcctctcttttttttctgaggcatttctctctctaaaactctctggggtctctcttctttgttggacttccaccgcaacgccaagaccgctcctggcccgctctgtctgcatctgtttcttccttttcttccctcctctttcttttctccgttgttcttcttctcctcttctctctgcgcttctctctctgttcttctctctctgttcttctctctctgttctcctctctccgatctctgcccttctctcttcttcggcctgccttctctgctctcgtcgcccacgcaggcttttttctctctgtactcgagttcttccccgagaacaa

SEQ ID NO: 3856 - DNA, 3045 bp, Toxoplasma gondii
agaaagggagagataggccaaaggcagacgcacgacagagtcctcgcggcgtgctctggtcgtcagcatcgagcccatggtttcccgcgtctgatgcacaatcgaaggaagccgcgaagtgtagactttcttccggggcctctcgcagtcttcgcggcgaatgttgaaggcaacaccccgcgctacacgagacgaatttcgagggtgaatcgtcatcgacaaggaagaacgggcctcgcggcgacggaggcagcacgtcggtggtagggcggaaggacgcatcgtggcccggagggcacaaagaaggagacgctctgtgggcgaagctggctgttgagtggtggaagagcagagaaggcgggacacactccgtgcgcgatctcggcgcatcgccaaccaatctctctgtcgcatgacgagcagccgacgagtgagcaaaacacagggacggccagacgtcgcgggcatttggttgactgcaaggccccgtctcagactccaggggagaagaaagggaagcgagaaggggggtacgacagaccccagcttcgggaccgagagggaggctaaatgagcctgccatggctgcggcggcgctttcgaatgctgccgtgccacgactcgatcgaaacgaagcttgtctttgagttccaagctcttcgtctcccttttggggaggggacgcaggcgaagaaggcccgcctcccagggggacgacggggtgagggccgccttcgcgagaagacggcgacatatcactgttgtctttgcatccccagacacacagcgtggcacccagcctggccacaaggaagcaactgacgaagtgaacgcacagaacgaaagcgaagacacttcgcggcaaggcaactcacccaagtctcgcgccactctctctctaggcgagatcggaccaaggtacggacgtaaagtttgcacctagttgactcatcaagttaaactgaggagttcggtgtttacagactgtaccgttacgttatcccccaaagagcattcagtgatcgtgtctacgaaatgtggttagatcacctaaccagcacgatccggctgctcgggaacaactgaagcaagatgacgactctcgctttcaatgtgaagggacttccccctagagcgaaggccgatccgacagggtagagcaaggagactgacactacgtaggcaaaaactaaggagatagcgccaacagtttggccatgacgggggaacaggaaatgaacggaaacaaatacgacaatagaggagagaagatcaagcgaaccacagcaacaaaccagtaaggatttgccctcccgtgcgaggcagcgaacagccgttgagcagagtgtgacgcaagcgaaggaaatggtcgtaacacaggaaagatattggaatacgaaacacaggcatgatacgagaaaagaaatactgtggagaaggtgaggagaaaagagggatacccaggaaataaatgtgaagagtagttcccaaccatctagtgatgaaatgagcgctggatgatgttccacaacatgctcgcgaataaaggaacacaccaagagggaaactggaagtcgacgaaaagacacgtcaaagagaagcttacaaggaaaggatcagaagccctcaaaaatagtgttctttaagggaaactcgcgaacaggacaaatgaaccgagcgcagggacacaactgacacacacaggaaattaggatatacccggcgtagggccaggagtcttcgaagggacggaagacagatgatggtacaaacatcaaagtctgttagtactgcgacgttcatatatatatatatatatatatatatattacacggttaaatggactcggactcgttgcgtgcatgtgtgtaaacatctgtgcacaagtgcaggaaattctctttgggaggaacagatgagtaacgagacaaatgaggagataggcgacgtctgtcctcgccgcaaaaagaatgggtcgagggctgtgtcgcgatgttgaagcgcgatttgtcgccaacggccgaccggagcgttggcacctaatggctcgatgtggcctcgcatgtgcatccggggaaaaagaagctatgtccactaggactgcaggaagaaagcttgtcgtcctgcatggaataaacgctcacagattcggtttgaaaaccagcagtctgttgtccgtcttttgatctcgcgccgtctctgtgagggttgaaacgagccgcgcaggtaggcagcaggctcagaagagacacagggaagagaggtactgaatctttacttccctccttccactgccttcatcttctgaagccatttcgccctctcgcctcaatctccaagaaaaaaccaaacctggtctcgtaactactccctggttgtgaggcgctttccccctctagcgctgtcgcgacctttcgctcccgcttcctctgtctcgggtgactgcgcagtttttttacggcctcggagcatgcgcatccgcagtcgcaaactgcattctgaaacccaacccaagtatcatccccttggtagcaacagcaagaagggaggttcctccaaatttcgttctgttggctgcccttctctgtatacacacgtctgtcggcgacggcctgagttctttggttcccggttttcttccccacgaagtgaatccttggttgtctccttgtcttcttcgttccgtcagcgttgtttcgctttcagtgtggctcctgtgtctttctcgtcttcttcgtggtgaagagaattaccgtttcttcgcaactttccatctttctcagacctgcgcactgactgcttcgccctgcgtagccgctctgtctggccaactgtgaaccaccgggagaaaacaacgcggcggaagtgtggaaagtgtagagagctctgtttatacgatcacgggcagaaaacgtcggctttcattgcggtggatgcgtgtttaagtcgcgaaaatcctccgcagacctagaaagtagtggcccctgggtcctttctgtctagaagctcgcgatttcgtgtttcggctttcccctgcgacaaca

SEQ ID NO: 3857 - DNA, 2463 bp, Toxoplasma gondii
ggggtactacctggatgagagacaagttggaaacgacttcgtttcggcgcgggagaaagccttcatcaccgacgctcggccgggcgcgagaagccgcgcagaagggggagacagggagcgacacgaagaagtagacatcgatctggagggcgacgttcccgatgaggtgttcggcaatctcgccgctgaagcaaaggaaatgcgcagaaacaaagagtgaaaaaagtgaacagacgcacccgagaggggagagcagaaagcggaagaagacccgctaggttttcttggtgtggtagggggggaaaggataggaggcagcagtggtgagtctgaagggagctcggttcttctctgttcatgtcccgttaccagcctctgtttctcccctttcgcctccttttcccccgtgcacacacctcgcggacgaaactcggtatccggaaatctaccagtgttcgtcttatgttctgttgctcgtatgtgtttgaagaccgttcgcgttgggaggtgggaactaggcaatctctgaagctagcaaacagtcctgctctgttcgttcagctagaagcaattctgaaagacgagcagactgctgttccgcgcctgccccaaaagcggaggactcacccagtcgttgggcagtcgaagtcacgcggaaagaagtttcgtagaagcgtttgacacccagacactacatctgccttctaaatcgacggctgatgactacgtgttttcctcccgaaaaatccgtaagaaactagcattcgaccagagccactgcgtatacttgtcaagattgccgctatttgcccgtttccgacccccactagctggggtgcacgcattgacgcgacctgaaagatttcgtgaatgtgtctatgcagactcggcccggtggtctcgccaccagaaagagttttctgcatcaggcggaactcgtgcacaagggtgctgaaacgactcgccatggtattgtagcttgacgctgttgacaagattcactattctcgatttcgtagagcaaagactccgaacgaggttcctaccaacacgcggtcttggtgccacaacttgacacacacacacacacacacacttttggtcacgcgtttcagaggggccatttccttctgacaagaaggcctccacttgacagaaagtcggttctcagaagggggggttcgaattcacagcggtacgccgatcgtgcctctggcaacctagatcagtaaaaggtacagcagaggcgttaagatgattggtgtatcgcctaaatgattgcgttttttgcacgttctctcgaaactaaaggtaccggaggaaccccaaacacggtacctccacttcgtgagggcgagcctctggcaggtgtacaaactccgtctggtacgtgtcgcttatccgggtgcttgtctgcttcctttcctttcatgtggattggatttcagtgaagatgtccctacccctgacagacatcgcatgcgtttcatttgagagggctaccgatgaagcagacaaaggcagtgcgcgacgagtaagattcgcgtgtcgcctcgtctctaatgtggcaagacactacaggcagctacgatggcaattgaactggaaggccgccggtgcctactacgcttccttctttacgctgtctgacgttagcagcttctgcagggcgctctttttgtttgtggtttctgcctccattatgtcgtctgttcagaacctctttttgtctatcctagctttgcgggggcaaaacctttttaaggcgcagtagcgcgaaacgcaaacgatgacggctagctgagccgtcgaggagaaccttctcggggcattgcttgagtggttcctcgcatgaatcttggcagcaggcacgtctctgttgtcagccgtacatgccttttggagtttttgcccatttttgtaggggaatgtctctagacccaggacaaaagttcgatcgacggccgaatatggcaccttgcccatctcgcaagtgtgccagaacaagtcgtgcactgggtcgaagcatatttgtggtcaccttccctgttctgtccactaattttgattctcagtgccgtgttcgtctccaaggcaaaggacacatatagaacattcgacgcacaagtcagagcgggggaggcttgttctccgtcgacgtcggcgtttttttctggccctcgatttcacgtacagaacatatccccctcgtgtgagtgacttccgccaaacttccagacggaaaggacaccgcgaaaagcagtcttgcatctgtgtatatagttttaatggtgcctaaacggtaaagagtcagccgttttgtccatgtgctttgtgtctcgctacgtgcgtacaagccgttcgacacgcagtcctttttgtgatgccgctctcccagaacagaatttctccttcatcggtgtgactctgcggtgactacccattgacgaagtttgtggagga

SEQ ID NO: 3858 - DNA, 4779 bp, Toxoplasma gondii
tttttcttgtgcaagcgagcaacacacattggagagagaggtggtttcggtgacagccccatcgttttttcaaggatttgtctccctctcgtggttgctcagtggagtggtagtcttcgtgcatgcgtcgtgatgtatttcggtggaatggcgaagacagcaaatgcgcgacatctttgcggtcgtcagtggcatgtggcggcgatggacaaattgcaccaacgtagccgcaagtctctttatcgcaaggtgcaacatgcgcaggtcctgtagacaaaaacgtgggctgagcccttgaagtgtcaccctgttgacacatttattttcaaatcctattgctgactatagctctttaacttttttaaaaaggaaggaaaatggtggtggatgaagagcttcagatacagagatgaatagcgtgttagcaaacccattcatgcaggataatgctgctttcagggagaggttcagcttatgactgactaaactggtgtaacctaatgaaagcgctttatctgcttccacaattcgacgaccaggtggagaagcttgaaaaagtgattcgcgagcccacatcaagggcttgctgaacgcagtcaccaacaagcttcatctgatgccgacgaatgatgctaccgtcaagatgtggttcttctgcgggtcatctgccactggtatggcgttgtgacatccctagtataggacttcacccgttaccgtcttgtgcttccgtgatgaacaaaactgcattttccatagctgtccatgatacgccaataccaactcggcagcagaggagagaactgcgtggcttttctttgcacagatatggatgtctgaaatgctctaatggcttcgttactacctttgtcagagaaaggtttgctggcgtcccttgatgacagtttggtcacggctgctaacctctaaattcggcaggcctggggacatgcatatatatctccgagttgctcttcagcggtggacccttcgcccgccatccttctttatttgatacagaattgcacagcttacgcgaaagacagacaggcggacaagcggaattgatactttactttctttgagagctatagaaaacagagcagagcaatagttgcacttcagcacatcaatgcgcgcacaggtgacttataggggtgtatttgaggaaatcatttatctcgaggtaggcacttgcgagaggaagggtatgctgggcaaggatgttccactacaaccacagatgcgcaggtattttagtatccatttttttagagttgcggttatcgaccctgactcttgccgttataaacatttatttccaacaaagtacgtgcctgcataagggcacacagtacccgcgtgtcttacgggtaccaatgtgctttcgccaagtggtatcatctatgaagcaacgaatacagataccgacagctacctgtgttgtgccccgctggcgacaggaggaaagcgacagttcagctgatgaatataaaatactcgtgcgtatcgcagactggaaagtgcggtagcccgcgggctttgagcaatcaacgtttggttcttccatggttggtgagatagcttggttgtaaaaacaggcggaagattctctgtacactgtttcttccctgttcccgctttgatcgtgtagaaaatccacaactcagcagagcagcaaatttcgagaggcagtaacgtatgagggtaccacgaacagaaacgtttccttacgcagcttggcgatctcccaccacagctgcggtattaagacggtgcaggagaaaaggatgagaaaacactaacgtcaaacagttcatggataggcatcagtcagactgagctacttcaacaatggttttcctgctatacgcgacatctggtttagtggcagaatgctcacgcgtcgacgaacttcaccgcagcgctgagagggagctcttcgattgtgcgctgcatcagtggtttgggaacacctccactacgtccacagactatcgcgtacactgcgccaaggattattacggagatacccaggataacgtcgaccaaacctttctgaaggattacaagtccaatggtcacgtagaacaaaccacgtccaacaggtatataaaagaactgcacgtaagcgaacagtgggagtgctttgacatctgcgatgatggacagcactcccagcatgatcaaaataacattgacggcgagacggagcggatcgaagaatatcataccgacgatgcctgatgatattataacgcctaagagaacaggagacacagttgagccaaaagcagctggcaactccagaggaggaattcgaagagaaaatggaatagtgaataagaatgaaagacaagaagcaaacgacaaggaacacgaagtgctcttcaacagaacgagaagcatgatggcacaccaaaccagacctgctgcgtgacatttacgacgcccttcgtagaaacctggaccagaacacctgctacatctttgcagggcagcagctattcgagcgccaagatgacgagccactctctgggtgttgcgggttactcattcaacagacggattacttcaacagccgaagcaagagagcctctgatctgaaggacggtgcccaggcattacttgaccactctttcggactcgtggaataaggtcgaatcacttacctgcagtaatgaacgaaacaaacgtcatggccgccattgagagccgcacactccgacagcgatcaaggactgcttctgtcgacattttgggagaaaagagaacgtcgaacaaaactttggtttctcacgtcttgactcttctgttcctccgtggcattgccgagacgattaaaaaattgatgagagccccacaacagattcacgaatctatcgaacacacgtgtaaatcccaaaccaactctcttacggatttttcttgtagtactttctgcttctccagggcgagcaaaagaaacacgctttgtccctgacacgagatcagcccctcggcaaatggggaactcacaccccggtttttgagcgatcaacgatggacctcccatcgccggttcagccccgcaggagccctttcggtgacgctactaatgtacttctcgttaatacctaccgttttgtattcccattaatggttctttttgttggcggcttagtgccccaaactgtctctttccagtcttgctggtttacatcatgagtttgtgtgtatcatgtacggccccctgcatgtagcctgacgagcatagtgcgcctagcttccctcttcgtctctgtgcaacttactgatttctttcctccgacagaagagcaaatctctacccttagatgcgttgctgtttcatgcaccgcacatggcaagtaacgaagaagctccatactgtaccggtgtgcattaggaaccggggcgtaaagagcactgcaaacagataggatcaacagatttatcgggcaaaacatacgtggcgaacaagaaccagttgaacgatttacgcacaggcacgctgctagcgagagacagccgacaacctaatgcaacgctccttcacaggactcatagaccactcgataccggcggcctgctgctggctcgtgttggtagataattttcaattcgtccaccagtagctgttgtgcgtgttcgagagacagcatatccttttatggagttatgtaggatggcaacaatatcacagaagcaacggcggggcatgcgagaggaaacgaacatacgagagcaagtagaaaaagctgaaaatcaggtggaaccccatattcggtgatggatgcgtgaggcgaacttcaggagaaagtgtgactcggtgccattttgtttgcttggtccggaatgtgtgtgcaggccgctcctcgctgatgtcattcccaagctgtattcatttcctaagcgtcttatcggaacgcgttcaccaggatatacacaaacgcctaacgagagtgtaattgatgtctggcatttagaggacgtattcactgcttgcgcagctgcagaatatgtcaagccctacgtggagacgcggcaacgcatcaataaactcccgactggaacgacctcatcgtgtgttgagctttgcagcagccatgaagtcattaacaacgacgctgtcgatttgacaattgaaagtatgtgcaaaagctgcacccgtatgggtgatcgtccttcagcactattcatatagctgcgtcctacacccacgcgctgtgcgaccacccgttacagcgactgacacgggacctcagaggatgtgtgtctccctttcttgaattgacgtaggtagtcttttatgctcttcagtcacggaattaccaaaatcatctctgtactgttgggttatggtaagaaccgtggaggctacaggggaggccaagggcgtatctcttttcgcatgtctcgtggttccgacccgcgctgcggcgacttcgcgttgatcctcgcgcatgcaacactgcgggcacaggtaccaactgtaaaattcacgaattacacagtccatttagaatatgaggagctcctttgtggataacatctctttctgaggtcattgggacgtatcgagtgccggctgatgagaagtttagcgttcatgtcgcgaggttgtacgtcttcacgcgcatgcttcgtgtttactgggtaggggggcaacgggccaacgaggatgcttttccagtttaactaaaagtccttctttccgtaaaccgtcccgcgttgtggaccaatgacaccttgaaccctattacgtggctcatacgggga

SEQ ID NO: 3859 - DNA, 2092 bp, Toxoplasma gondii
cctccaaacaaaccaccgctgcgtctattgggaaccattatctggaggcagttcaaaaagccgcctcgataccaccctcctccgtgtttcaacaggcccacaatgtctacacgggctggagacggcttagcgcagacaccacatctcctccgaacgacagctgccagagattcaatgcacagatcgatttcgtttctgttcgtcgatgacaggcccagagctcggcaagtgtagaccccctttccacattggcagtgcctcgctgctgaatcagagagtttcccttgccgcagcatttccacactgcctcaaaacctcgggtcgccttcgttactcccttcagtcacgacaagaggcgcgacgcattggtgtggctggcgcaagactgcatgcccgcctggtcggtcgtttctaggtttccacaggtcgtcacttctgtgcaagaagagcgcttatcggttcgctgagaactcgcaggaaaggaggtaggagaggaaaaagggagaggcgccactcacctgggaggtcgtccttatcgatccgaaccatcttgcggtaggcgcgagcagaagcggagatcaggggggacgtgacgggcgccgaaaagccgcgatagacaccctggttaaaggggaaaaggccggggaagagaaaacgacgagaaggactgaggagccggttaggggaactccgtgactgcgtaagggagaaaaatgtgaagaaaaagtgaccccccacaagctttgcgactggggaccagacagaggcttcgagagacagagggaaaaaccgggagtgggctacggaaacgaaggacgaaatggaaccggtgacggataagagagacaggcggagaacggcaacgcgtcgtgggggctgaaaaacgattcaaagtaccataaatctctcagtggcgaggcgggaaagtcggggctgccccggtgaaaatttccgccgcaagactgacaccttctggcgatgccagattgagaaaaagaaaagacctcgaaagtcctcggtcccgtcgcgcgcgatttccagccagcaaacacgccaaaaaaccctgcagcgctttcccctcagaactctcgcgcacacgacacaaccttcattcgctcgtgctttccactcccctgaattgagcactgagtgcatgcatgcgaaaagaccgtgtgccccccttgtgagggaaaccccagcaacgtgcagcatttcgccagccagtccttgcagggcatcgcgcgcgaccttctacctcgtgttaccgtagcccccccgaaacagccgatacgccgtccaaaccggaaactgggcggcgtttgagcggctttctctgcatggcgtggaaagaaggggcttcttcgccgagacgaagagacaagaaaggatcccaatacctctcctagaatggcttttgcacagggtgaagcggaagtgagaaagaagagctgtacacaaaacggaaaaaacggactcggcaaatttgcgggtagagtcttccgcgttcgcagcgacttgggctgctcgtacgctgcagcggcgccgagagagtgtgtcgcgaaatcctgaacgcgatccatatctgtagggaaataccgcgtttcgctcttctttcgccacaacagcaaacataccgctgcctgagacttctcggccgtcaacacgcagtttaaaacgtctctaccaagcttactcgacacttccgtatcactcaatccagcaaccgaatagcttgctgtacactaccagacacactgccgctttcatgatgtaaaaccaacatcactttctctgtgtctgttctgtatcttcaagagatttcgaatactctttgctgggtgggggtgtatgagatcccacgggttcggtcttgaccaggccgcgacaaggcatttccttccctcgtacctggcacatttccatccgctttccctgatttctaaattttctccaccaaaccgtcattgctccgggcgccctcctctgccgttgcaccgtccagacgtccgcggcgactgcgggtccactgggagggattggccatcgtcctgaccgagagaacatcacttactctttcttcccgagcccacca

SEQ ID NO: 3860 - DNA, 4012 bp, Toxoplasma gondii
agtccacccagagacgcagcagaagatttttgttactcccaattctcggggtcagtacttcctcgagggcttcgttatgagtgcatgcgtgactgcctgcgggcttgctgctgcttttcttgtctttttgccttcttcgtttttcccgactcgccaagagctagccggtgaggctgggacgccggactgcgagacgggaaagaaggggagcgtgcaagcgctggcgcgccccccccgtctttgtcctatagatgaagaggacagtggaaacagatccacgagttttgacgtggaattggaagctggtgaaagccatggcagaggtgacgtgtccagtggcacgctcagggaggctagctgttcgggagagcaaaacagcagcggtgtgtgtggagcaaggaaaagcaaagacacaaggaacggaggaaaggcggtttctgatggagaacgacatggaacagatgaagcaattctgcactggatagatgcagaacacagcctaaatcgcgaccagggggaaggcttgaacttgtgggcgacccgcgtttgcatgctcatatgtctgctcatgacagcctttgcatttgttgcgtctgcaagtcttgtgttccaggtgtaccggcaaaaagccccgtggtacacagtcccgttctttcctccaccagaatacaagcgcggccccatgagagcggatcgaggcaacgaactgtgaggctccgagacgaaatagggttgacatcaaacaaaatgcttcgaaggttgacactgaaacgtgtcatgttttctaccgtgggatggtgctatactcaattccgctcaagggactgcagtggtaaaattgtggggcaaggaaaaacctagtcaccggagaaccgggaaggtgatgccacaagtgtgtggaattatctcctgtagtaaagatatgttacaaagccgccatcaaggatttttttcgggttgtttccgtgccaaacgcagccgtcacgcaatccggtgagactcgagacggaggatcagaagtcagctatctaggcttgcacaccacatcacatgcgattgattgcttgcttgaccctcagcagcccggaacattcacgaaaatcgtcaacgtcggagcagctttgttcgacgtagacgcactgcaccagatttgcgctatctccaacggtgggaagacgacaacatgctagtctacacatctcaagacgttttcgtggacacaaccggggcgactggcatgacactgaaaggagttgccaacattcccgagtaattcggtgaaccgatgaagtttgttcagaggacggtgtcttttttgctggcaactttctatggcatccagagtcaggactgggtggtggattagtgtgtgtccgcatccgtgtgcgtaccaccctccgctgttattcacgaacatgtttccgaatcaaaatgtgccccacttttcgaactagaaacagtctttgtgtttgccatcacccgtcagaccagtggtggcggctgccataattaatgcagcggtaccggacgcagaagcccggctcctatagaggctgcagcagcctcttcttccacattaatttcatggaaaacctcaacttcgcacgtctgattcacattcagctgataggaggcaatcatccaatatatacgtatccatcgcatgttcagtctaagcggggattcgtaggcggtagggacatccaaagctgccactggtggtgaaggcgcatgatgtcgcaggagctttgtgaaatatttctgtctaatcgatctacgtctgttgcattatccaggacattaccgaatcaatatgcggttccctatgacagtaacctcacataacggtggtcacaacagtataagagtccacagaggggcggggctatccgctctgccatgttcacgaagccttgtcaccctctatgacgaacttgttgattggtactgagttgtctgggtgtgatagatgtatcaaaccgaaaaccgatttgttagaagatgaatccagtccagtgcgacgggcatttagcatccgttattaacatatcacgatacaagacaccttctgcatccctttcggcacgttaagttgaaccctcgcgacggcgacgaacgcctgggaaagtaccactgtccagttgccgagttctcacccttctgggtcgttacgaggaaccccgcaaatggagcgtctcttcgccgggctagttgtctcaagcttcgtgactgtcgtgaccgcggaaaagatttaacaccaggcaatatctttgttttttaaggaaatctgtgttgggccgaagtagttggaggtgtagagaggccacgacgtagtatttttttttgggaagcacgccaggaccctgtaccagacgcgctcttgcaaccgcgcagcacccggagacaggctgggaagcaagttctcatagtcgcattcttcaagcaactcaactggggtacctcggttcgcagacacgaactggaagagggttaggcgagagtcgacacttcagaggaagtcagcttttttctggtgtctgcggtgaagttttgagggtgaaggagacgccatttgttaccttctgtcggaggaaactactttcacttggaatgtgtctaggctctgcagagcgcgcgaaccggaagcggattcctcgtgccggcttgcttgtctgggtgtctggcatttaacacccactttcaaacctttacaggttggttccgtcttcgcatgtggcagaaatgctttataaaactctcgctgaaattgtttcctcgtcttggggcttggggggactccgggtcttcctcccttttgcaggacgggcaacggcttgccagcgaacccatcccggacaacggaacacctgacccaggccgccagcgatctggcgattgctccgacacagtttcctcggtttattctcttcgtctcatgtgagactccaatttgaaatctgtagaaatacgtgcgacgtaggctcctagtggctctctctgggactctagagagacttgttcgtaccctcgccgaccggaagacgtcctggcggtgctgccgctttgactgctggcgttgagccggttgcccccacaaaacatgtctagttgctgcaaagacagcttgtatttttacgcgactccgactgtaattgggattgtgacaagcgtacttgtcgattctgcgggacctgaaatagcttgagattctttccgcggcggacgtctgcctagggaatatctcgaattagccgtcacactcgtacttgtgataggttccgtgtgtctttcatggtaagtaaagaccttctctgtcacttggtgcgcttggaaactggatttttctgcctctttgccgttgacgagtcaacttttgcctcgatgacccgaaccacggtcaaaataagacagccaagagctgtctgtgaggaaacaggtgtgtcttcaacctgggggcctgaggcattgcgtgtttcctctcattgtcggatgtcggttatagaatagtatgtactttacctattctagcaggtgggttacttgtaattctattaaatttacttaagctgtgttgttcgcggttccgtcggtccttcactgaggaggcaactgccacttaaaacctcgcgtcactgacgctcaactctcattatggattttgcatgatcgtatctgtgtgatctgctctctccggatgtaccaaggcggaaatccaggagccgtgtggaaggaatgccagatctgtggtacctccgctctatgaggaacaaaaattggtggcctgcgtaacgaggttcctctcgaaagacaggaatcggtgtgccggacgactgaagcgccaaaaactactgaaaggaaacacaaaattgtgccggtgggcccgtcaggttcaatgacttccgtgcttgtcctgtgcttgtgtcaggacgcttctagaagccacctgaacaaagacgataggcattccaaacggagttttttccttctgccacttttttgtgtgtatggacaa

SEQ ID NO: 3861 - DNA, 1930 bp, Toxoplasma gondii
aggaactcgaggcgcgtcatgtctgcgcagagatactccattactggcgggagaggaggagagcgaggagaagaaggagagcgaggagaagaaggagagcgaggagaagaaggagagcgaggagaagaaggagatcgaggagaagaaggagagcgaggagaaggagacggagaagaagacgaagaaggaggcgagggagaagacgaagaaggaggcgagggagaagacaggtacttcctgatgcattccctttcgtgtcgacgtttggcttgaagcactgtgcggctgaagtcgagattgaagacgaacggcattccacttgccactagcgcatcgctgagttcgctgttgccgcagcccactgtgaggacgagcatagacggacggaggagaggaagcagaagcggtagcagagactctggagactccagccattcgtagtgcttctctgctgcaaatctgaagacgcagaagagaccgggaacccacagaacaggagagaaatgcaaggacagcaagaagagctgcagcgagagaacggggaaagagacgccccgggcgcgaggagcgtctgcacaagtcagcagcagcagaaaaagacgaagaagcgacagaagtctgcttttttctagcgactcgctggagaaacaactgctagctactgcgagaggcgcccaaaaagaaagtcaagaagacacacagggcgaagaacaaaggctacgcctccaaggcaatcttctccgcctaaaacgagagagaaatctgtacctttcttcccagtattcctgctttgcgtaggccgagttcctccgaggcaactgtcgagccgtccccttttcctccattttcctgaacactctgaattcaaaatggcagaagcaagagagagaagagaggacaagaggggagaagcgagaagaaaaaggagaagaagaaaagagaagaaaaaggagaagaagaaagtagggaagacgggagaagaaagaaacgcgagagatgcgcaaaagtccagagaaggggaagaatcgactgagagacacgcagaagaagagggagaagacgcaaaagacgatgcatgccccgtgaagaggcaggcgagagcgccggagaaagaaaggtgcagaaacgacagacagaaaggagagcgaaccagatcaagaagaatggcagaaggcgaggcagatgctcatcttccccccaggcaaagcggaaaaggcacagttggagactccccacggcgacggcgagagaggaaagcagaagatgtttcttcttcttttcttcgccttttcgagtgcggacaacggcaacttacgaaagcgaatcgctgcgtttcttcgactcagagagagacgggagagagagactcaaagacgtctcgctttctgcagtgtatcgatgcagctggctggtttccggcttcttttctccgcggtgtctccaagacgcagacagctcgagggatccggccgccgctgcctcctcgatccttcccgtggttgagatcttccgagccagttcacctgcttgccaagagagaacttgactgcggtttacctcacaagactccaagacctgtctttctcccctcggtccccagctttctcagcgaaacggagacaccccccgcctccgcaaaagcgagcacacagaacgacatctggctgctttcgcgcgttttcttttttctgtcgcgctttgcatcaattttctctgactcttctccatctcgttctctgtcgctcttcctccctctgtctctcggcctctccggtttttgtcacgttctccctcactgtcggtcttctcctgtctccctttgttccagtctctccccgaaatcgttttttttcgctttttcccgtctttctcctcttccttttcccccgtctgtctctgtccctttcgatgtttttctgaggtctcccca

SEQ ID NO: 3862 - DNA, 2609 bp, Toxoplasma gondii
tctctccagatctatcggtctgtcttatgttcttgtagcttggagcccgtctccgagatacagtggatgaaggatggacggaaatgagttttttgtgtgattcgtctgatagtattcaccgaatgtgtttcagctcttggcgtcctttgtggctaggcgttcttctgaacgttccgactcaaccgcaattttcttacgattttcgcttctactccacggtcaccatcgttgaaaccagaacgagtggaaccatgcagttcgcagttggtgaaacaaagaccttcgagagagctaaatgagtgaacaaagtctcagaatcttcactccccagaaaatgctgaacatccgctcttgtctcagagaagattattccccgtgcgacggttctgctcctacgagcatctgagtgatcgctttctctcgctattgatgagagtgcaggagttttgcgtcagttatctaatttcttgacctaataccacctgggtggaataaaacatgtctcggcatcgctcgcgctcaaagtttccccgcagcatttacaatttgccttcgctttataaatttttgaaagacacttgatcgaatcggctttaccccggtgaacaataacttttgcagattcatagtctctttcgactgacaaagcagacatcaatccgcactgtagaatctgtacctcggaaaagatttgacctttctttatcgtatgagtcactttgaaaatggactcactgtacaaaaaacgtaatgtttcagggatttatcgaattaattttagtgccgcgtaagagggcgggcagcgtgtgtcaggcagcccaggtccaggcgacattccagcaaatgtagtttatcttctttcttgctacgggattttcaacccgagtaaaagcttgtgtcatagcctcatcacagtaagaagagaaatactttaactgctgtctccgagatccgcaacttgtgttttttttattttcaaagcgcgaatcccagatctgtaaggaacgacgcaaatgtcccgacgccaccggcttttacaggaattaatcctaccaacagagttcattaatggtaataggaaatatgatgttgcgcgagttctgcgaaaaaggttgcattacgaggaccatggtcaaccgttcaacaaggaggcttgactcgtgcagaacaccggtggcattcagcttctggaaaccggacaagctgcacagaaagtggcctttcgttcagctgggaaaagccaaacggggaaaggcgcccagagagcatttcgtggtgactcgcatgtcgacaacgagagaaactctttttagtcgtccagaaaaatccgtagggtgtgtgccataaaacttgcacctaattagcgcagcgtaattaagataaggcgaaaacgaaaccccacatttttgtcgtaaagaacatgatatcttacagaaggcgcatttttgatgagttttccatcaaggcgaccctctgttgggtcgagcggggtctcgagacaccaatcccggagacccagtttcaatcttcagcatgggcagcgcttgtcgacatgggtctcttgaaggtagaagcatccggactgttgacatatctttattttcattcaggagatgtcaacacaaatatatgtgtagccgacgaaaacggtgttttttcacctgctctgcaccagcctagaacgccagcgagtggccggcgcatctccagtgtgcatgcgtttgagactaggaccccgagtagtcactcgtccttttcaacggcctgtcaacacattcagccgaattgatcgaccaacatttgtgcgaggaggcacaaagaaatgtctgtctgtcgtccctttcctccattacacactccgcacactcctacctgagacatgtcaacaagcgcgctgacatgtccgtccgtgtgtatcgagcatgttgtaacgccggcgtacagcgcttgatgccgactgggcgttttctctcacaaatttcggcgttttgcttttcgtttgaagttccttcaagtgcgttcatcacatcggactgtattagtctctcgacgtctctgtcgccttgtttgtttgaatctgtcgtcttcatgggttccaaagtcgcagaccacgctggcgaccgccacagatcacccgttattctacgattgcctggttggagggagggttacttgatttccgcttggatctgttgtttctcttcttaactactcattaattgagacacagccttccccgaaggccctcccgtcgtgcttctctcactgaacaacccagtttaacacacaagtacacagtctgctgctgcaaacgggtcttccccgttgagtctgacatctcggagtgaacatccgcaactttgtcagcttgtacatcctggacttccctcacctacctcaccggcaatttcacagtcaactactcaagcttcatccctcgtgtaggagtctacacggctttgtttactctttttgaacactgtctctcgtttccgctccacctgatactttgcttcccggccgatggttttcgtcgtccacacacttttttcatcgtgttcacttgccgagactcatcgttcgtttccttcttccagttttttctccaa

SEQ ID NO: 3863 - DNA, 1265 bp, Toxoplasma gondii
ctgaaatagaggaagcgctgcttgggatagccgataaccttgtccgtacaccagctttgcatatatatatataaataaataaaggccaagtttcagattttaggtgggcatcaacgccaaccagcaagcatctcactgtctggtggcggctgccagaaacaacaaaaaacaacactttgatgatatctcttgtttcctatttccttgctgagtctcctcttgccttgcgatccgcaatgtggctatcgttttcagcagctgttccacgctttaaatgccaagaattctttgggacagatagaagaccggttccgctaccgaggtcggttgcgcgcatcggtgatacgagtcccagaagcgccatcaagcgccattgttctcgcccttgtaacgcccttctttgccttctgtgactctcctgtgtcgtcttcaagtccattgacagcatgtaactcagcaccagccgcaacgtgtgtttcctctcttcgacgccaatgcataaacggcaaaccggcgccgaataggtggcagcgaagagccacgcacaatggaagagattggtgtgagaaaagcgctgatatactaggaagaagaggtcctcgaatgaagcgacgatgagcctcaggatctcgaaccatcatcgaggtcgagtttttgttcattctttaatggaaaggcgcgtacacgcaacttaattaagactggaattccacgcgccacaccacctcccaagtggaccgtgtaagaccagcgaaagtgttagatctcagtatcgtaccagttttcataccagcttgggagctgcggctatgctctcgggtcgtctacacaaatctattaacatttgccaacttcctgggatctctgaagctcaccgcgtactggaaagcgtgggcgagtcaaagaagagaaacatttatatcctaaccacttgcctcgaatacaaatccggccgcgtcgaccacgggcgttgcttcgttagaacaacatgcttattgactagcgcgagcgccacgccttctgcgcatgcagtttgtttttcttggcgtgagttccgtcgatagagtattctgttgctttgtccctgaatagtctgtgcccgaagaactcgctgaatccttcgcgacatcagcaaatctctttttttcaggtatccgaagctctgtctgttgagtgccgactcctgtttctttggatttcccgcgcatgcaggcatatatgctggcagatcgccgttctccattttctcgccctgagcgcgagca

SEQ ID NO: 3864 - DNA, 2807 bp, Toxoplasma gondii
gtgcaagaaacatcagaggcgaaacgccacaagcactccgcacatcgccctccccttcactaccactgcggaacccgcaaacaaattctcctgcagaaggggatgtggcgtttatggagccgcacaagtgtggcgagaaaacacgcgcaaacgagcagggcgacgaatccactagaggcgacagagggtgatctgttgagggtgacgggtctgtggattcaccctccaagtccgccctgtgttgcttaactccactatccgcgacgcggggtgaacgtccagtcgtttgcgagtaatgctcatctgtatgcacatagttatcgacccgcagcgttccctggcctgctactggaacgtaaggggaagttatcggggaagtgtttttgccatcctgtgtctcggttgtctgaatatcagcgcccggtgatattttgcagagcccgcccacgttgcctcccacaaatagagagtgagaatcgcattcctcctctccttcatgccgaaaaacgacgtgcgcaattttttgtggacacgcacacacagatagggatgatgaagacgacaaacagacggaggaaaaaattgggcgaggagaacatggggaagataactcggttgtcgattcacacagactgcccccgcgcatccgggaaaatgacaccgcctcacttgtcgaagcagaagcggtttcttcggtgattgtgccgaccttgccgtgtcccctcggacgccgataagggtgaatcattttggtaggcttccgcaaggtagcacgtgtccgccagtgaaaagcagcgaggcatcagcattgaaacggctttcacactgcactaacaatgccacgactgccgcaggaagaaaatgtttgctaatcttctttaggtagtaggataggcagattaagcaaagacattatattatgattcgcctgagcttgtccactggtatattgagcaggcggacaaattgttctatttcggcgcatgaaacaggaacagagaaccactgttcctacgcagaagttttgcttgtgaacacgcgtcatccggatctttggatacctgggagcccctgctgattgccaagggcagtcgttcgcagtgggacgaattcaatgtgtcggcgctccatcgaatccacagaagcgacaaatataatggcgccgatgtcgaaaaaatcaaaatgatcgactaagaaatgggtgaaatcgtcgccagtacttggcttccagctgtacgtatgtgacaaaagacgagagtcaaagagggagttgaaaaccacattcagcgtctctacgacaaacgggtcacgaaaaaggtcaaaaaacgaggcgcccggagcggctgaggctgctggcaaaccgtcgaagaaagtgtgggaggtatgaaacagcactacagagtgtgtcttattacgcagtcgtattcagcgacgagtgggaaagaggaattgcagaaaaaacgaagactaagtttgtcacgcaggttcgaaaaaacatcctttacagccacggatgtagacaaagctgcgggcgtgctgcgggcaccgtagttgtatgcagtttctgtctagtgggaatacgaaaagtcgagacggttcaaaacaacagcaacatgcaaacgaaaaagtaacagccactgacggggaaggaggccaaacgtctctgtttgccgccacttcaaaagatcacccagagaaagagcacttgcaagtagtttgtgtccaatgtaggactggcaaacaggagggttttccgcggagaaatcggatataaagaactgcctaaagtgaagacttctgtagacttcaagaccatgaaaacgtcggctagacgagtgtatattccgtcaaggcaacctgtgcacgctctcctgtggctcgtgcattgggaccccctcgttagggggccgtctctcagctagtaaggctggaaaacgacgaagcccgtttacagcggcacccaggaccatgaacgcaccaaaacacacaacgggaaaactaggaagaaatttcaaccaattgacctgcacggtcggtgctgctgaatgagcgtagagtttgactcgagattgaggttacgcaaggtcaccaccccaaacatagtatagcgcattgcctctcccggtcgtcgttgagttcggtccaaattacgtaccttgtgcggaaacgctcgctgcaactctcagaaatgaattattcgagaaacatccgcgtgagaagcactgatattagaatctaggccagcgcagcgacgaatctgtatcaattcaacctcccccacggagcaggacaggcctgcgaagttgcggcacacgtagtgtgtctagcgctcaaggacgcgcgcgatcatcatcgcgtccgcgtccgtcgcaggcggaagaagactcgagcaagtcgacagacgccctccttactagttattctaggaaaagaagggaaacagagagaaaaaataaacaagaagccacgcattcctcagtctgcttcgcctcgcgcagtaattcgctcactgtctggaatagaaaaccggtgcggagctgtgccacataagcacggggctcgcgactcgtatgtttttagttcgacaacaatgtcgaccgtttgaagggtgcgggctgtataactgcggaatacttgagagctgcttccgcaatatatgtaaaccatacagcgacgcgagcattaaacggtagatgggggctcgggtgcttcacaacgggcgaatatataatccaggagttgtctgccgtctttccctctcacgaaatgtcagcagcggaggaacacccatttgaggcgtccgcgga

SEQ ID NO: 3865 - DNA, 2134 bp, Toxoplasma gondii
gcatggccaagctcagctgcaagtgcaaccaatacaggcaatgaaattcgtcttattactgccccaaactttaccatcaaccaaatctgactttcaacgtgggtttcgcctacacagcatctgctgcattatgctcagttaacgccatagtttcagggtgttgtctggatccccgtaccaggcttgttgttgggcagctgcgaaacaacactgtgattgtcgttcctcgtcacactcaattgccatgacgccagaaaagaggtatttctgctgtgtaggatacatggaaaatgaaggcctacacaagcgggaagggaggcgctaccttaacgccttacaaaatgaaggcttctgctgcagctgctgcctgtccgtatgtttacatctgagcaacccgattctaaatatttgaataccagatctcgatggtacgaagtagagacgtgtctcacggaaatggtggacttgcctgtttaagactttgcaccttggactccaaatcaacgatgcaagcatcgttttcctcctccattgcgtccatgccacgctgctcaaacctgcgcctctcatacccttctttctttctcatcatcggtacgcgcgttgggttgaactagtcagaaagaaaccgcttccacctctatggctctctgaaacgactggtggtctttacgtagctcacacgccagccagccgctttctaccggcggccatccaatatcactgtcttaactctcgctttcttccagtttcgcgttagcgctctgtcctgtgcatgcaaacacgtgggaaagtggacaaataccaaagggaacaagcagaaaaacggatcggggcaaacaggcgcacagcctaccaacgatgtgagggttgcgcggtggaaaacgaagaataacagcaaggcaacgaagagacgactgtcagacgcaggaagtgtgtcacgaagatggacaagtaaaactcgaatacctctcctggaatttgccgggatggcaaaacgaatcctccgaatgccccgaacgtcgcaccgcacggccggtcatcgcacactggtattccaacgctttgaaaaggacagttggatggatcagccgattttgccgtcttaggagactaacagggccgctttgaacgagcggagaagacaggaagaagaacggaacaatgaaaaatagtaccaacaaagatgcataatgctatccgcgcgtgctgcagctttcggactctcaggctggcacgggaaagacactccttgccggcgttttcgggcacacgatgcgttcaatcctatctgttagtccgcttgaaccaagcggatttgtgtctgtcttgaaagtttaggttttgacccgtattgcgggaaggataccgccagatgtgtccaagatgcagacagtcttgatttggaataagagcgttgtggtcactgccgcccaaaccacctcagttctcttcacctgtgaaaaccgttgttcaggaacggaagacagcgagcgaaattctccgcaagaacatccaaaagcattcagagcctggaattagtcgtcgtcctaagccaagccataaaaactgcagccttttcggcttgtcgggccaggactggaaaaagtgtaacaggtcgcagcaaagcgcgacgagctcgagaatgtttgctccgtgcatgcccttaatctctctggggggctggtcgtgtcgcaaagggtgaatcgtccgaggctaagcaattcccaggcgaagtgtcttccggaactctctcagtgacctgacatttaaaatatcatggtgaagcgctttgtcgttttggtaaacgccccctttgttggtggaggagtctttgtctccggccagctcgcatctgcgggaattgcagtgcgtttctcatggatgtgctggaaccccccccagtaaatttacctcgcggaggccttcgggcgcagtcgagccggcagtttcctcattttgagctccacggttttgtgaatgatggtcaacgttggggactttcccctctaacccgagagtagattttgcagcggccacgctggtttagaggacagacacgtgtgtgcggcatttgagggtgcgtgtgactcgtccgcaggggtatgtacctgcatctggagagatgccacga

SEQ ID NO: 3866 - DNA, 3839 bp, Toxoplasma gondii
tgtactctctggaagcagaccgtacgaaagatccttgccgcagagagggcagagggagagaaggacaggggaaggaagaaggagaagaagagcgcgtaaagttgtgggggggaagaaaaaacatgacgcccggaagagggaagagaggaggaggagaaacgaacgcgccgagagacagaggaaaggcgcttgggaacgggaaagagagaaaggcgctgtcaaaacgacgacacgaccaaaaacgcggcgcgtttgtcgaaacggagagccgattagaaatacggggagtgagggcgaactgccgagacctcggtgtccaaagaaacgaaactgaccttcctggtatggcaggcgaatcagcgccgtggagcctccacgcggtcgcagagcaccatgagaggaactgaggacggacaatcagagacagaacgagaagaaaagagagagcaaggaagacagatcggggtgggagagaagtcaccttcatcgtggggagttcgcattgttgttgacggggaacgcatctcagaaagctcgtgcatcacccgtagtggtatccagcgtatatttgaaaatccagcttttatagacaagctgcaaaaaaatcatgatattcactttggtagtctccttcctagtgttagtctggacggaatccagggaaacgcggagactgggcaacaacagtagaaggacgaaactggaaggccagctctcgagaaccgtatccgacgaagaagagacagctactcgccttccctctgcggtcggctattcttctgtcggattctgactccggcgaagagacaaaggaaaatagagaagggggcagggaagaaaaaacagaagggagacaaagaaggagataaaggaaagaaaggagacaaagaaggagataaaggaaagaaaggagacaaagaaggagataaaggaaataaaggagacaaagaaggagataaaggaaagaaaggcgacagagaagacatagaaagaaagaaggagggagaaaaagagggggagaaagggggaaagacagaagaatataaagatggagcgggaagaacgtcagagagaaagacgagagacagacagagagatgaagaagggagcgagcgtatgtttcaggagactctttgttgctgcgtcgtggtgcctcgcgggaaggccaaaagcaatgtcaagctcccggaaacaacttttttcctttattgcccttccccatcgatgcaccggttatgacttcttccggttgactgaaacaaggtccagggtgtttaaaaagggtctccaaagaggctggaggcaaatgtcaacaaccttgtgtgtcaactgtttctcgtgttctcgcggcccacgcagaccagaacgggagaaaaaccgagtttcatcactcaatgaagagaggtggaaacaaatggaaaaatgggatgctaagaagcggcggctctgccacagtgcacaaagaattttaccataggagccagcggggtcgagactagcggcgtggattcgcatttctgtcggtaaatcgatggttgtttcgacctgcgatacccaagcccttcaaaggagatgcgttaaatgtcaggaaacgaaaagacaaaggggaatttatggtactcgaaagcgatctttttggaagcgacggcaggcgaatcgtcccttgtcttgtcaacgcggcatgtcgtccgtatacaggggggggcgggtccgacgcgcttcttctgggtttggagaaaagttttcagacgtcacaaggcctggatatttctgtggagaacaacttttccagttgtctcgtctttattttacagacaatttttctcaacgctgagtctcttcaccgtgcacattattccgcttcgggtgtgaagtgggcgggaaggatggggcacacaaggtcagaagatacgttttacactgtttgcgcggtaactactgctggaggaactcggcgaaaagtagctgaatatactgctgttgactagttgctagcaccccatgcgcctccttggccttggcagtggaaagcaattcgttagctgtgagcggcttgtgaagcgtcgggtgtagcgctgtgtatagaactgcgccagcgaaccgtctacattggtgttagcagtatttgctggaaacagacgcagcgcgtgaatgctctcttgcttgccattgacggagcaacgtattcggaagtcttcgcacgtagtcagcgtgaggtttaaacgtcatgcaaccaaggaagggggcactcacgtgaagcgggacgcaagaagctgcaactttcgaaggcgtatggtcgctctcaagacagctactaaatggagagaccaagcctcgttcgtacggtgatcgttcacagcttagcactcacctgttcgttcgggcactgctaggacgccatatatacactctaaggaggatcacgtgtcgctctaactcgacgaacacaaagttaggctggaaacgcgagaagcggataatacgccttgttacactagtttatgtaaacggtaactactatggaaaactgactgagaaaggcgttcaatatcaagtgttctagcatgcgaaagcaacggaggaaatctctcaggctaggtgtgtgactcgggctgtccagcattccaatggcgacgtgttggaaggctgttccatggttggttcacgaatcggatgagcatccatatacctagataatgaccactggactttcagcagagctacgccagtgggtttcaggtgtctcaatccccaacatggtgatagtattctattttgtggtacccaaacgcccaaccgcgaagaccttccgcggtttcgagccggcgggtaagctggcccagcctgtgctatcatcgtgcacctgatgcgagcccatggggacgtcgaaacgaatgcaccaccgtccctcagttcagtcgaaatcaagtgcagctctttcaaatctattatatccccggactgaactcctggtcctcccctcactgtttcttcctccgcgagtaccctcggaaactaggactcggtttgcaacgtttcttgtaccaggatcttggtctggttactgaactgacgggcgatggtcgatgctaggaaagcgtacgacgcgctggtgctagtttctgtcccttcttcacttatgcgttttagtacgtgtcgcaaacaagcaatgccttgtgactctcatgcgtgtgcgtgttgatttggtctcccaccttgccccttgttttgcagcgaggatcttgcgaaggcccgtatgggacgaccatcgccacctctacactatcgacgcgtcgctgttttatccggtcgtgtttgtccaccgggttcgcggcggtctcggggcgtccgaagctgagtgttccgcgtccatagcaagcgggagggacgtggtccacccgcctttccacgtggcgtcaccgttgtgtgggaatgccgtacgggtttcccagtgacggcaagcggcaatgaaattaaagataactaagtgtcatgtgctgtggtttcccattattataggctgtcgggatttgcgtacgacggctaccagggcaagtgaccacgagtactgtttgcgtcgccgtgacgacacgacgtactgccaatagtggagcttacgagggctacacgtcgtgacttcgtgtggaagggttgcgtactaagtgtggagcctggtttgtaaaacgcaaactactgtctgggacatcgtgatggttcaaggcatgttctatgcatcaaccgctgaggcagctgcaacatcctagtcctgtgggagagccgccagagagaaaatcatcaaaccggtggaaagcccttgtcgaatgtctcagcttccaaga

SEQ ID NO: 3867 - DNA, 4301 bp, Toxoplasma gondii
aaagctgatgagcgacccgacgttgttcgcgaatgcaacaaactctgagacttccatcgttgggacgtcaaatttcacgaaagtgtcgggaacaacggccatcaactccacacctgccttttcaagaggtgtgtcgggttccaagatacgaatctgaaagcagtaccccaaacacaaaagcagattaacaagtacgcgctgtaataacaggtcacagcagcaattttggtaaggactcgatttgtggcacttccgcagtttttctagtagcagccattaattacacagtgactcgtagtgtgctctgccattgacgccggttcgtactaaccgattctttgaactcaagagggctgaagtggcctgttcgttgagcatacctcgggtttgcacacaaccttaggtcgcagtgaaaataaggcaccgtcgtggaataactgatgcgtcatccacaatgccttttcgtaattggcggtcacgttgtagttcatgtctcaccttcttttgcgaatacacagccaccttcactttcggaggcggttgtagggtcgttgccggaagaagaaccagtgtgccgtccgcggcatccatctgcttcaagaacgtggcccatccgtcgtagtacttttttctgtcggcgacaaaactgctttgcatatctttctgtagaagaaccatccaaaatggacacatacactagcatcctatcctcacgcaccagcgtctgagtagccacccacacatccagtagagtcgtgtccgtgggaaacgctcgcctcggaacatgtttgctgcgcaacaccagccacccgcacgacttgtgaactgctggagaggcccgctctcaacggaatactccaagtgcttctcggaggtacccagactcgacatacctcaaggccgccgcaaatatgttgaacaccatccttcttctggaacttgaacgcgccaacttcctttttcggctcgatatatgccagcacacctggaccggataaaggcgtgttgctccacttcatgtacatggtaccgccattttcagtagcatacacaagatacactcccataccgagtggagctgtcggttctgccggctccgggagaggacccgtacaggcctcaggagggggtgggggggtccccgcagcagaacccgtgaacagcttcggctggcttttgactgcgctctttgggtgaaccttcgctctcttcttagttacaactctagtacggaccgtcgggccgtctgccgccgcctctctcgtcacctctgctcccgctgaagaaggcgccgtttcgccttcttctatctccacaccatcctctacagcttcttcaccaaaggattcttcatcgacttctttgagggcctcttctgttgttgtagagtctgggactagctcctcctcgtcgatgcgcttccctggcggcgcaggtcggcaacaaacgcacaaatagtaacatcccgagtcagaatagccgggtgacgggttgttgccagacatctcgccctgattgattgtttgccgcaaagctgattgaaaaattgggagcaatagagagcaatcacttttcacggaaggggagagggaggagtaaggggctgagcaccactcaacaatcctcaaactacgagagacgaaatcactgcactagccataccacgccgctcgcgggcctgttacggtacgattcaacgatacttcaattttcgatgaaaggcaaataatatggctttgtgcggaaaaaaagacaaccgtacacagaaatgacagttgccctcccaataattcagacgctatcagcgaatgcactggaagagagggtttagggctggcacacgctagcgggtttgtgcaatcgcgtagtggcgatgtgtgcgatgctgtcacgctgatccagttgttgaaaatttgtagggtgcgacgccgcacactgaatcgccggttggcgagcaaagaaatgacaaatgtctttgaatgatggccaccgtgtgtcaatctgctgccatcgtgttacggggctataaacacacttgcctcgtgaggcggccactagccttgccatttttcgccgtgtagattccgagaacctgctggcaaaactgaccgcagctcgcgggacggaaagaaagcaggtctaataatcattgttaatctgcatccggtcacaggtcagatgcctgtatataatgaaaccctttgttgggtgcccatactcatattgcagaggcaagcagtccgtgctcacgaggaaggcagcaggaaagcttttgagcctttaagagtaaccatttgaacaagtcgttgactacagcaacttcacaactgtagactaaaagatggtgacaccatcaatctgggcgtccagcccgctgaaactccatagccacccgaggtgcacaacaacagcggttctcgacggagaaactgtccagaagaggttttcaccatccacatctctggggaacgttcgccgtccaccgtatccagaagtatgattttcgagtggcacttgcgctctgtttccgcaacgaaactacgaccggtgcccgcaatactgcttgtggcgaacaggcagtagcttctgaatcgctgcagtgttggtggatgtggataaagtcgtccattgctgactcttcaggctgtagtaatacggcattcagccactgaattcttctaccttgtgtgttgaaggcgctgtaatctttgaatgccgtcagtagtagctgcaatggcgcgattggggattgttgaaccctggacacccagactgctcgtgtgctgagggaacttcatcgcgagtttccgcatcttccgtgacactgttacgcacacagacagtgtattggtcagtgtctactttttaacaatcacccgtggagatccacgcgtgccaggtcctcctctatcgctagcacagtgcaacaccttgctgtgcttgcttattcaaaccccggtcgagaagaccggctatcgtcacagaaatccgcactgcttccacttgtgagcgaccttctattcggatctgttgtctgagaaaggggacactgttatttgaaggtgggttcaacgctggcaccggtcgagttttaaagggaaaaccacgagtccgtaaacaggggcactgatgtttacggtatctggtgttttcgctagaactgcatttcgcagtattcgcaagaaattcctagcaatcgcgtccaaaggcgtcttccttaagcttctcatatggaggcttccttgcgctgcaaaccactgagcacgaagccctgacgactagcacgaatgtataaccgcctgttctcgttcccagggagagcaagtcgctgcacccgaacgtcattgattcaatgaaagtgtagttttatactgtacggcgtagactaacgcgtttctctatctcatgtttcaacatcgggaccgaatgttcttgctacaaaagagcattccgaatcccgtgttgagttttcctgtgaaccaactggggagttctttacgttgcaagcagagacaaagaaatattgcttccaccccagctgacatcatgggtggcagtcgtgtgagaaacccagtcggtgacgtctggccaactgagttcttttacgcaatgaagtaacaaacgtatatgtgacaaccgcaagaacccttgaactcagtgcagtagccttttgtgcccacctagtggcgtttccaccctggggaactagtttctctatgccctacagtttacaggactcgttgccacgagaggctacgtaaacccgcattggcactaaactttgagttaagctggttctatcacgttgacaccgctcgttgcatagtgtgcacgcggtaatggggctggcccacaggtgtaggatgttcattgtcgcgtctgtcgtcctggcggacgatagcaattagatcacaggcggaacctacgctcgacaaaggacgggcacagggcacacctgttgtgtggtgtacatacaacctccagaaaaccatcagcgtgaacccttgctgatgaagctgtgtgcacatttccacgctctccggtgacgcctgcctcatttttgccctctctgtgtgtttcattccccccgttttcactcgccccatacgctgttctgcttctggatgaaagcccaccgcacggtgtctgccaaagtgcgcgcatgacacccagtgcacccgggaaatctgtgcgagcagatccgtggcacccaggtcccctcaatttttcctttcctacaaacttttgacattcgcatttgcgacactgttttcgcgttcttttttcccctatccccaaaa

SEQ ID NO: 3868 - DNA, 2270 bp, Toxoplasma gondii
cacccgacaaccgaatgaagtaaaagaaagagagggatatattcctgtatacatatatttatatatatgtatatataaatatgcgtatatatatatatatatatatatacatgcatatatgtatatatttatgtaaatcggtatcgaaacgattgtatctggatttccggatacattgtggttgaatgtctttacggcgaaaaacctgtttttttctgtcaatggtggccacttggaacaggtgtacccgttgaaccccatcgtgccgtggttcctccaaagtttcttagcgggcggacgaaagagagaggcaggaacgaaaacgaacaacttaccaacggagaattcttgttcttccccccttgtcaaggaaggaccctggacactgcaagcggtgtagagttcgctcttcaaaagagaaagagccgctgcacacgcaaccagaaggactctcaccgatctacctaaaggtagatacatgcacatacaagtatatatatgtatatatgtatgtatatatatatatatatatgtacaaataaatctatatatatatatatataagtatttatatatgtaggtgggtagatacctggtttgtctgcgaagaaggactgaaaatgaagaagagggatagagtgtgagtgctcttatcgactgctacggaacagcaggtgtgactaacaggaaaacgttgaagctctcgagagcaatcgaccttaggtgcctcagttctgttgacggactaggcatgctgcacatactatgcagagagttttacgtactcatatgtctgagaccttgacttgtagacacgcatacgcttgcatacgggagactgcgattttctcgtttccaatatatcttagacaggtctcgggagcgcggcaccaccaggatattttctgctgtgaaagatttttgcccacacatgcgtgtcaagtgcacgactgtttccagactttcaccgattgttcaaaatcgctgccgctacacaggcgtcgtctttttcaccgactgaggctggctctgccctttcacaagatctaaccttctgtttttccttttacagctttgtctgtttatcaggcgacaccgttggtgactttctctcccgttttccccgtgcttgtcagctccggcagtgttttctttgaggcggtgctcgttcaacgtcgcgtgtctcgcgcgcagtgtggcctcgagctttctgcgttgctgcggttctcagaatggaggtgagagacaactcgcccgcgacctccagagagaaaaaagtaccagaaaaaacaaaaagaccggggggaagccttcggatgtgaacagcacaaaagcgagtgcacgtgagcgacacccgttacgcagaagaagtccgtacgcgaaaacgaggcgagagagggaggacacggcgcgcgcgtttgtgtttcactctcgatttttcttgcatgcaacaagaaaggccgctgcgctttctgccgtcgtttgacgggcgacgaacatgagcgaaacgaatccgagtttctgggtctctctcactttaccttgttgtccgcatctcagttttcccccttcttcgccttctcgcctgtccgcctgtccgccccgctccagtagtgtcgcttgcccggagaatccgctgcgttttctgacactggttccagtcctcttctcgcgttctttgttccactctttagattctccgtcttttcagtttctgcgcgtctcccttgctgtctttttcactttttcaatcgtcgacttcctctgccctcctcgctggacaccgaactctgggcgtcgtcgcgctggcgcctctccgtctccgtcgtgtcgggagaggcgtctctctgcccaccttttccgcgctcttctgtcttctttcttcgtctctcctttttcctttcttcccctcttttccagccgactcctctcccgcctctctgcggcttttttctcgaaacaccgctcggccctgtggcatggtgcggcgcgctcgctgcctcctgggggataacagagagaggacagctgcgctccccgcagttctcgtctctcgtcaccggaacaaagagccttgctctttctctgctgctcggaaaaaccacggggagcgcatggccctcttctctggtggagctcccgagagaacccgaccagcttctcaacacgatccctcgcgctctgccttggagtcgaggtgacggctgtgtcgtcgtcgtctgtttgactgtgcaggaggaccctttgtttttccgcaaaagtcgacacca

SEQ ID NO: 3869 - DNA, 2598 bp, Toxoplasma gondii
tgtacgtaccggcgcaagaaagcattttattgatgcggagaacgtggaaggggtggacgcgaatgcggaggtggaagttgtctttaccgcagttcttgatcatgtactgcagaaaggagagacaggaatacatttatgaggtcacggatctcagctgctccgcatacgaagaaggtccctcccgcgagtctgaggcaacagacaggcgcccctgaatacagaacatcgtgcgtgtgtcgatctggtcgcagctgtttatcacccaagaaaaaagaggtgagggtgcgacgaagacaagacaagacggtggagaggcctcactacacctttggagaaagcggggatccagagtcacgttgacgcagagagaagaaaggaaacgtcacttcgaggaacaccacaacaagtcaggaacgaggttcagccgagcggaagcagcggagaagagagaaggcctcgctgaaacaaagaggggcgtccatgaccgagaactgtgcacctcgaactgaagagagacagagaagctacagttctctggccagtgaagcggactcgagtttttttgttccgagtcacagagacgagcgtcaacgcgcggagccagctggcgctttcttggcgatggagccggcctccagcgaccacgcagaagggagcccccacacgcacgagctgcatgcagagaagttgggagagatgggagagtccgcagcgaggatgaaaaagagacaagaagagaaaaacgtttaccttgttcgcgcaaacgcgggccgcctcgagcgcctcagaagaaatctgttcgtactcgtcggagacgaggtgggcgacccccgggaactcgtcgacgtctgccctcttgcgacctgcatcgtagattcggattttcgcgtcggggactccgcgacagaaacgagatttagggtacggcttgttcttgcagtaccggtagcatcgcgcaggacggcgccccattttcgctcggcgaaattcgcaaaaaacggaggacagagactggaaaaaacgcgaacctctcgggtggtgtaggtacacaaggagagacagtgcgcccgagcaggactgtacacgcgacaagagaaacgaaagagaggttgtgtgtctcagcaacggggaaggaaaagcgatttgcggggccgccgacgcggaaacgaacgcaaattcctcggatgatccggttccccgtttctccgcaaaatcccagcatgcacccgcgctgcccccacacaaaactcgaattccaggcgcctcgccgatcggcgtatagacggagaccttcgagcgaaacgcgcgctccccccaagtcaagacagaaggaaccgcgtcaacgtgccttcgatacgttttcgtcaacgaagaagcgcatgcgagacaagcgctcttcgaagagcggcagactgacgaaggcgcttttatggatgtgcagctgacgaggccgccttctaccgacgcgccgcgtcacttctggacgatgcaggcattcgcgtactttacagatgttgctttctgctagagtattcaaagggtgaagaaggtagaaaatagagtaaggaaagtgaatcaatagagtcacaagcggcgaaacgcgctgcggaccgtagctagaggcgacgttcacctctccgacggagactagcgaataaagaagctatttgcaggggagaaaatgaaggcccttcaccgcggctcatggcgtagaagaagaaagagcgacgaaagtgtcttccttggggatgtctccagcgagacaaaagcactggggcagacgagacgacacagatactcttggacatccatctttcatcgagaaaattcgtgctctcagagccaggtgtatgtacacctgaagaggaggaagtgcagatcggacaagcagttttgctttcaagtgtgtgtgggtgtttttcgtttcctcgctgtccactgggaggaaggcattaagcactctgggaggcggcttttctcgagctgaaatagtcggagatggcgttcgcttttcatctgtcctccattccttgcctcttgcttctttccttttattcgaccttctcattctcggcggtctttgcctttctccttgctctctcggcgtcctcttccgcttccgaaaaatactggacgttctcggttaccgccggtgctctgtgtcttcgtccactggttgtcgagtctgtcctccttcggtcacctttctgtctgtttttctcctcaacggatcgaaaccggtcttgcctttctccgacgtcggcctttcgtttctcctgatcttctcgctcacctccattctcgatgcgcatgtttctccactgtgtcctccccaacgtccttcgccccggaggagttctccctcctcgcttgctgccctcttcctgccagtcctcctcgtccgcgttgcttcttcgcttcttcttctcgcttctgttctcttcgtccgccaggtgctccgcgtccgcgttgcttcttcgcttcttcttctcgcttctgttctcttcgtccgccgggtgctctgcgcccagttacttggcgcgagaagctgggctgcgaggagcacacaggggaagacagagagacaagaaagggaga

SEQ ID NO: 3870 - DNA, 2931 bp, Toxoplasma gondii
ttatgtatggagtgtcacctacaggtatgtggatatatgtgcgttgctctgtcgaccatctctgtctctttctaagtgtatgtttgtgacgttggagaaccggattctgctcgctgtgcaagagactcactagtcccgtggtctgcctgccgccattgtgcagttgctggggtactttcagaatcgatctttcggcagaaggcgagcagacgaggactggaagccgaggagaaccaggccagagttgccttcgtctgcggagagggaagaccgcgaaaggcggaaggactcgacggggaggagccaaagtggcgaagggggcaagaagacgcgatgcgagagaagaaagtcagaggccagctgtgtacagagggatccgagcgcagagctgcaccctgtccagcggccagtttccgcgcgtcggcctcaggcttgcgcgcgcaagccaccaaaggcgcatgcacctcttgcactctctccgagaagcgacgcgcgcccaaccgcgaaagtcgactggagacgaagctgttgatccggagtgtctagacagaagccgagagcgcgatgcggcgaggggatgaggtcccaacgcgcaggttgaggcgcttcgaattacacagctgcgcgttcaagattcgatgcacacctgcctgcgttctctgcctccgtaaacggttcacagaagatgggagaggagacgaagacgcctactgttcgaggtgacgccgtggaaacgagcactcacgcttcgcgacggttgcagagagccagttgggcggccgcggggagcgggggaagaagggcattcagacaggcgttttttacaattgcacaagacgaggcgagcgcgcgcggaaaggcgcggccgtggagacggcgagcgcgcgagaaggagagcaccagaggaaacggaactcagatacacggaccaactccggcgttttcgagagcgaagagaactgtggcgtttttgcaggtcgcgacgaacaaaggctgaaccagtagagagaacagatgtccgacggagaaggaccggctgagactcacggaagctcgacagcgagaagactggcgtcttcatgtccagcgcagcctcgaatggggtatgaggaagagcgaagatccggttgtccaccgacagaagcttccgagcttcttcaacgcgtttctcataattgctcgcacaaacttctatccgcacagacttacagtctttgcaaagccttgtttgtcgagacttgcttacagaagccggacaggggaagcgagctgttcagatggacatgcagctcggctctcgcgatttctggcgggtgagtgttttcggggagacaggccgaggaaactggagattcatgtcgaagatagatgcgatttgagtttcaagacgtcttcttctcccttctaccgcaagcttctcttgtcttctgcagcctgcgtttcccgactgtcgagcgcctcgcagtcggcactgcacacttccagagaactttccaagaagcttttgaccgggaattctccacgagttgcaggcaaaaaaccaaacgccaacgcgcctctgagaacaaacgcctcgcagccgagcgtcggcttatccaccgtgcaaaatccgaatgcctctctcgcctgcggcaggcgagaagtgaagatgtgacggacggcggcggctctttctccactcactgctctctctgctttccacggatccgagcacacagcagtcgtcggcctcaaaacctttgccccttgcagacaaagagatgtacacctacgcatgcacagatatacttatttgtccgcgagaaaacgtggatgtgcagatggacatcaggcaggcaccgggggggggctctagacgcagctaaaaaaggggagagtttcgcacctgccttcgagcagccgttggaactggagagtttgcagtgtgtacagacgaggatttccggcttttccgcgcgcggagaagagtttgcagaactcggaggagagaagctgttcgacgaggcgcgactttctccagaaaaaggcggcgcgttccaaacgcctgaggaggagcgccgccgcggtcgagaggacggttgcgcgcattcgagagagaaaagaagacctgcaaaagtcgtcgcacacagaacgccgtctcttccgatggacaccatacacactgcgtgctgtcccgcgaaattctgtcgtcctttgcgagaacaccgtgactcctctgaggccagtctgaatctctgtctgctctgcggccgttgagagacccctcaactggtgtggttgtcttgctgcacccttcctgtttcttcgtttttctccacgacctctgtcccgaccttctgcctgtctcagactcgctgtttccacatctctgcgcgcattttctggagaaaaagggctcagcaaagaactccatcgccgcctgtctcgcgaacgcagcaggagagagtcctcgttctcctccgtttcctgctcgcggctatcccgacctacggcctctcttctcgtctctgtcttctcgcgtggttcgctgcctcgctctctttgtcgacacacttgtggaaaaccgcgaggatcttctgctcaaacgtcttccagctcgctctccacgcgtcttgtctggacatggagctcttctgaagacggacagctacctccgttcgccagccaaacttccaaattttctcttctgaagcgaagctctctcgggtgcgcctctctcgctcggtgtcgcgacagctgagctctggagggagtcgagagacgtcgtcttcgagctcttctgctccggtctcaaacgttttctctcctcgacagtccaccgagacaggtcgtcttcggcgacggagaaactccgacggcgacggatcctctgtttctcgtgtgaactcgaagaaaacgacttgaaaacgctttcaccctccctcgccacca

SEQ ID NO: 3871 - DNA, 2398 bp, Toxoplasma gondii
tgaaatacctgtcgcctattcactattcgtatgtggctctagctctcaatcaattcccgcctgacgagaaatggggtgattcgtccaacaaggactttctcgagtcctacggaggcatcactaagacagatcttgggttctacattggcatgcttgctctgctcggctgcgtttgccgcgtcctgtctttcttctgtctgaagtacatgcacaggcgcatcggccttgaagcgtgacggaagggttcagcaacgcagccgatacacagggaagcctggtagacaaagaaggaatgaaatagacacattgcggtggcgcgaacagccacaagctacacattttggaacaatcaggggtaaaacgacctagtacatccttgtggaacataaatgtcatagtccaccaaggggcaaggataccgaaacatattcgagagttcgtggccccggcgagtagtcgcactgctactacatttctcggccatcactgtaggttcagaagtctcttggcatgctggttcgaaacgggaataaacctaacaatgacacggcacgaggcagacaccaaaacggatttagaagaggggaacgagagcagggacggatatgcacgagaggtcgtaccggatgtcagtggggtaaagaccgaacacgattttacacgcaagggacacgcagttgagaaagccgaaaaaaacgatggacgcgtgagacgtgtatgcatcttccacgggtggtggacacgaagtgggagagaaaaacgcaaagacgaaaaaacaattgtgggagatgagtgatagcggcacgccaaggctaagtcgttgcgcggaaacgaagagttccctttgtcaagcttggcacgcacgttagctcgtgattccaggactggatcagcggtcactcgtgcgccgttacaccaacccaaatttcaagcggagcgagttctgcttctacgggatcccatcatcgcgggcgtctgccgcccgtctttttcaagccgacgaacgtctgtgtgtatataaaactataacagtgtctgtgtgtagtttattgcgcacatttctgttcacatttgcagcaacgttccacgagcacatgcattcgcgtctatttcgactagtgtggtttttgacatccacctcgtagctattctatgcttgtaataaagtgttgctatgcccatttctagcgcaggtgaggcgttcgagaaacgaaggttattgcgaggcgttttctatttagaatgttgtatggacacgtggccgcgcgggatggaacccgatctcgtccctgttgtgcgtcggaaacagccgtcgaaaggcccgaaaaaacgatttggtaccgagcaggaaaccgcgtaacgggagttttgatagctcattgtgatgaaaggcagccaaaaagcatccggcttttccgcagccgaaatggggtacctccgaacgtgtcaagacacggcaagaattcaccgtgagctctagcgttaaaagtgttgttgaagcgggattctactgtggcgaacacttgttcagcatcgatggaatgctgaacgtaacaactttcggtagcgaatcgtgtgtagcgatgaagccgccgtggtgaatttacccgtttggtacttcctttgatgtgctgacaccggtcagccagctagtgggtgaagccttgaggcaacctagcgtgattcagcacccaacactaaggcaccagtctatgttgaaactgtatagcttcaagacgcagtgtattcgcatggagagtgaggcggggcttgcacgtctcggccccctatcgagtctatgtctctcagtagtcatctttgacacggatgcaaacaaagcattcgagaatcgttgagagaagcttgaaccataaggccttttatagctaccttatgtgtcgtaccccccacggccctgggttaggcacaccgtcttgtgttggttgggtgtgtggatgtagcgtgggcttgctgctccgaggacaaacaagaatgagggaggtcaacgctacgcacgttaaatctcggcgtcgcatcacctagccagccgaaagacgtgagccgaccgcgctgactcccgtcgtcgctgagctcggatggccgggaacaggcacaaagggattcgtttgtgaatcgtccagcggtcacggaatttcgcagttcagaatcggggatccacggttttgtgcacgtcctttccttgatttgtaagatgttggcagtagttgattttggtcatttatcgcgcgcaagtgagaggtaatttgttttggttaaccaatggcgacaagtatgccgttcttgtagtgacccatcttcgcacttgtcaatgcagaacaacgagtcaaacatggtcgggtcttgcttttttcgtgcaccggtcaattagtcccgaaca

SEQ ID NO: 3872 - DNA, 4920 bp, Toxoplasma gondii
aggttgtattggcaacaagaagacgacgccgagcacacaagaggggggggagaccgacaaaagaggaaagcgcaaaaaaaaatatgggagagaagctgcatgcagggtcacgaccggaagaggcaacagctcgtgtctcaacactttgtctgcagcagcaactcttttctcctgctttctccagcggctacactaagcgcctgtgctgaaggaacaactgacactgggtctcaacgcctcgcgtctttcaactgaactgaggggtcctgctcagaaagcgaggcgggaccagacggtgggtggaagaactcgatcacggacggagaggacacagtgtagagaaacataggtcacaacagtggccggacgcgaaaaaggcactttcgccggacgggtggcgaggctgatctgtttgctgtggcgctctttgtgggcggtgttcagtgcacactcccgacggtttgaggtctcggttcgcatgcacagaagcggtcagcttacctgttgcgcgtttcactagagtgtctgcgtgcgatccctgacttccgtcctcggcccgctctcctcttccccattccacgcctctcgtagaaatggtgattcattgaacggttgggctgttcctcgcggttctcgccttcgatcgctccttggacagcaaactgcggcatatcgtgtccatgttctccaccgtaccccacgtttaagttgaccaaggtgttttgctgctgctcatcttgttcctgctctcccgtgagcatgaaagagtcgtttacccctccagtcagaagcgggtactggtcggaatctccttccccaacgccacggtccaggaagttagcgtgggcttcccttggcggggtggatgccgcagtaacaaaggtgccttcgcgctgcacgacgacacctggaaccagggaagcggaaaggaaaggcgcgagcaacagagcgttccggagaaccctctttgaggacatcccctccgcaaggcacatgcccttgaacgccatttttgcagcttaaccgaagcagaaactcgtggaagagaagctgatgcgacgcgtgattcctgggaaaacgcggcgcagtcgcagccccagaaaagccggatcgacgacagcgcagtggcacaaatcgaggagtggacacaccaagcgcagagcgttggcgtacgagcgggttgtcaaaacgcgggggagaaaacgagggaaagacgcggaagcgtgctgggggagaaacgcgttggcagattgttgtgcaaggggatgccttcgaaggacggtcggtcaagagaggacgcaccgcaggctcaaacgatcgtcgctccttcgccacagttcgagtgtccacgagccgcagttcccaagaacggggagaagtgagcaaagtaaatgtaaaaggcagttcagaagaaggaaaagcttcgcaactttccacgttgagcaaaaccgctgctgcaatgaaatactgcccacaatcggcgacagcggtgcacgacggcgcggccagggatcggaggagagaaagacagtacccacaagcagaggaaaaaatcggaaattattccacgcggaaacacgcaggatcgttagtgaaagagcggatctcgcttttctattccgagggaaaggtcgaacaagttgcacggacagtcgagcgccgcataagttgcaatttcgtgggccagggaaaaggggtaatgcgtcagggccccggtcaatattgagagactgcgcaggaagatttcgatgaccgaagcaacgttcgcggctacaacaacccccggcgcacgacaaggaagctaccgcagcgtccaagcagacgtcgagacagcttcagacttcctccttctgacttcctttctcactccttctcctcactgaaaacctcttccgcttcgttacgcttttctccacaagggggcagcagtcgtttcccccgtgcgtggtggacattttttctgcagcagcactcgaaagacttgtacttcacagccaactgtgtctccagggcttcgtatcatccttgagcaagttggaagttgtgctgaatgtagtctgcttagttcgctttacagccagttattgcctatcacattgcatgtgctgcggatgggcctgcacaaggcaactgccggttttggttcgtcgccgagaacgtcttgttgcagggtccaactccaaaagagttggctccatagttgacttggggagcagaataccgaaatttgtaatatcgtcggaaagaaaaaagctgaaggcgcagagagtttgactagccgtcgaaaacgacagttccttttggggcggaggcgtcgcgggacggtcccagtgtgggagctacaacctcccttacgtcgagacagtcaagaatggatttacgtggcagaaacgaagttaccggtggaaccaaacgattcacaagatgtggctatagcaccagcgacactcggcaagtcttgtcgggatccagaataccgcagtatcggctcaaacgtccatgaaccaacctttaacgcttctgaaaagcacatagaaggaattcgctcagttgtccgaatcctggtcaagacacaagatgtagtttcgttttttcggattgagggccaacaggaatagcgtagacgccgctatagacggtgcgctgtagcggctgtatgtgtagacgaagcgcgcctgcagcgttttccagaggtacttgtatagattagttcgcattccccatgttgctttaagagaaaagaggttttcctactggtatgtttctaggccagcagcaaatcatctgttcctcccttttcgacagaagggagacacttctgtgttcctcatgtggctactgaacatttagtcctctaacctgctaaaagtgcaacgctctatggggtgacatgttctcgcagcaattcgtttgcataaaggcaaacttttgcgcggaacatggataacctggacttttgtagcgaatgccgtgcatggcaaccgggtgtcgtaaacgtggtgacacgtctaggaccacacgcgtatagatcagtgtaaggtgtattcctgcagtcaaggcactgtcgattacgagacggtgcttcacagccaagcgccttcgctgtgacgcaccctgacacctagggaaaaaagagccagaggacgtatgatccacgcacagatcatactgctctctgcgcagttgaactgttgacgcattctgcatggcatggtggacagaagcaaaaagtttggattaccgttctagttgctttcaagatttgttacatcgcagttcggcgtttacttcatctctcgtattgtcattgttgacatccccaaaagtgtgaacccttgaccttgaataaactttccagacggtgtgcagttcctccctggttattatacgtttctttccttgcagagtttgtttcttcgtctgaaatgtgaatgagaccctcaaaaaacaataagaatgggttcgggtgtgtgctggactccgctggttgccgcatgactacgtcctaggggaagaatgcgatctgcgaccgtcctcgagccgtcactctaagatgttccgatgtgtcacagtggtgtttataaaacagtgcttctcccagttggcgactgaaatagacccacaaccacacgacggagtgcgaacaaatcaaactccgtctgtgcactgaccacagcttgcctcttctgtgaaccatggcgatgcttgaaaacagaaggactcagggatactttttcgtgatctacgcaagtatcaccttttttcagtgtgacctttctgcctcggagatgggcgcttcaccacagcgctatgccagaaaggccaatgagttgtattgtgctacctatgctcccagcatcgaatagcaaagcgcattctttagggcactgaagagctgctgagtgcaatgcgttcagcaccggggtacctgtgagctgatggttgagccaattagttgacgttcagcagacagctgtttctttgagtaaggtgcatcaatcagcgtcttcaggtgggcaatgaaacagccagtcagtagaatcgtgacgctcaaaaaggtgcataggtgaccccactcgagcaaggccccagtagacctttggtggtgccgagccggggaagcgaagagcacgaaaaaaaattcacagcgcaagcgcgacatgtgcccttgccacacatgcttgagtgccggagaaaaattttgtttaaggcaaccactacgtaaattgcttctccacaagtgtgtcgtaagaagagagggagagggcgccgacgccggtcagcatcaccttcggcttctctggtgctccgggtcaaaaagacgggaaccatcttactgctgttgaatcgtttcatctgcaggctactcatgactgtccaaaggtttctctgcacaccagccaagtttcgttccacctgcgcccaggcacatactctgttggttcgccccgtgccaactggtggtctcacaagagtgagaggtgcaacagacttcctttcgtcttcacaggatgtttttgcgcaaccttctgcaacggcaggccagaagagacaccaaccatatattttgcttcgtttctccagtacgtgttgacccctgccgatatcttgccttgggactggaccgtgaagggtgacaatgccttgacacatatattgatacaatgctgtaacactgaggaaggctcgacagattctacgttgtatcttggagaggatcgaatctttgggctaactgttccggtcgccgtttaatcgggattcatagcacttctggcaagttgttgagctccgtgtgactgttttcacaaccccgaaatcgtgaacctttgaatatctgtcaagcgaggtaatagtcctgccgggtgttttcgcccgttgttcccaaatcaattcgatttcccatccgagagcggaaga

SEQ ID NO: 3873 - DNA, 1825 bp, Toxoplasma gondii
aaatgagagaaaggccatcgtctttttcgtctctctcgttttccgggattttttcgagcaccccgttcgcttttttttttcgaggccggtcgcatttcgttgttctcgagactgcgaagtctcgcacagtcatggaccacgaaagccgagatgctccctcttggtgagcttatggtcaaaatcttcaatccgcttgggtctgctttcgcttctctggaacagcgtgaggacgacacccccccccctccgcgctccctccttccctcgctttcgcgcctcagtccttccagcctgctgttcggtccgcgcctggctttctcggagacttcggcctctcgcctcacgacgaagatcggcgcgttcgtttgctgctgcctctggttctctggtttttcgcgttctccgcgcgctgcggcctcctcctcttctcgttttttcctctgacctttctcctcgcgtagctcacctgtcgtccccaaaccggatgcggcctcgcactccgcagcctctgccagacccggttctcgaagatgccctccgtcagcagcggcacaactgcggagacgccgtcgacggccgcgcggtcgatgcccagccgcgtctggacgaagccggagagagacgcgcccccctcgtccccgccgccggcagcggcaccagagccccccgaagaaaacgcgcctcctcccagcatggtgcagaacggaagctgcccgagggaagaaagaagaagagaaaagagaacagggagactacgcgggagaaggagcgggagaagaaggagcgcggaggaattggttttgacgtggaacgatgtggaagacgagcgggcagaccgggggcaggcaaggaagaagcagaggagaagaggcctgagaacgagaagaggaagacgagaaaagagaggagaaggagagaagacaagagaagccaggaaagggaggagagacagaaaggagagaaaagggatggacggagaggaagaaagaaaaggtggaacagcttagtcctcctccattgttccaggttctggggaagtaggagacgcctccccaggaggaaggcggcgcttcaagcctttctctagagagaaggaatcaaatggctgcagaaaacacagacgcactggcggacgcgtcgagtgaatgaacaagatgccgagaaagcgcaaggagaagatgcatgcatgcgcgatcggtgttcgacattgcatgtccggtcgctcaactctcgacgagtgaaaaaaagaaaacggtttccatgtcgcttcttcgccgcgctggtcttgctggtggggtcgtctggacatttcaacgacattcctcggaccctctctgttgtgggagagacaacggttgaggtgtacgtacaccgggcttctcccggggaggaacgacgctcgctgctcatgttcctggatgatttctacggacgttgaagttctgcctctgcttctttttatccttttcgtcgctccttcgtcctcgcgactctcgcgttcctctcttggcagtcgctcttccgcggacgcatgcctctcatccaatttcttctttctctctttcctccttctctgttcatcctcttgtcctcttgtcctcttgcactccgacgacttggggaaggtcgcgttctgttcaagctccgaccttagctcttctcctcactgccttttcacacggacctctctccctcgcctgattctccctcttcgctgtctctttctctttctctttcttcttcttcgtctcctttccttcaccctgtttccctttttttcgcactctttgtcaacttcttcgtctctgtcttcagtgctccgcaa

SEQ ID NO: 3874 - DNA, 1948 bp, Toxoplasma gondii
caggcacagaatacacctggaaaggtgacttactcttccaggatttcaggcgcggttcgagggcgcatgtcctcacattcggggaaataccgttttctgtgacgacctgtcgcatcccgatacaagatctctagattccttgtcattctggcgacggcgctctgctgtcagcagtctcggcaacgctctttctttctctctcacgaatattccttcttctatttgtctctcgatgtcacgagcaaacgcgtttgtgtcgagcagagaccgcgagtgcttttgtctcatggaagaagaagaacgtaacgggcagcgtgcaaacgtcgctaccaagaaggcaaacaccgaaagttcaactttacgttactttgtccacatctcgctcgcctctttgtcttccgacagcgtattcggccgtttcttcttatttcactcagaatgtaaacggagctgagaacttttgtctggcaccaaattcaccgcttctgaatttcgaataaacctgccgctgtgcctcgcagcagactaacggcaagatgcgctagaagaggtgacgagaacgtgtgtgataaacgcacaaggacgatcttggaaggacttcagccaggctaatcgcgtctctctctcggagcgagtctgtctctaaagtcccgttctgccgccaagtgtttctaacaaaaatgctgaaggctagcgaatgcgcgagagctggattccctaacgaagacaacagcacgattgagtttgccgttttaaacgctgaaggtctttgttcacccgattcacattcgaatgttttcccgggtatggttgagacggtgatgactggggaaatagggtaaaattattttgaacgccgtgtatcaagattaacgaaggcagaacgtcctctgtggagtgtcggagaagcacactcaaacgccaggaagcaacggggggcttcactcacagcaaacacaagcatgcaaatcttgttgcgtttcagtctcccctgcgagcactcacgtttatgataagttatgtccatctgtgcatctcacttgataatagaacgtataagtcaggcgttaacttctggggtaaaagtcttactccttgaataacagccttctccaagctcgtacgacctcaaagtactagaagccacgcgcaagcatttgtaaaagcatctgtctactatatgaagttcctgttgcggagagaaacctgtatggccaggtcgtttctataaaacgagagaggaacgcgcaacagagcgtgcactttccgaagtagggatcgccagcgaatccgagacgtctgcgaattcctcggtcatccatgtgcatcttttactctgggccatttcccttctctgtttcttccgtgtctccacttgataatatgctttgacgcgccccgctcgctgcgcatgcagtgtggcgtttttttcgcacccgcgtggatttctccgtggcacacaccatctgcgttttctatgctcgttcgacagctctcgactgcgtgagccattctcgcacttttctcctcaattttaaagcttcctaaccagcggaacaaccctcgcgacgtttgtgtgcgccaaaagtgacgcggcgcctcggcttcccatccctccgtcccgcgtgttttctccagcgtgcgccggtgaaaagtccaccgcctttcgtcgccagctttctctccttttccctctccccatcttcagtggagtcgaactttcctcttctttgtaaatgtctcggttgcacgtccccgtttccggtggacgttaaaccctgtctggggacctcggtttttctgcggcagtacgctccgtgaacgtccgtgtcttttttgctgtcgcccttcgcgccgcctccgtcacgctgcttttcgtttctgctgtctccgtgcttctcgttcgcgtcttgttgtgtctcccgtcgtctccgcttcttctccacga

SEQ ID NO: 3875 - DNA, 1170 bp, Toxoplasma gondii
agtgaagaggcagacacacggaaaagaagtggacccgattcacaaacagtggcgctgttgtgaacgatgcactcgagagactttgttgtttgcacgtccagaactggtggggctgggcgtgttttgtcggtgtttgtgtacgttcaagatcgagtgtcgcttgaaagaaaagagaaactggaagaagatgcgttttttgtggagaaacacgcacttttttggcaaataaaacgtttccttagaagccgaggtgaaacagagcagagatcgctgcgccgtcagaaggcacctgacctacgaggcggtcttccagggtcctttgatgggcgccgcactaattgctcttctattcctcttttttaccgttgctcccttcgccaagtgtgactccagcactctgtcgtgtcgcgtgcctacgccggcaggtattttcccttcctttgcttttaactctggtcttacactccagctgttttaggaaacccaaactgtgaacgacgcgaatttttgtccttgactttgcgggaactggcgacacctcagacgtccagttcttcgtttgcctgttgttggaacgcttctgtactttgccttccccttccttgatgtggaagctctaaaagatctgcgtgtcgctacagtcctccgttcatctgacctcccaagtttctgtcttgtgaccgagaaacagccagatcgaacgacgcgccttaccgaatgcactgtcctccttatagagaataaagtgcaataggccattagcaatccactgccaccaacataacaaggttgacctgaatatcgtacacctcgaccaagtccatcctccccatcgacggagagcgaaagagcgagtcctccgtatacagactggcatcgggaaggaaaaaagtgcgaaagggaacacggtatctgtgcagcttgtgtacagaggtgggcatggtttcagttatctggttggtggtggtacgcccacgtggtgtctcgcaacataatactggtgagggggccgcgattccctaggtgtccagtcgagtgctttgccttgggcattgaaactggctcacagctccggtcacgagcacctgcacgagatgtttgtgaacggaaactaattccgagagggttccccactttgtcttttgtctgcgacttgggttagggggcaac

SEQ ID NO: 3876 - DNA, 2645 bp, Toxoplasma gondii
tcgtttacatccacctcacgtgtctcgtgtgatatttgaagaagcactttaagctgctcttcacacactatctacgaaagaaaactgtacgtttgtcattcattcattattataggacagatcactgggtagcttatcatctccatctccccctggtcttttccactgtagcatcgtagtctcaagagacactccctctcaacacagcctttttatcacacatcgcgtttcaaagacggctgacttaacaggaaacaaatgcgaatgctcctcaccttcgagtgtcttatcagcgaacggtgtgccttgaatgaagcctgaagaaaggcgtgaaaatgcgagataaaggtatacggaacgcgtcaacatgaatcgtttttatcaattcacaacgcaatgaggattataccgcctcagcttaccagcctccgtagcagcatcagctggcagcacccctactcccacccccgtttctgctctgacagtcttctgtcccgtgctgcagaaatatcacacgcatattatttcgtcattcaaacgtgcaaaacgcttcacagctgttatgtggtggttcgcactacccatgatagctggccaccggcagttgacgttagtcactacctcactccgcaaaccaggttcaaatttcacatcgtaccattcaacttgttgacgtaggcagcgtggtgttttccatggtgaaagcgaagagtctctgcactgatgtgtggcgccagggcgtcttcggcgtacgggaggggaggcagtgtgaaagcacaggcgtttgtggagaaacagtgggcatctcgctgtaggtaaggagaccgcacgtgggcaattctgccttgcacagttttgttgcacgaagaaagcgacgcggatggaggacacaaatgcagaaagcgagacgtcacttggcgtgggccgtgagacgtggtgagagcagccgtctccagtgcgaggccaatcggcgccgcgactagggcagccgaaaggcggagtgctggcactaggacagctgtgatggacattgtgactcagagcgaagcaggaaacgcgaagatgagaacaaagtcttccaccttgaagtccctacggaggtgaaacgattctgtgtcgagtaaactgctcgagaggaatctgttaccacagcagcgaagtaggtgacgcaaatgtgatagtcgtccgcatgtgtcggcttcatgctgtgcgtgcaaagtcgatagtccgctcaggtggtgttgagcccggtcccaaaatccagccggtaacctatttggtgctcttatggggtgaaaatgagtgtatgacagacagctgtgcttgagatttatcatggataagccgttatcagtgaggcagatcgtccctcatttgaagattcctacagcgaagtatccgcttatcgggccggtcccactgatgagctgtgtcgttttcgagagttgctgccagtcataacgcctgcatgcagcgctattcctagaaaagagacgcgaaaaaaagagtctccctgaatcgtgctacgtagactacggaccatcgccaaagcgttatacacaagccctgcaaaacgaacggtaacgtacacgtacaggcaacctggcgctgatgagccgtcaacaccgacgttttccacaagttgctattgggtgccgctagctgctgttgtttgatagcctcaacaaagctgccgccatccgcgcgagaaatcagtaccgtcgcgggcaagctgctcgttcacggtgtcggtccgattttgttaccgaccgtccggtaaggcaggacacaccgtggcggaagtcttgaaatgcggtgttgcccgttttgaagaaccggccccgagcaagtccaatgaggctctctccattccttgggaagaatcgaggtccgggtgctagcaagcgcaacgctcgacacacaataactcattgcacgatttttcctcctttgtcatatcccttgtaaagtgtgtttactttgcagattcagctaagccgacctttgcagaagtattttttccgttgcgtattccgggctttttatttcgtttggacccttgtgcaataggccataaccggacgaatacactcccgtgtcgaaaccggtgtcatccgtggcagtccgctgttcttgcgggtgcgttgtcgaggtgttcttggcccgttgatttgtcattgtcgtgatttccctctcttgtagtgatttccttggcactctgcctttagttgacgtaggaaaattagctgtgtgtcggcaactggccgtcaacagcgcagtttaggaagagatttgtgcacgtgacgagccagccaaagaccgcgttccgtgaacgtgaggcgcgagccgccaacagctaaggaaaactccagaagcatatcaggcgaggtttttgctattcgaaaattccaaacaacccgaaaaaaggtgccagtgttaagcggggacactcgtcgtcgttgtgtgcttttttagaacaccgctaactgctcgaacgtgcgccgatcgcttgctacccgggacaaggcgaaaacaagtagagagatcttacctacattgtcgccgcttgaacacaccctggcggtttcgctccgagtcagtacgaagcagtctctgtgtccccgtggaactacctgaaagcacca

SEQ ID NO: 3877 - DNA, 1497 bp, Toxoplasma gondii
gaaactgacgagagaaacgaagtcagaggatttgttccagcgcctcgggaggcagctgagacaacgcgtgaggcatctgcgccgcacgggttcgctgctctcggtggggcaagcagcgcacggaaagccatggcgaattcgggagtcttcgccgaaaaaaagtcgagatagacgtcgtggaaaatggctccacgccagcgagtgcgcaagcggcttccgaagaacggatagaacggataggacggctaaaacggcagagtcgggcctccgtctagctgcgaagtctccctaggcgggcgggagctcgcgacgggtgtgaggatgatagacgaatccgaaccgccttcagagacgcaaacgcatcttacggaccccacatctgtcagaatcggttacgctgctctaggcgctccaccctgcagcgaaatgcagacatcgccgagacgcttttcctgcttcttccgagctccctctccgtttctggccttgggcgactgctctctgtctcgaattgacggcaagaagaggaaaagagagatagaaaaacacagaaacccgctggagaacagcctctaaaagttggagcgaatttgctgagacaggcggagaaagaaccgaaggaaaacagcgaagacgacaacgccggtgaaaagatcggaagcgcgagacaggactccagcgaatgtgctggccgtcgagctttctcaattgcgtggggagcgggaagcgcggacttgaagaaagccgcgggcgagagagaagaattacgaaagaaaagaagactgaactggtggggaatgagaaatgaaacaaagccttgtgagggtgagagagcgaatcccagcggcggtgtcggcagctggaacaacagctgcaggtccgcgtcggaaaacgagaaatgggactaaccggcacaccccagtgaaactcactgggaaaaaagaggcaactctcctccaaaccatgctcagaaagtcaaaagagaaactatgaaaaggaagattgcagtcgccaagcagactcgtggatatctcctcacacgtctggcagaacagagttctctccgccgaccttttccgcgcacactgtaaggagtcacggcaaaagcggcactgttgtgcatgcgagaaacttgttgacctaatgtttgtctgtgaaaaagagaaagaactgcccggaggaaaactgagcttctcaaaacggtgcagagatgccactggatagacgggagagtagaggtggaggaaaagggaaatgttgaaacgcaaaggccagatcaggcactcctttttgccacatttcgccttcagaaaagtgcgttgaacacggttttctgcttgccaaaggcaggagaaaagaagcacgagtgtcgcggtacccgagacgggttgctcctgtcagcggaaaatcgtggtatttttcgcaaagaattcagcggacggggtcaaaaaagagtgaaaagagcgatgcttcatttggaaaaaaactccttgtgaa

SEQ ID NO: 3878 - DNA, 2975 bp, Toxoplasma gondii
cgaaagtgtctctgtatcgaacaatccagtcgagcgtggtgttcccgaggtcgcggaagggattgatggcaacgacgagcgggtccgcagtcgtgtagatttgattcttcatgaagcgcaccttgaggaagtcgaggacgcaaggaatgttcgtgtgaggcaacatgccgatgtctccgtacgtcatggggtcgatcaggctgttcacattccacgcattcgcctgcggtacttcgaacggttcgtcgaagcccggtggatcgatctggacgcaggtcaagttccccttgtctgtccccgcctgcacgatgcacttggcaaacatcaggtccggctcctccttcaccgacggcgccaggtccgtccagatttgaaatccctatgcaaatacacaaaagcacgagagacagcgtggtgactcgcgggcgacaccggggtcggaagccaggaaacgacctcggaaccacaagcgcactgcggccgggagaagcacgacggcctttttcggcaagagaaaaaatggtgcacagtcggggtgaacgattcgaaaagcgggcaaaaaccgaaacagagacagagagagagggatgtgcttctcgggccgaggggcgacacacagttcaaggtggtgaagaaacgacgagcgcacacaatccgtgaacaacagagacgacaccgagacctcgaaatattgaacccacagcgagtgcgaccctatgctgcggctggggaactggagaaaatgcgctatttctcaaacttgagtcttcgcagagtcacgcagcccagaccccagacacaagggctgctcgggagtccacggcacacacgccttccgacggcaacgaaacgcggaagcgcgtccacccgaaatatttatcccctctgcaacgttagagctctccggtttcctcgaaaaaacgatgcaggaacgcgttttacacagctcaaagcggcgcgtcctctgcgacctgttaacgcgtcgccgcggtgcgcgtgggaaacgccaaggctgcacctgggcagaggcacagagtggttttccagcggttttcgcgacatccactgtggaacaaaataaacgactttcaggaaagcgagaaagacgcactttgtacacattgccggagtggtcgaccgcgtggacatcggacgacctcttcttcagcgccgtggccgttttcagctcctcagacgtggtcttgctcgccattttgcttcagagagagataacacgaggaaagaggtacaacgaaggagagaaaacttcttttttccccggagagggtcgtcgaagcggccgagaagagctggccagccgccctgaaactgcagcaccgcgcgcgccttcgacggcgtggacggaggaatcaggtcgaaggagacgcggaagagatctccgatgaaaagacgacgtgagtgtgggaacaagtaaggaaaaatttggggaaactccaaaaacaagaaggacgaaaattcgagaaaactggctctgcgacagagctgcccaaacagccctcgggtgtacatacagcccgcgcgcgcgcgctctcgcgactttctggttcgcgcgctctggggattctgtcggcgccgagagagctcgaggattttcgccgttttctcgcaaaaacggtccggatacgcctgagtttcttctcgacaggtgcacgggactgtggacgctcaccgaggaaacaaatcgtggattttcggagcaatcaagcccgtttttcagtcgcactcgcacccaacacgacagcgtgctcgccacgcaaagatcgatcgcaaccgacccgactcgctggcgcgcgcactctccacgcgacaccacagcttttcatcgatacagccaagtcccccgaagcgattctgtgcactggacggtcacagcgacacccatgccgccgctttttcgacgttggccgtctggtttcgacggcattcgcaaggtccactttccacgttgcatctggggtcgtgaggcgcagtcgccgtcgtcttgaaacgtggtgagtgttcgtagacgctgctgccgcaacctctcttcgcctctgctgttgagagatgcgcagagctgccggagtcccgaatgcgacagcatttccaccaacagaaacacgccgcacacagagacacactgtccagaacgcagcgcttagcacttttagtggcgtcaattgtggctcgtcaacggacgccggcgggtttctcgcccagcgccccgcggttcctaactgggtgactcgagtcgaagaacacattttaggcgctcatttaggttcagaggaaatgcgatttctgacagaagcgacactgcggacacggagctgtcgcaggcagagcacatcgagtgttaaaacggtcaggtatgctaggcggcccgtcgttctacgcccgtcagaagtgcagatcactttggaaagatgttaccggcctagcacgacggtctcgtgatcacggcgcctgagggtccccctgcacccgttgctgatacgagacctacgtaggaaccgatgtagaaggtgtctaggccacagccgctgttgagtgtccctagtcgcgtacgagctgtctgcattgatgcgatgcggctggcgttggtcaccgtttctctcgggtgtctttcttccacctacaacgtgcagctttggcagtaacttgcagtgaacacttcttataagagcgtttctctaaggtgggtgcgaaggagcatttgcggtgtaacgaacgcatcgctgtcctctgtttcttcgaagttttccggccttccgctgcaggaaagtgcccggatacgcagaatccaccgctcttgaggagtcgacgactcgctccactttcgggcatgtgtgaaagcagcaggctgccaccagtgattggtcgtgggtttgccgtagcgaactgtccagtgtgctgaggaagtcgttttgtcggaagaaaggacaaagaaggtgcagagagggatgtagacttca

SEQ ID NO: 3879 - DNA, 3369 bp, Toxoplasma gondii
agcgaaagactccgatacagctgaacgtatgagagacgtcgttttctctccggtgccagtcactttgtagttgtcttttttagacacgccggctgccgtagttcacggtttccagtttcatttctctctagcttttccctgttaccacacgacgtacgttgctgtggaagcgcgacggcgtcaagccagtagggcggaaggtcatccggaatctcgcgtttttctcgtttctcgcgcttcgtgtctctgcttcttcgggaatctttcgagtgcagttctttatcacttgctttcgctcgatcggccccgggcgaccgttcaacagcgctccgttcccgatgctccctggcacgaaaggcatacgcctcgggggagctgtcaacccctccgttgccgggaaggaaagtctctgaggaaaaaggcagaggagactgccgcgaaggcgagagtctgcaactcgaaatccttaaagcgacggagaggggaaactcgggagctgccgcaccgctgaccgcgctgtttcctcgccattttggctcgaaaagcgggagcggggaggtctcgcatcgggaaagccccgtctgtgtacgccgccagcgtcgaagccgacaggcacgccggaccgcggcggctttccggttctgggcagcatggcgggccaacgtgaccagcagaaaacccgctctggattctagggaacgttttggaaaaaccgagattgacatggatatggagacaccctgagagagcatctgggatagtgtgactcaaaggatcgtcatttgaagagtggaaacgaactgcaagaaacgcacgatgcggagtctcgccgaccaccggtcgacgaaagtaagcagcgacgctcgttggcgaatggggacggcctgaactcgttggttttcgacaatagcggggccagagactccaaaaagcctcgttggaaaagtgtctactcctgaagcaggttaattgtccgtcaaagggatctgttttacgaaactgcatctaagaaattgagatcgaccgttggctgcggtcgacgtagaaacgtgttgaacgttgtcagcgcatgcgcatgcaacgtcgctgagaatggtaaaggactcaaagaaatttggtatttcacaggccagcagcaggattattgtaaccatccattcaaaatgcgatggggaaacccctatttggttagaagaagcgtttctttgagcaggctcttaacaaacacccagtatgtactggcaagaccatgtccaaagcaacccggacagcctctggtcacggaagaacctagtcttgcccgaataagaagaacagactaagaaacgttataaaatttcgcagtaagaaaactgagcaaaagaaaacactaattctacaacttagtgaagtcagaaacgagaacaaaaaggattccgccgccgggacttgaacccgggtcgcgcgggtgagagccgcgtatcctaaccacctagactacagcggatagtgaggaacgggtctcagttcgcatggcactgggcggtctctggcagtatttttctctacggtcttttttagagtggacgcacaaggtgtgaccgctcaaatccgaactagctagttatctagaaaaatgagtgttgttgagtaggttccgtcgtggcaaagactcaataccaacaacggatgctctcgccgcagcccccttcttgccacacacggaatggagacaccagccacagcggaacaatggaaatctatcgcactgatgacctgtacatccggatgtcccatggttcgaaaacgatgatcgcacggagtgtgtggcttggttatttatcaccggcactagctgtcaaataagaaaactgggagaacgcctggagacagcacgaaaacttccatgctgcggctgcttctcgcggatttttgacgaagttccctgagtcagtgttgcgtttaaaagcatgagagtgggttgttgatgctgaaccttcatagttaactccgctctccatctaaggtgcttgcgtgagaacgtttccaacacgagcctgtcctattggcagaccgcggcatcaaaatgactccatttcgaaagcacaaaaccataattcttctcaggtgtgcgaacaaaagtgagttaagtaatcgaatgccgctatctagtgtgttcctggttttgaaaagttatctgtgtaattacaggctccgcaaagtcggaggtggactcgccgcaccgcaaacagaaagacgctcttggatagttgatgcagaacaattctctggtggctctaatgtttcctggtgccagcatcacgggtggaagtggacgtagaaatccctagagcttctgctgactttcaatccacaccgtgacgaatgaagcaaccaacaagtacacgttctgagtatcaagtcaacaccggaggatctcttctctccgacttgcacccatgtgccagaacgcgaattacaggagcctcccaattcgagacgatggaaggccataaatcgggtgattactgtcaggaaactcaaaagagcgaataacagaagtgagctggaagcaactgaccacggggcttaagatgtctgtctccactgtcgtagctctgtagtggctccaggttcacgctgactcccgctgtaacgcttttttcggtcacgcagcagcggggagtaccacctttttgctcttgtttactttgtcagtcgcttagttctagcaacgaaaatcacccttcaggtctgtatctgccgaagagcgaaaccagattcataccagcctcacttggtgctttctcggtattaggtgactttttgtctgcgaagaacgcaggcaggacttgatcgcaaagtgtacggttaatcggctgcccaaaacgtcttttagagtgagtgtggtctgtgtatcgcttgttttcattccgttttccctcgtctctccagttaagtctgtcgccgacaacctttcggttttgcaatcaaaaccctaccacccgatctactccctataccaggtttcttctgtcattctgcaacgaacattgtgattgttaacgtgcctgggaaaaatcacgctgttctgctccctgaccgttcgcgatctaagcgacggcgttactgtcgcgtccaaccccacgccttagaaagattggctcctcgaaccacatcaaacagttcgttttccgcctttgtctgcctgtcggtggccaaaatttggctgatgtggtttagaaaaaaggtaaaaggttacatataggttgtgctttgagacaataacccagagtggtacatgccgtccggagccactttgtccgtgtagagcgaaacatcaacggccggcttttttggcgtcagacaacactgtgaagacttccacga

SEQ ID NO: 3880 - DNA, 3528 bp, Toxoplasma gondii
gtctgctggtcttgggcgactgcgttcgcgacagcacgaagaaagagaccctgtaccggttctgagtcttcgccttcgctttcatcggtctcttcgtcgctgctgcacgacgcggacaccgcgccgaactcccttttctcccactcgcgactgagctggaggccgtcttcctcgagttcttcttcgtcgtctgcctcggcttcctgtttgcggcttgtctcgccactctcggactgtgggcagtcaccctccagtgcatgaagacctgcgttctcggcgtgcagcttgtccagttcagcgtccatttcgtccagggccgcctcgaactgacggtgaaaccgctgctcttgttcttcttcttcgtcgccgcgctccagctcctctgccgcgtctctcagagcgcgcgtgaaggcgcgtctccccaagacagctgcgaatctccaagtgacttcgaacgcctcggcgagcgcggatgcctcctcactgctctcttggtccttcttccattcctccttccccaaaagttctcctctctcctgcccgacctgctcaccatttgcctcgtcgacatccgcatgcatcccctccagcggtcccgccgggttcgcgtcgaagtcgccagggtggtctggcgcctcgcgcttcgcaggttcaggtgtacctacacccgggccgctggcggcaggcgagagttcgtggagctgggcctcgcgcaggatcagaaagcacagcgttggaaagcaggaacggagcagacgggcagtgaggcaagcgtcgacttgcgtgaagacttggaggagactgagggcgaactgactgtacgcaggggacgccaggagcacttgtcggataaaggaaggacggatggctctcaacacgacggcgactgcatgcacagacgcggcagggttggatggcaaggacggagaagtcgaggggctcgagaacagagaggcgcagcgaagcaaaccctggaatttctctcgcggcgacgcgctgcggaggagcggcagcaacggacccagcgcaacaggaacatcgcaagcagaaacagcagatgaagaaaatggacaagcggaaggagaagaggaagcagaaggggaagaagaggagcacgagggaggaagagtcgctcgggtcgccatcgtggtagagagcaactggaaagtgaaaccggcaaagccacaccgctgcgatactcgttccgcgatgtttgctcagagtctgaaacgaaggtgaagagaaaaaggctctcctcaggcatttagggaggccgaggacgaggagatggatatcatccgttcctttccctccgtcggcctgccgctgcagacgatgagagcgagagaaaaccgcacggaacgcatgcaggcacgcgctccggtttctggcaacaagaaatccgccaagggaggagagatacagtttttccttgctcattcaacttcaaatttcgtctctcttcttcttcgtgctcgacttaggggaagaactatgccacgccagcgtggggctcgcgccgccggcgaccgacgcctcgatcgcttggggaaggttgtctgccggatgaacacagagaaaaccagctttgaaatgtggaaactttgaactttctccacttcttctgccgctttctgccgtgccattcgtttttttaccaagctggactttttgtgtgccgacctcggaagccttctttccgccgtgtggccgaggaccgcagagaaccgcaactgcacaatactgtacgcgtgcacaccctcttggaaaatgccccagagagactcaacttcgtttccacgaggagatcgtcacacatgcacaaacagacgcctactcatttgcacacagcgcgaaaaaaactagaaagatgtagtgttgcagatgcgaacgacggcggctatgtttaccacgcgaggagcgcgtgcgcagaagatcgacagccgttgcagcatgtgtctggggaggcatcgtaagagaaaccaacgtctctggactaaagccaccaatgtttgcggaaggagattttctactgtcctgttcacccccgtgtcgacaagttcgccgagaaagccccaagaagtcgacgtagggcgcaacactgcggctgtctggcagcgcactcgagggtagcagcgcgcagtaacgccttcaggggaagcccaagcaggtttgagaattcaatgaatggtcgtatgatgtcaaaatctgcgaactatagcgttttcaggcgttcaatcccagactgtttcgttggatatacattagagaggaaaatgttcacagataacctcgacttttactggatagcccttgccattgagactcgacccagctctctatcgtcacacggttatgccatgaaaacagagtttcatttgctgcgcacactctagcaaatatccgacagctcttctgctgcagctctctttcactttaatgactgatttacccgaggaagagtcttcagtcttcaagacagggcgccctcggagcgcgaagccggcgcctgcgtagcctatcgaatgaccaatcgaacgggcttcctgctgcaaggccccgcatggttttccagctttgattctgtcagagttgacgtgcttcgccaaatcttacggggtttcctagaaaagagcgtgattgtatataagtatccctgtgtgtgactcgtgtgaagtcctcaaaagcaagaacacataagcgttccccgcggcaagcgaaacccgcgctttccgagcagacggaagatgcagagaagcaataccagaactctcgatttctctgtcacgttagacctgactagggtggactctcagcgaacgaaccgcctttttttcaatatcggggaatccaaaacgtggcaaagaaaagttgagacgagagtgaagtgcgagaccactgtcgggggtgttgcgtgaggcggtccaagggggactgtgatgtgctggggaggcatcaggaaaggcaagtaagtttcagtgtggaatggagttttctacctttggactcgaacctgacagcagctggcaggaaaggcggttcaggcatgcaccgcaaggggtgtgatacaggggggagttctcgtcaaagaacggtggggtttgtatcgggttatttgatgaaggtttcacggcatctgcgggtcactcggaaaaagttctggtcacgctgaatagagcaaaaagtgagccttctggtacgcgcattcatagaatatgcagtagcgtggagagttttgtgtactcaagggattccaggtcgttcggggcggacctggacgaataagcgtagaagcgcactgtgcgggtcacgcgttcatgcatgttgcgtgcctcgctggattgctccaaaaagcctggttcaaaaggggatagcgccgattgtgaactcctgtgtggcatccccctaggtttggacatttttgcagagaatcggctgcacaaatcactctgattccttgaaacatttgtgtctctcgaaaccgttcttgtggattccctcaaaactttcctgactttcccaacacaa

SEQ ID NO: 3881 - DNA, 1745 bp, Toxoplasma gondii
ttcctcacgagtccttgtgaccacaagctgttgtattttctttctgcaagtgcttggagagttcgatcgaaggtagatatgcttttttgttcatctgcatcgccgtagagaacaagtgtctaccagagcgagcatttttaggaaaataacgagcaactttgtgcgctcactcgagtgttgagggcgatttgctgagtcgcgggtcaaaatggtcacctcgatatcaaggagtgtggccgagctctggcaacttttttcaagatttcaggcatctgacgataaagagagccgcgattccgtcgccacacgactattatcagcgtgcgagtggggaagcagacggggctcccgttctttcctcctctttctttacagaggtactcttcatacgcggtcatcgtcttcgcaagggttagaatatgtaataagtagagtcttggcatgcagttccacatctgaagaacgccatgcgctacctacacacgtccgtgccacgaaagatgcttaacttcagattcccgtccgagacgactcgtgtcagacactctgatagtcacgaagaagccacggtaaacataacgtttctctagaaaacacccaccacattaatctgggcagtaagaaaacacctctttgcggcgggggtatgatcccactggcactgcacaaggtctacatgctcctgccgcctctagatgaccgtgaaccccggcaaaagctctagcgtttggatgtgcctcagaaccaccttgtgcatttattagtgttcaacagccaatatcaaaagccgaagactcctgaaaaaggtgttgcatttcaataacccttaaaaaacattccacaaaaatcgtcctacggggtatgtgtgcacaacgtgccccaccaccaaagtgtcattccataaatgccacacgatagcaaaatccaacacttttcgtctggaatgtaaccgttgtgcagtagccgtaacaccgtaaaaagctgaaatccatcactttgacacccgtaacatcgccgttgtttaacacttcaaggaggacacaacgcgtggcagtttggacggaccaaagcaaccatttttccacaataaaagttacacatggattctctaaagaattgggaattgtaaaaccgtactaaaactgttctactgcacaacagctgggtgtggtttgtcttgctggggacaaggcactaacgcaccgaagaccgagctgatccgaatgtgacttagaacatcttttacggtttgtttctccctccccagtggactagatcaataaacaatagttgtggagaggcctcgtgaattcaacgagagcgtcagaataacgataacgctacacagccgttgctcttctgccgtgaaaagaagccctctctgaatccaacagcgtctcccccttcagtgcatgcgctctatgcgtactcggccgaatcgaagttatgtcgactttccccagagggaagagagagcctggctccgagcagaaagaaatccaacgaatggtgactgtacattctttacgacagagcctgcatgtgtgcgctgccaaccacctattgactgcggatctttggcattttcaattcacgcgccggtgtctcctgccagggccatgaagcccgagacgggaatcatctgccgctaggctaagattagggatgacttgcgtgactctgacttcgtgccctctgcctggaaacagctcgtctgcgagaaggttacccgacggtcttctcga

SEQ ID NO: 3882 - DNA, 3100 bp, Toxoplasma gondii
gctccaagggcgtcgactgtctctccaccacatggccgatttcgttgcatgcgctcgctgagggagcaaaaactgtcggtgaacggacacagtccgagaggcggactggaaggcgggccagaaggtggctgtgttcgtgggtgcacgaggggaaactcgcaaggaaattgagaccttgcgtgtctgtgtttaccgggtccgagttctgtggcgcttttcaagaccatcgcatcaagtgtactgagtgtggtggtgtcgaagagtgcgcgagttatggagccaacaacttcaggtatggggggaaatgcacgtttgcaacacatcgtgagattgaatagcgagccagatgcgcgtgccgggctctctgtcttttgccgacacgtgcttccacaggtatccttgggcgtacggcacctagaactcggactccactccgtgaggtctcatcgacgaacaactcactggctctgcagctagacaagcacacgtgcatctgtacgtggccgtgaaagccctcgtgtgccttggtcggtatcaagtcagcgcggatcgtgtgcttttatagtttttcactagtcgccgccacacgtaaaaatgggcctcccagaatgaaggcctcagatatctcgaaaatgagggaggcctcgactgtctaaaactggtgtacctgtttctgaatgtcctggtgtccgttcgggtaaatgcacatgcacacacgcatcaggcggtttggtcgaaagctggagcgttctcgaacttgagctgcggcagccgcgcatgcaacgacggaaaaacaactttgtttagaggatggaaagcggccggcgcgaggggcttcgggtgtgtgccacggggtatcgtcgctctaggttgaaaacattccacaaggggttgcatcatcgtttttgtgagattcgcacgcggcaagactgaagcgcgccgttgtcgcccgtccaagccccgagcacctcgcttttctcggaaaagtgtttgcgactatgccgcggaaacagacctgttttcgctggctagtcctgctaaaaaagtgaagagcagccgacgtgttgcctgatggaaaacggaaggaaatgcagaagcacagttggaacgcgaatctaggaagtatccatccacatttttcgcgggctggatccgagtcttttcgcgatgtgtccgaaccaagtccgttaattcaggaacgcggaactggattcttttgttcgaagtggtcggcttctttgagcagctgtccgcagaggacgagtttgcacgtttctccctagatcctgtgcgtcgatgtgcgcggggataatcactttgtcgctcgatgagctgcactgaaaaactcgcgcctgtcagtgatatcatggaagtaaatgtcccgctagtttgtagactccgcccgagaggatggtgaactcgattcgtaaagcaggaggcaagcggttcccgttgagaaaagcgaggtagacgggctggtactatggggggatgtttgctgtcgcgtgcatgaaagtgagagagtatgcgcacgaaatggacagtggaaaagcaaattggaagatgttacagggtattcccgttcctgtagaagtcttctgagcggatgacgttatgtccacccgctgtttttgtgggagatcccggcacgtggctgtgatggcgcgaacatcgccattttagatccgttgggacaaaatatcgaaccgaacactagttcgctaaaacaggaataattctgggttttcaactgggcgtccatatttgcaactgcgaactatcaggagaggaaaagttaggtttaagcgcatcctgtgttccggtgtgtatcatctgaggagcctcagtctcataattgctcgctacgtgggggggtgtcagagtatttggtagcagaggaagaaaactgggaaggcgcaagatgtccttcacaaaaagacaagctcctgcaaacaatgaagttacacgggagacgtctacgcactgcttccgttgcgcactgtcgtgcactgttcatgtcgtcacttttaacaaaagcgaaatctctccctgaaccttcgggaagcggcagaggtattttcctttctgcgagtaaactgaaaggggtcagtcgggttgcattgctacaatttcgagttgttggtgagtcacaccgtgacacggaaatgttgtgtctggggagtttgtagaagtgtgcagaaatacgcgcacccttgaatgaactgcactgtgtgtaagctaaaaaacgctcgacgtcgcgatcggtggtcaacatattcgtctagaagttcctctgcgaggcagagacatggctgccttgcgttacacgttgaaatgcagagaggatgtttgtgcctcatgcaggagtcccggcactctggacggctggtgttcagaaggggagagatctctacgaaagtagacagagaactgtaatagaggtacttcaatatgtgctgtcttttcccgagtgttgaataaggcagcatcaaatggaccagaaggaaaatttgtgttgtgtgcttccaggggaaaatttttgtccctgtgttgcgcataaaactggtcgatatgtctgtcggcttgatacgttaggagaaagaagtcgctaggacttttttcgacattgctttgtagcggcgagagttcccgtctcgcgaattttgcagcagtaccacccgaaaacgtcggcacttgtgcttcgagtacgcttgcaaagtcatgcaattgcgcagccgctacgaacgttcaaaacccccgaacaagggcggcatcttcgaggagttgcggacggctttgcgcagaaacgcggtgccttcggttctggaagcgaattcccgtcagaattcatcttctcgctgaatgatcctgtttaaagtgtttcgttggtcgaacgttgttccaaaggcgcgcgggttgcgctgaacgcaccgcacgcatcagaagtcctgatttcgacgtctcttcgtcaccgacaccttgctttgtcttatttcccttaggggaggtcctgctggtctcccacatcgaagaagggtgtatttttagcctctcgaaacttccgacggagttgctccctttccccagacttccgcgaaca

SEQ ID NO: 3883 - DNA, 1704 bp, Toxoplasma gondii
cgctcaaaaaggcaaagaggcgcacacatagatgaagacggaaaacagccgcaaagtgcagttttcgtacgaattgccacatcgttctttgttcacttgtctctatgtgttgaccagtcaggaaggtgatacatatttgcataactttctgttagaaattcatttgtaaagggagtatgtgcagatacatcgcataaaaaggggagtctacagaggttggttggcgcatactgattctcactctgtcgctctgtgcattcatcggcgaactgccaccccacctgactaccgcagtgtgtgaagcatcaattccacctgcgcgcgtggatatgcacgcgaaggtgtggtgtcgctgttggtttttcaggaggcattttggatggtctacttttctttaaattcgacaaaacgatacctgacatgtagttttaccgctttttccagctgtttggaagattcgcaagcacaggctgttcgctacctagacggcggaggcagtaacagagtggacgcgataagctgttgtgagcgaagtttccggcacatgcaaagaacacagaagtcatctgaccgcttcctttagtgcaaacgttccagcgggcccttttctgaggtatgcacgcagggcacagcctcgaaaagaaaaccaaaaagactcgagcttgccttcgtgtcgaaacaatcctaagccacgggtgccgagacagttgcggtgctgttcgacagtggacatactgcaaccaccaaatacaaatgaatacgcctttctgcatccacatcagggcaagggaaatgccggtgacttgttcgagggcggtacttcgtaaggtgatctcaacccacgaggaacgccaccgtacagctgaagccgtcggtgaatctgctttctggggaaatccgctgcctctccaactctatacatcctcactggatcacaagctgctgccaggacagacagctcgaaatgagcgactgtggatcagctgctttctccacatgctgcctgcgttcagcagcgatggaacacgcatcgatataacgaaatgcacacagtcgccgtcaacgcgaccatgagattggagctgtagtaaccgctttcgttctgtctgccctgaatcgagaagaggcatttagaatcgtagaaaaggaagagcgaactgtctcagtccgtttcccgggctctctgcacccgtcactcggccgcgacaacaatcgcaagctgggttcgctgggcgtagcggttaccgaagtcatgaacacagcggctgcgtttctgcgttacgcccccgaatcactcttctctaattggaaccaagaatcgatctggttcctagaaattcgcattttcgcgcgcgagcggatgccgtatcgccagccttgttgtggtgtgatactgtctcggtgtgctgcggcccggccccgctcgagtgttgattctgtgcacttccttttaagcgaatagctgcaggcaagagccgcgccgcctgaaacagggaaacaaatggaagtttactgtcagccgtttagattcaaaacccgcgatttcaaagtggaaatgcgtgcgcgcagtgcgacgtccacgaggctagcgacggtgccacacatcggttgcatgcgcttcgtggctgtgaggcgccgtgacacccagcctgtatgtttggacgcttcttcaccacagttgtttttccttcatttgttgtgcca

SEQ ID NO: 3884 - DNA, 2895 bp, Toxoplasma gondii
gggctcaaaattcggtccgagagaaccgagagacgcattggatctggggtgtatgtacagcacactgcgcacctccacgtctgcaccgttaaagacggattcggcagtagagggggggtcggcgccggccgcgagagcgaggctgtgggctgctcgaagcggaggaaaggcaagggtggttcgctgctgtcatctcttctcaaggacgccagcgtggagacgtggacacggaagaaagttcgcgacctggggtcggcgacgttccacgcgaaaggaaggaagaattcatggaagatgctcaaaaagcgtaggtaagactcgcggcgtacgaagccgcgggaggcgcattaggggctcaaacatgcacaggccgctagagagctgcttttcgtctgggagtctgtgttcttccttctgtgccaaaatgcgattgcttacggctagtttcagaacatcaagtgtttttttagcgcggtggaacaagatacacaatgacgagggcacagaaatcaccgctcgactgtaggtggatgcgaaagtccgatgccgtttgctttgtctctgagacatacgacttgagccttgaaacgaattcctttgaaagggtttcctcccctttctgcgacggcgccgttacaccccagagaggcagtgctacgcgaacaaacggggtgatcccttgctgccgttgcgcaagggggtgtattcggtgaaatggcggcgccgcttcttcagagattccgctgcagacaaccaaactttgagatttgaagaagggcactcgaaagaccccttttgctcacggactatctccgagacgccagttcgatgataaaacgagggacaggaaaaagcctagtctcagctgctttagttgcagcatggtctcttgacggtgcgcagttttctccgttgtccaagtgtacgcatcgttagctagttacgcgcacgacactcgactcagcaagaaagtaatctgaacatgagattgcattccaacccacgcagcgtcctttcttgtcgcagcattctgactgtgtagaccactgctttggtcaaaaacagcttcgcggcaaagtcggctcatacacggattgccatgaagacccacgcgttttctgtgctgcatagatcgcatctcgcctggccaccatcctggtaaacggagacacagactgtttatcgaacaagtcccacgcagggttatctgagcccactttcggaggcgtctgtccggacatctgctgcgaacagatcacgttagtgttagagaggggtgctatattgccactgaacgagactcttcgatctgctacgtggccgcagaacgaatataatcttccagtcactgaaaacgaaaggacgtacatgcccgtcgcgtgactttggagctcccgttgactttcgtcatcgcgttagtatgactcgaatcattttaaggaccctccacgaacacagacgattcttagctgtctctggcgttcagagtgaaacacagtcctggtggacagagtgtcgcagaaacatgcgtagaactgacttcgtgcaaaccagcaacaaggtgtgttgttatggatcacgtgcacggtaacagcagataatcgcaacgtgtcctgctccccctacgccggccgctgcgagtgtatcgacgaatgcaagtgacgcgccgagaccgttggcactttttctgtgattaaaaactagtggctaatcgttctcatcgagttctagtcgagatagtcgcactgccgtcaggctgttcgtgtcaggaaatctgaaaccgagaatctgcctctcttgagagcgagacgcaccatccgccgcaactccgaatgtgtgacagccgtagtatagaggtttcgttagggaagatgcggtctactgttctgtctagaattagcgcaaaggacctggtttctcaatattgcctaccaacggaacccctcatttcatcttctgtgttgcctcgaatgcaactgtctcggtcgttcataaccgcttgcaagtcacgcggaagtacagatagaacgcgtctcgaatgcacgcatgctggtggggggaatcccgagttcgctacgtttctttgcgtcgacgctggttggaggtctccaggccgctataaactaaatgaagtatcaaaaagttaagagagaaaagtgcaacgcagtggtcagcctcagttgcaggggcattgcgttacctacaggcaatcactgcggtaatagtgtcgggcttgaccccctgaaattattgccttgtctcattatttatgcagcgtacaggtgattgcacgcgtccgtccacgccatccgtctgctttagctgcatctaggtgatttgctaggttttgtggagacacaccggtgtgggtacttattcggtacttcggtgcccacgcgcatccttgttttgttccttcctcatatcttcgtctgtctccgctgaaggcagttggtgcatcggtccgagcatttggtggtggtggtggtggtgcttctgttttgatagttcagacatcttttcagttctgaagacctcttatggatgtgttgaccttgttgtccgcacagtctaatgcacgctaataaatgcgcagcggcttgcctgcgcaggaacctttgttgttcgcgctgctttctggaaaggcggttgacgcagtcaggccgtattgccgccattggcacatattctaaccagaacgtgagttagttccagatgtggctgtcgatgggaggggagatgctcttgaggatgtcgtgacttaccgccatttgagagtaaagttttttgacagcgtcgaaatgcattggatctgaatgtcaagcatcggtgatggatctgaagtggcagaggaatgtgtcggtgccttttgagtattcgggtcgtcgctcctaa

SEQ ID NO: 3885 - DNA, 1484 bp, Toxoplasma gondii
cgaacacctgtacgacaggtgttaaacgttcaccgaagttccactttcgaaaacaggttcctctcgggtccagcggctgctgaaacaccggtctgcaggtgacaaaggaatgtaaaccgtaatcgattagcagagcgttgcggttcgttggcgcaccattttttagcctttccgcaaccaggcaggcttccattcggtgaaacaaacagtgtatggacaggtttcttctggcaagccggctgaatatcgccgcatattcacacgtgatttgtcctggaactccttcgctcagatggattccggttccgaatgtcctgtgcaaagcgaagctcctttgtcgaccggttgactggttttgagttatctggatgtggcagttccattaaaccaaaagccgctttgcaagtgtaacggctgggtacgttcccatatcttatgaagagctggcttgtagggcctgtacgtctcatgatttgatgcccgtgacacaagggcacagattacattggttccagcaggaacgttatttcacacaaaaccacaaggttccatgtttcacaaatgatacgaggaaagccgtgtgctgaaagtgagtggagtgaatcaagagcctctttgttgaatcacgcacttcgagcacgggaaaccaaggtcagcagaaacaaggagcctgctgtttacatccaaaggcattatgtgtccacaagcggtaaacgtcggggcatttgggtgtcttgaaaacgaagcatcaagagatcaagcatccttatttacttatacacagcctggcacacctactgacgtgaagcgcgcctttctgcgctgcggtgttttgaaagtgagacttaagttgctttccacggaaaaacgccgcagaatctacagggagttaaaaaagatatccacctggcacgctttcaagccttcgattgtggtgtcttggattgcgtgattcgtctgttttgaaatttttgccggagcggactttccgtctagagagaaggcccctataggtcccccaaaatacctgtaggcagcgccccgcaaggtcatccgcagctgaatttcgcagatgaatccagaaggaatttggccgtttgcgttcggtttctttatgtattggacctgcgtagttgtttttcttgtggtgtttcccctgtgaaacccctggtgcactgtcagccgctgtgcatgcctgggtcgcctttacccgagaacgctgtcgagctgttcgcctctgagatccacgaatcgggactttttcctcgaagcggttcctttctgcagccactttttgtttcatccgtttttctcgtctctcctgtttgtctttctcgtatttggtcacgttcgcgccacactctccgcgcgttctggcggttttctgcgcccgcctgactggctggtgcgcacgtctgcacgtcgtgagattttcttctggacgcccagaggctctgtgtgttagtttcactgaattgacacga

SEQ ID NO: 3886 - DNA, 507 bp, Toxoplasma gondii
attgcatcgtcacctgcgtcctgcatccttctcccttcattgctcttccctcttctttctcctctgcgttctcctcccctccttcttcgctctctccctctgcgtcttgttctcctacgattgcttcttcccctttggctcctctttcttcgccttcttcttcttcttggtcgtcttcatctttttcttttctgagcctcccgcttttgtgtttggacgtatcgcctgtgtgccgtcgaaccggttttcgaggtgtatctgcttgtgtctgtcgaggatcgacttcctctcccgcagttgcctgtcgacgcctttccattctgcgtttctctgcctcgcaagagagacagacagagcgccctggattattttccgagtcgtctcttctgtgttccgcctgcggagaagcggagagagtttctggcatcggcgctctgtctttaacgaagcgacgggcagcaggagactgtggagactgccgcgtcctcagggcaaagaaggcacaaa

SEQ ID NO: 3887 - DNA, 1608 bp, Toxoplasma gondii
tgccgaacgagaaggaagtggagttaggtatcactatattgacgtatacgcaagtctctatatttatcctcaggtagacctcctcttgctcagccgagtggtgctgccttgcgtcgttcttacctgcaatttactcatgagttccttctgtgcttcattgggttcgaggttcccttgacgcagcaaggcagagaagtattccaagaggggggtaggattgtcggggtcgacttcgaggaaatttttttccagatctttttctttgacatgatacgtaggcagtcctcgaagaatgttggccgcctccgggcctgcaaggccttcctcctccgtcaccattccactgcgtgtcgtcaagaatcgccttctgtctcgtgcgaaacgcagagcctctgcatttgctttcctcgcctctacgagactccaccgtcccgcatatgtgcctgaacctggaaagaagggggaacacaggaaagcggcgacgcagttgagacggtgaatctttctcgcttgttgccacgatcgacggggtggaacgggaaactggaagtgtttgccgatggccgccgcttcgtgaggatcccagtacaccccaaacacagagaaatgaggcacttgtagcaccgggggtgacaagccaagactttcctgacttgagctcgcaaaaaaatgtgttttgtcaacggaagagacacaccgtggcggctctccgagagcccatctgtgaagattcggcgaccatcgcggttactggaacagccgaggagaggcctgaaaccttcgtaaggcgggcggcagcagcgaggagcgccagccccgtcgatgggcaccagccgaagggaacgaaaggaaaaaagtgaagccatggcgcttaacacttgcgcagacgacaggcacaggatgcccgaaaatcattctgggggcggaaagcggcagagaggcgacgccgggggtgctgaggcaagccccgaggtcccacgagcagctggaagaacgaatctctgcttttaagccaggaaaaacgccttttctcttcacaattcccccggtagcggaacagagggagggggttgcgaggcaaccggctagtcaaactgaagagcggctctcgctcgtgacgtagaaaaaggcggtgccagcacaaaatatgcaaccaccatttgcctgaagaaatccgacagcgctcaaggagacaggcaaggaaatgcggcaagactgttcccagatacaacggaaacgaggcggataccagaagaacatagtgtatcacgcctagtcgtgcatgcgctgcggccctgttctcatcgacgcatgcatcccgtcgggacactcaagcaaaaacccgaaaaaaacgccgtgtcggcacagcagcagtggctgatcatctttggctttcttatggcgcgtctgtgtgtaagggtcgtgccgctttacctcagaaacttgtacaactcgctgttgccttgtgcttctggacctaccgctgaacgtcgcggcatgcgaaacgatcgctggcacttgaaagcaacgtttccaggtcacttttgagagacaggatacgtggtcaacagaaggtccgaagtcttcttgttcgtttttcaccggaaa

SEQ ID NO: 3888 - DNA, 3259 bp, Toxoplasma gondii
cttgttactcttaccgttcctcttcgtctcctcatttctgtgtgcctgcttctcctgctgcttaccactcgaattcgtttcttggaggcggggaggttttaggagggacagggtggcctgctggttgtgagcgaggagaggagaagaacgaggtggaagaagcgacgctgttgaactgtgactgcttcgttgagatttaccggcgagagcaggagagagaaagcaggcgccagaaagaagcaaacatcagccgggaatccggggagcgaaagcggaaatcggcagagaaagacaagctgaaagcaactgtgtgagttcggactctgtgtcactgggacggaaaacgcggagcacttggagagcgattccgatgtatgtgcaggtctcgaagttcatcagatctgcataaaaaggattcaggttgaagagcaagtttcagtcgttacctctcgtgaacaggaacagttttttccgctggtgatggtggtgcttcctcctctagacacatttcttgtgggggaaacctgccaagcgttattactcggtttaaataaacggcaaaacaacaccactatttgaggtcgaacgctcaagaaacttgggtgtctactctttggcgtctagggttcagcgttttctgttgaggtgtccgaccttcgtgtttcctgccgggtcgtctcggcgcttgatgttttgaaggccacgagaaggcctagacggcaagacaaagatggcggaggaaggcgtcgactttgcaaccgaaaacacgagttactagttctgctgagacctaatgctgccctttagaggtcctcactccccgcaggtgtcgccaataccaagagcttctgtgattcacgcttgactggtctgtcattcgcgtcaggatcacggctccgactgcacacaacttttccacagcgtggcaattgttaacctgacccacatccatagggtcagcgagaagggaagtgtgtttcaaagaaaagggatgtttagccaggaagttagcgtagtcacaggacgtctgagcgggtccaaatccagagaatgcgtatgactgagtgcactgacttttctttgattccgacagaaacctcgagaggagctgacgctttcgcgctgataagctcttctgtgcggacaacaagaacagttcaatattttatgaacacaggcgatctgcccgctgaaccaatctgggaatatgcggctcaaactcgtggcttcctctgccgtttcgttttcatcggatttaacggaaggaacaacatcgaactccgacaattgaactggtgaacgtgcggcagtcccgtgagttgttgcggctgttttacagtggaaaacgtaaactatgtggagccctgcagcggtaaaaacgccggaaaggtttgaacttgttgagaatttcggaatgtttcctttccccaaccgagttgtacctctctagtaatggcatcagggagtaaaatcagcctgaagtgaaggtgagtagtgtctgaagcatatatgtggcgtgtcgccgtgtttaacttttttctccaaaaaggaagacacaggaagagtgtaagtcgccgctctagagcaggtgcatgccccttgctgtcctcttttcttgccgatgcttgctgaatgacagcaacgccgcgatgtgtcccacgacaggtacactcatgccgatctgcgtaacgtagtttcagcatcacgttttctagaggccaaaacagacgcttcctcgcacgccttcgggtgaacctgcctcacgttcctgcctttctgtgtgcgggggtgtggctattgtagcaagttcttggacagccttcgtgcttgccagttttcgtagatggatgcaggaaaacaaggttgcgcaaggagtgggaagcttggcgattggaccacgtaaacgtcttgcaaacgaaccacaacgcgggtgctgtgaccctcgtggcctttttggtcagaggagtgtgaacaggaagttaattatccattttcttcagtttctctctggaccttcgtcttctgccctagcgacccattccgttaacaacagaccacgtactccaaagtgactaactcttgtaccccgctgttatccggtttgtttttttctcgcccacgtccacctccttacttcaccgcgccaaactgccggatgagtagcgtgtgagcggcgccagacatgacctcgctcgacgcctacagaaccccagacttaggtgaacttgttctctaaattctgtttttgtccgggtatgtagggggaaaacggtgaagtaatgaaagctcgacccatcttgagcatgtgcgtgactgccgcgctcgttctattcgggctgtctagacacctggtgatggaacgcaatggaaggtcatcgatggttaaccccgccacttcgtgacttcacggctgaagaaatgtttgtttcccgacaaccagcgcgtctggtagcaggacaagcgcggcagtttcacttgtattgaagttcgagcacgctggatagaaggggtttggcggcgtgaacccgttgtaagttcggtgtgcgcgaggttcgtcacggtgtaccgtattgaaccctactagacctccacctgtggagctgctcagaaaccccgcaagcgcggtgatttcccgtcaaccatgccgctgacgtttgcagctcctctaccacgatctctcccagaacaggccgaatatgttcgaagaggcggtgcagaatctcgtgtttgcctcgggtttccgttttcgccagtcggcacagataactggcacggaagtttgcggctctctccgtcagttccctccgcccgtcttcgagcatgcaacgctcgcacagcgtccgcggcgggtcgatcctacacgttcgggcatcgaggcgcaaggagccacacgcgcgagatgcagatgccgtgagaagcagccatcgtttctggaagtcaggttggcgttgaccgattgttccgcgcctctttccccctttcgaagggactttcacgaactatttttcgaaacacagcttggttcgccgttgtcaaactccttcgtttgtaaaagtctctggcggcgtccgcgcttcagggcggtcatcccgctgagaacagcggggggagaagaggcccccctccatagaccgttggtctgtttcctccgtcgtgtctcttcttccagggttctttaggacggaaacgaggtgggggtttctgccgactcgaaaccccggacccaaccggccttttccccctctttctgtacaaacca

SEQ ID NO: 3889 - DNA, 4289 bp, Toxoplasma gondii
cgagataaattcttcagagcgcgttcgccctctccggccttctcttcttggtcccaggtcggcaagctggaccgcgcgtggctcagaccgcaggactcctgggagacgtcggccctgtcccggtcttcagctctctcgcgctccagcgaagacgagagagcagccgctttcctcgaccttccgccgctcctcctctccgaaatcgagaaggaacgagcgcggtcggcgtcgagcgacaatccacgcttccgcgggacggccgctgccgagtgtctagacacctcaggccgtgatcgtcgcacccccggctcctcgtgccgctggcgctcccgctctctctgttgttggcgaaggagcatcttcttctccaccgccagcaggaccggcgtcggtgtcgggaacgacatcgcaacctgaagctggaacaagactcggcagagaagcacgcggggggcaggcggaagaaggaaagcgagaaagatgcaagaggcgaaacgcggacagccgaacaagaaaatgtcgggcttgcgactctgcttgtcaggggcagaaagcagagaaaggcaccacagagaggcagagagttccaggccacaagctccccgcctccaccggagacagcagacagggcgaggagaggacgtgggcagcgaacagcctgtctctttgtcacctggacccgtcagcgtaagcagctcggttccgagagtaggtgcttcgtctccgagaaaatgcaaaaatttggagaaacacggtaaagcgggcaagacaaagtcgcggggcagaatcgcacgacagtcgaaagaagccaagaaacgaaagcagcggctgctctacaccacgacactggaacaggggctaccctctgtgcccgtaggaaaaatcgcagaatgtcgctgcagtgtatgtacacctcgggagacctatcaaaacatgtgagtaggtttggcaccgctaggaggagcggtacgctgaaaaccgagattttccgggtaggccctaaactggcctttcagttacgcaagccgatgacaaaggaaatgcggaaggcaggccgtaccgcggaagcggaggaacagaaattgtttgcggaacggaacacgttgccgccgaagattgagcaagacgagaagacagcggcgttctgcgcatgtccgcctctcgcccgcaaagagtcgaaaacattggtacggatgctgacgaatccaggacaaagctgtgagcgtacgtatagagctatgggataagcactttggtagtgcagtccctgccgccattcattttttctcttcagcaaccgcagtgaatcacgatgaacggcggcggcgaaaagctgcgaaaaaaacggccagtgtggagggcggagtgacgccaggctcaggtcacctccagccgaggcacacggagatgaaagagtcggggaatccaaatcagtttcaaggagaagaacgatagaggacgcgtggaagagaaaacaaaactgcagaccgaaggaagcagctctgcctcggccagctaggggggccgaggggggaagggaaaggaaagcccccagaggtacgcgtccacacttatccaggcgctttcgtcaagtgccgggagaagcaatttaaaaaaagaaccgaaagaaggaacggggaatcctcagagcgagggctgacaggaaactctcgtggaactcgacggaattttctcggtttggtacgcggccggtgcgtgcgagaagacgcaaattcccggccgaccatcctgcgtcccaccaacacaccctgagcttcggcagggtcgccgccggcgtgggtggctggcagaagggaaggagttttcgagccgcccgagtgactgtttttcaccacttcattggcatctttcccgttgtaaaaagaaaagaaacaatttcggtgcacccgcaaagctccccggtccctgccacgtcattctgggcggcatgcggcggtcgcctttgtgtatgcctaacccgctgttcacggtccaaattcagtggaaagattctatccggatcttactgtgtttctgccacgctgtgcggatattccagatatcaagagctcactccagcattagaaaatccagccgtagcaacgccttcaaccgtagccgctgtttcaacacgtaggcggtcaagcagccacccaccacagtgtcttgtctgctgaccatcactccgataggcattccttgcggaggcactctccagaaccgctcgtattccaagatagattgcccccgtcgccacattttaagattgatcccgcaggccggctgcaatgcgtacagtttaattttctgcaaaggtacaaacacatctgcctgtagaggctctcaccggaaccactattactctggaaagtacatgcactgttgtcaccgcacatcaatatatcaggcagacagccgcagcacgcgcattctgagattctttcagccgttcaagcacttctgtctactttgtcttgcagtcctccacgaccaccgatgatcctcatgattgactgtggcaaatggacaaaactggatacactgacttgaagaaggcactactagaattcagacaaacctgcaggcaggtcacgcgatatgcgaagaaaccgctgatcatttcagttcagcattgactccaattcgtcgtgtgtgtcccgtgctgccggattgtacaccgaccaatgtggcacgctgcccagtacactaaggcagctggtttgtgccagaggcggttgcaataccattcggataacacctgaagctagacacccctgacacattataaagtgggaatccaatgatctgtgaagtgtacggtcgtcccaagcaaagcgacgaccagcgttcacagtgtttctgcgttcatctatgtagaatttcgtatatctggaacgacctgtcagctgcccgctggtcgaaaaatggcatcccaggcatctctcgaattatggttcttccacaagaaccagttcagggcagccactgcgggcgcttctacgaccattagcatgcgtgcctcctcttctgtgcacccaaggagtccttcgctacttgcagcttttcagactttagctccagatccaggtaatgcgtttagttccagagtactttgaacgtctgggcgtttggtcaaatacatacatcgcacgggtgtatcccgcgccgtggctagggatactacggtttgtgctttgcactacaaacataacatgttcctgctgtgttaacaagaacagcgggaagcaaaccagcaatgcatggtgaccgccgactcaaatatgcagtcagcaaaccgcgcaatggtgcaagagcccaaaccactccttgcatatttggtccatcatcattacactcttctgctcgtgttgactctatctccatgccaatagcttggctgacggcttctctgagaagcgcgtttgttgtttctactgctcacgcatcaccggagaaaatgcgtctaccgcatcttgatgagccagaaggcggcatccagaaaaagttgcgatgctgctatgtttcagatgttacatgcactacgttgcgcgatggggttttcttcggtgaaatgcccggatgttgcgagcatcgtagtggttttcccagaggcggcaacggccatctggtttctgaaaaatggtctagcgaaacacgtggctactaaagcgagtgtgcatctttattccgtcttgttcacaatgctgactagtgacctcaattgacctgagggagtgctcccgaagccgacgctcttcgctgtgccgagcacggaaaaacagaagtagcgtgccgcctggcgcgggacaggtcagctgattcttttcagatgactcatttgcggttatcttccaggaatgaagacgtttttttcttcaaatctgatttgttccgagagtattcttacgtaaaagttcacatgtgacggactcgccgccgctggactgcgcccctcaaggcatgcgtgcggactcgccacgacaacgcagacaagctactcccgacgagcagcgaagcagcattgtgtcttgccattttcttaaaagaaaaggcgggaaaaggacatttcaccgagacgtatgtattattttcaacccggcgtgaaacagcaacttccaggggtgtccatttctcgtcctccgaagaaactttcttcgcgcactttctcgggcgcctcgaccgccactgccgatcgacaccccggtgtcttcaaaagccgtcgaagctcgtctcgtcgtttcatcgcttccgccaaaaactctcgcgttttccaccatttcacctagaaa

SEQ ID NO: 3890 - DNA, 1659 bp, Toxoplasma gondii
cgtacgccttgtttatggcgattctatcgatgtccttcgacttcgtgccggagcgagtctcagagtcgccgtcagactcagacgcgaacagttcatgtgacccgccatttgcctcacaggtgacagcctcgtcaccagtagagtcgtctgcgtccgtcttcctcttccttcccttaactgaagcatgccccgtggtatctcttttcttgtcaccgtcgtcttcatccgactctttctcctcgtggcagccgacattcatttccagcagcctgctcttgttgttcttgtgagggactcctttgaacttcttcgcagcatggcgagacaatttgccagtagttttttcatccacagagacctgtgttgtctctgttttaccattcacagcggacgagcactcatcgccgaaagaatcgccttcctcagctaactttgttctctttttttccttcttccgtggttttccatgtgaagaatcagaagccccttcacttttggaacgtgacttcatagcactggcgcacccttcctcgtgtttgctagtccccatgtcggcgacatcttggtcaaagccatccggatggtgtcgctttttttttttctccattgtcacgcaaaatataactcagactgtttgtgtaccagaaaaaatctaccctttagtttcgtagccgttgcatggtttagtcgttttgacacctgtaaagcgtcttttagccaggactccgagaaaaactccgagtggctgcggctgcgcgtagaagcaggcaaaagcgagaggggggttgggaacagttggccactggctttggagacgagctgtgttcacagaaaagaagcgaaaattggagcgctttgagctggagcgggggcagcaacttctttttcaggggaggcgacccaaaatctatgcatgtcagcgttgtcacgagatagtcaacatttcctcagggcagcgaagagtcgggaacagcgcagcattgacatctccacaggattggtagctaaatttttagccagcagcaacttcatgccaccgacgaggttaacaataaagatatcgatagcgatttcggtacctctccaccggccgaggatgggatgtctccgtttcccctgccccgttctcgtctaaccttccggaaagcatgcaatgaaaacatgtattcatttgaggagggccagacagccccagaacggttagtcacacgcagtctgcacgctctcgtgagaacagaaacggatgaggcaaacagtgtgtaccgggttcgacgagcataacgtatcacgattctcgagtcaatgaagactgttaggacccatgagagtgcagggatatttcgttcttctacatttcgtctttcttatggcaatgctcctgcgctgcgcaactccggtatctggcatgcggaacgattttgcgggagagacgaacgcgaacattgtcaaaagctcgcggcaccgtccgagaagaacttgcgtgcatgcagtcggtccattcgccgtacggaaccgtaacgagacaaagcatgtgacaagttcgtgagcccagaatcgaaggtgtttgcaccacaactttcttctccacttccgcagccgtgcatatccgcacaaacagacatatttctgcactctgtccttgtctcttcttgtccacaa

SEQ ID NO: 3891 - DNA, 4654 bp, Toxoplasma gondii
agcctcaaatctctttcgccctcgtttattgcatgagtggttttcgacaattcgtccttcagtcccagcaggtctgaggccgctagacgaagtaaacacagagtttctcaagtcaggaaggcaagcacacgaacaaggtcggcagcgaatgccccccgttactgggtcgatgctgggggtcgactgagactctcgaacgtgaacgttttgggtcaacggggtgcactcggagtatctcggctcgacttcgagccggctgtgtttcgccggcactgtttggatgcagttttctaagatggacaaatctgtcttctcctttccattggaccgtttcccaacttcactgagaagagcgaaaacctttcagagtttccagggaattttctcaccaggtgcccacgaagattttcacgggaattgcggttttatcgcggttgtctttgccgggttcgggccggacgagctcgaagacttctggttcctttttggcggaaaagagggcgtctccctcgaccctgtcgctcctgactgtgtgcggactcttcctttgtcgcgcagactctgcatcctggagcatctggctggcatagcgtccggcggaaatcagttctccgtcgaaggtgccgtaccgcggcgggtactctaccttgcagcagccaaagtagtccaagaacgagaatggctgttcgcagaccactacgccgcatccctcggcagagagacagtccacagagaccgcgacgagaggtgtcacgacgcggcactcccaccgggtgccgtcgagttcagcctgtgtccctctgtctgacaacgccagacacgcgccatgcgggggttcctgcgccactttcgcggtttcaggtcgcgctctttctgccggatcttcatctggaaacaacgcgtcgactacaaggttcgccaggcagcactcgggcaactcggcggaccgccgtgcgcctttcgaaccataaggagtcgtttcgtgggtttctgaaccctcacgagtgctcgactcttcgtactccattgctcgaaacagccaacagggaacaacacgaaaaccgatgtctccacagagtcgcagtgctagaagcggctagcgcagggaccggcgttcctcgaagtccgcggaagacccggttaacgcagaaaaaagcggaaggcgcggggcagtttaccgccgtgttcgtgaaaaagagagcgacgcggaagacgggacggcttggtctcaaagagaagtcctgaaggtcgaaccccagagtctatgccagagccgctggcttctgctggggctgcaggtcgctgttgaaccctcttcgcggtgtaacgcgagcagggctggcacaaaaaagacagaatatgttcatgtttcgaaccgcgcgggacggaactgagatgaagcaccagacggaggaaagaggcgcgtagaacattcaggatacctctccaggatgcacacctgagcacacgctcaggatctcgctggagaaagtggcacgcagtttctccgttgtgccaggacgccgctctcagcagggaagaatgttcaaaacactaaagcactctacgcagcgctaaattccgcggcttcgaaagaacagtgtctcaaatatttactggctgttgagcctggcgtgtgaaggaacgtggctacttgccgcgcaagaaacatgtgggcttgtcgctccggttctccgagccacgtgccagcagactcgcggggccgttcagtccgcccctgtttcgtagagaggaaagttgcaccgccaatttataatggagagacgaaactcgcggaaatctaagtcaggagacaattcaccgcaaaaatctaggcagtccccccatttctgtatcgacaacgcggcgctgcataggcggcttgcgcgactgccaggaaaagcggaatctttcctagacggctcgcccagtcaaaagtggataatttagctcttaccatttgcgatgaaactcattattgcaacagcgcaagcagtcaggaggagattcggtgttatttcacgcgcacaggcaacgtgctaggaagcaaattggtgtcaacggtgcctctcattcgaaagtacgcttgcacgcgtagtcgctgcgcgagtctacgcgaaagggatttttaagctcacacggtgcagtgcctttccacctcgaatcttgaaagcttcgcttggattatctttcttgttcgagagcgtcttcatcagaagcatacacagtcgctgcctcatttaccgcgcaggtcgatgtacagcgtacaagaaactaacgggggttagaaccgatggggacagacagaaagcgcgtcgggtgagctttgcagtttgtcaagttgtaggtggcacagacagtgttgaacgcagatagttttcattccaggggctcgcatggtcgtagcgagggatgtggcggcacagtaaaacggaaaaaacaggggaagttgccacgtcactcaggacagggcaacaaaggtacaagcactgcggtaccacggacagaagaccactggaaccaggcagagtaataccattcgagtgatggtagagaagctcgtgatcagtctcgaccttgtttgagtttccagcttttgcccaagtggaggcggaatcgagtctaaaaagcggttaatgagaaatggttcatgtctgcgaaagcggagtctggtgttgtcagaaggcgaacacatcatagataaaggtcagcgaatattcaaggtaccataatcacataaattatgtatcaggctgtcgtgcggcttgttcaaggatcagaaaccatttcaaacgggcatgcttgtcacggcagcccaagcggagcttacatgaaccagcgtttgggtcagaaagatcgtgttagggaattggatccgggtagccaagatcctgacccaaactagtggtccagctcgcagtatatcctctccagaaattgcttatcggtacgtctgtctcagagaggattcctccctgtacggtgggactagtcacactcgcatatgagtagtaggtttctttcgccgttaatgcgagtggtgagaggaattgatgtgtttggacaccgcagttagcgatggactcagcaggtgccatcttgtctatggtgggtacaccgtttgtgagacctgctaacaagatacaaagatgcatgatttattccccaggtcacgaggaaatcctgacggcagtccgcggcttgtggcgattgttcacgtcgtagaagatgattcgacttattcgattgcattcagttgtgagacagaattccgaagcatccacgatccaccctcatctgcagacgactgacagcgccggacacgaagcggacgatgcggatgcctgttgactggcgacagcatgtgggggttttcaatggtgctggaaatgaacttgaactttcaatactgtgcaacatcctgttcgtgtttttctcccttattgctggccagccgtccctgaagcgctacgacgggctgagatattgttcccgcaacgtgtttgcaggcgtggacaaagcaaacgccactcaggctccgaagacaagtgcacaagtctaaaaactgtgtttccttgtctgccccgcaaagaggagggctttaaagtagaacgtaagcgaggcattgagccaattgcgctgctgcacacgttttatgggtgacaggggtacattagatggcgtgcagtgagcccctttgcgggaagtgtacactaaactattttccaccagagaaacctgtgtctgaacagcgctaatggatgcctgctaagcccttcttagacagccgttagcaaggaccgccttgatttcttcgacaaggagacaggttggccgtcgtctccaacgcagtcgtcacttcggccgacaggaagagttggcatgttcggagtatctacggctctaaccagcggcaacgagtgtttttccagccgtgtacgagtacatgttgttagggtggtcgccatacaacgtggttcgaaaatctgtcaccgaatctgtcaccgagaaattggaacatcgaaaagctaccgccaagaaactgcacaatcgaaaagctgctaccgagaaactgtaacgtctagaagctacaaccgagcatcgcttatcggtagccccggtagacaacagtagagacataagagcgccagattgttcttgtgagcattttcgtttcaccgattggcgtgttttcaaggagcgccacctccagcgttgcttcaccggacgttcgatatgtgtacactatagaaactttctttaggggtcactcttcgtgacaatcatttctaagaagacggggatacagcgtataagcaaggcaggggaacctcacagatgggacagaagagtgatcgcttatggaaagacgacagattatgagcaccgcggtggctgccgttatgcaggaggcgtgttcgtgtgctctctcgctcaatgtgtcccacttcgcccgacaggagatttgcttgcatggactcatgagttcttccacaccgtatcatctgcttaacggaggttttgacagcaaaggggttgaaaaactgatcaactgcgagacggcaaccacaggttgccggtactgacagcaatttgtggtaagtgcgcaaacacgcaagcgtctcccatcccgccggctgtctcaccaacggga

SEQ ID NO: 3892 - DNA, 1779 bp, Toxoplasma gondii
ttttgagtctggtgtaaactattgggtttcgccttgtggaagcatcaagcacgggcattctcctgtcaagacatgttttactgcaggttcagtaaacaagaatgttactttagcagtgagttgtagtgatgcaatcaccggtagcgaaaagtgatgtcgcacccctcacagtcaaagggaacgtgtcgtaacgagggcgggtggctcttcgccgagtaccatcactggaaatagaaaaattcgctctacaagtagtaccaatcacagaatcagggaaggacttgcggagatgtagtttcgtagtaccagaacgagggaagattcgatggctgtgacttccgtttttcgcttttgcgtcctgcgtttgtactcggtcagactgtgtagtcagtttgatcctaggagatgttttccgcgtgtctcgtttagcgaacttcgaaaggacttttttggcacgaagcttttcggaaacagagtgaactaacgccgcagctgccatgattgccggacggcaagagaaatgccttagtcgcgtcgtacttgtctcgtacctgcagtggagttacgactgctactggtgcccctgtagctgttgacgaattagagggatgattgataacgggactcgcgctgatgttacacaccagcataaaaggcactgtaggactagcggtttcagcacgagtgtcgggtttgcaggcagcagtttttgtttcctcttccaaagctacttttcccatggattcaagcctattgacatgtagtatgcactggcctcagtcagctagtcatcctttggggcagcaggggctgaatacaattggctgtcggtcaacgacggggcgtatgtctgccttcccgcttcctcgaaagctgtaaaaataagacgaaaacatcccgctgacagcacttgagatacgcccacaagtgtccactggcctttcgacagacaagccaaggtcacctttcacgtacatttcacgcaaggaagaacatctaggcagagaggcacagccacttgcttggcaccaatgactaaacgagaggttcttctgctgttagacagagcccctatggcggtacaaatcatgtgactaaagccctctgctcctttctttctctgcagacaatatgccggtctacatatattcggtaaactccgtgggtcttcccagcaaatatgtcctctctcgaaagacgacgttccagttcacagccgctgttgccatttttccgttcagagccccaggaagtttctcctcaaatagaggtcaccaaagctgaaccgtcttcgttctgcaacgatagaagctaaactttttcctactagagtagccccacattaggccgcctcaataatgtaccactggacagcgtctgcagccgtctttaacagacgggacagcgttgcatgcagttacgcacatgcacacgtgtgccaacaacgtttgcttgtgaattaatcggtttttcactcgcgccgcagaggcgttttcctccccgcattgtcgtttctttttggaaaccctgccttatctttgttcagtgaggcagggacgaaaatagtttgccttcattgtcgtcactgctgctgtgcagtttcttgttgtcaattccactcgtgctactaatcctcgttcaacgtgtgtcccgccaccgagccggtacacccttttccctcccgagtccagaaggagctcaagcttccttcttgcttttgccgccctcgtttcatccttttttcttaatctgtgggtcgttttccgccaaagaaagcca

SEQ ID NO: 3893 - DNA, 1907 bp, Toxoplasma gondii
gccaccgagagagaagcgatgggtagagaagcctttcccactgcaatgatagaagctgcatttacaatcagacagtcgctgaagtatgtgcggcggctcgagtgagcatcatctgataccaatgaagctgaaagtctactcgatgtgcgcccgaacttccgaggcctttttcaccatgctttggaacttatcaatgcttgggctgttgcttttacacagggaaaaagcctttccagttaaaaaaagatcatgtcgtatcctcttttatggtgtctgtttcatttttggaggctgcgctcttggaaatgctcacgaaggtggggccttcgatcagtgctttgaccaagtgtcagtgtacaaaacccagcggatggtgccggttcaaatggaggtactagaaaacttctgaccgctaatcgtctggagtttccgctagaatccaatgccacgcagagtacagtattcctgccgtgctgagaaatctcagcattagatgcaaactgggtatgtatgaattctgtcttctcgacaggatatatactgtcaacaccgatgtgtggcacgaggagacaacactcactgctggtcacgtgtgtggtagtcagttaagcgtagcgaggatcccacgaaaacagatgacagctgttatttaatccatcagcgatgtgagctctcccaaaatccatcttgcttcgttattggggacgcatcttctgcagactaccactggcaggtcaatacactctgctgttagagtgtcgttctggaaattgtctccatctatacttgacgcattcggcggtctcggcggcagtgcgatgaagcatcacgttcaagtctcatacgtcacacccgaacaaggggcccctgcaagggtccgtccagttcatgtgtaagcatctgtcgccgtatgctccgacggtcgggtagttctagcgaaaagataagaagcaaggcggacatatacagaccagccatagggtgccgtccctgtcacctggtttagacagttctgtatcgatcggcttgccatgattttctctccaagttatggcatttctcatgtagatcgtttcaagacacgacaagtgagtactgaagtgtaaccgggatacgcagccgttcaacaccatgttgaagggggagagagtcttgtcccttcagggtgacaacgttgtgcagatccgtacatgctatcagccttgtttggtcggtgagtgtaagattttttgtacgtcattgcgtctatcgtcccgcgtcggcgttgctgtctgcagcgcatcgtggcctggcgccgacttcactaagcccaggagtgttccgccgagtcataaattacctcttcacataacaggcacgtgtacccgacagcggtgtacaacaaaacatgcgcctttgtgcttcggcatacttcctggaaggagagagcgtcggcagttccacagtaatacaacgtgcttgtcgacgctggagagttgcaaaagaaatttgtggaagctgcgcggatgtattccacttaaagtgcaactcttccctttgtttaatttttttgtgaaggatgggaaggactgtcgtttcaaaataatgttcatgtctgtcttttgttcaaaatttgttgattgcactgattcacgaatcatcgcctcgtccgatgcctcttgtgactaggtcaccggtgtccgtatactgttccaaccgagcaacgagccacattgggctcagctcgatgctgagtcatcgtatgagtccaccaataggcgcccacgatttcagcggctctttactcagattcctgcctcgttaaagacgtactggtgcccaggaataatagttgtgaatttggtacttctcatgagaaccgcattgcctgattacgaaccccaggctgaagatattactgtagaaca

SEQ ID NO: 3894 - DNA, 2632 bp, Toxoplasma gondii
tgtgtctctatgtctgcatgtctccgtgtaaatacattcatgtctgggtgtggtgcgtcgaaatatttgaatgcctggcgagcagccgctgccaaagtacatgcggcatatgtactccttctatgtggatttttcgcaagtgtacgcactgtctatcactccagaaaaggcgaatcgcgtgacggccagtcggggactgcagtccaccgggcgcctgtctctcgtcaactctttgtaaccgaagttttagcgagtcgcttttccgctgtccacttctctggaactcgactcagtcaggaccgcaaaaggtcctgctgcttctctgcctctctgtggggagattgagttctgtctcacagagactgcgacgactcgtcggacctcggcgagcctgtctgctcggtgaagcctcgagtgatgcaaggcagtgaggagctgagcgacctcgcaacggtctgttgctcgtggagcgccgctcctctccctccgagagacgagaacatccgactcgcgagacttccccggccgctttttcgtcgggtgtgtcggaaagagggctaccgcatgctccattcgttttcacctttcgtattcaccccattctccgaagttcgatcgaagacaactggcatccacagagagaggacgaagacaggcgcctccgctttttttcgactggaaaggtgactcggggactctcaactgtgtcgcggcgcggccgctcgtccgttcgtttcctcaaaagctgtggggtgcgcagctcccctgtcggcggagaggcaaaagcttggcagcctcctgctcatgaacttggttcaaagaacgtacaaagacacggcacaagctggcaggcggaaagcgtccggatcgcgctgcggctccttcgtttatctcactcgcaacttgcgcgtttccgcgatcgagtcgaagccctgtgcacttgaacgaccttatgctggagctccggcgatgcggccgcagaaaaacttcaacagagaacggtctgtcgagatggcacacatgctcgagaagaaagagccagcttttgtcttggcagtgaatgtatgggaagcgcgcgcaccgggcgcgctgaaagaggcagaaaaacctgtgcaggagcgctgaaacgaagccactgtaaacgtcgtgatggcgcgcgcgcggcctctagaggacaaagagctccagcaacctgctgctccgagaaccctctgtgaagccgcggaactgacgagtcgctcctcacctctgcaagcgcgattggagagtccacatgcagcagctgcaactgcgtgtgaacagtcgaaccagacgcgcgtgacggccgctggctccgccgagagtctgcaagtttcgcgaaaaaaaggaaccacctcagtgtgcgcgctttggacttgcttcgctgcttttctcgagctccaaaaagaggaaaaaacctgcagtgcgcgaggaaagttgcccctcctgcgccagtgccgcgagccgcgccttttcctgcccgcctatatgctgagagaggcggtcggcgagggaaaaagaacgcgtcttcgagccattcgcttcgactgtcgctcgacgtctttcgcgccaatctccagttcgctcgcttgcgcagttcctcattctccctcgttttttccatccccgcagaaccgcccccgcggcatctcctcacgcggttccgttccctcgtcgcgccttttgagttaaaaggcctctcaaaatcgatcttttccagagttcgaaaagccatcctgtctcggttcttcttccgcgtctgcttgcctgcgctctccccagctcacgcgagctctgcagcacaacgaggcgacgccaaccttctgaggctgcttcctctctgtttctctccgacgctccacggcttcgtcagaacatctctgccgcagtctctcgttagactcgcgaaacatctcagccgtacttcgctctctggcttcgcttctgctcgagtatatatgcaacctccctctgcacaggcgcatgcagctcttcaaatatccaggtacgtggatagacgcacttacatgcagggaacgaaggacgtagaaaggtgagtgcgtttcttgtttgaggcggaggaaagtcgatttgaagagccggagccgcgtttcgatggaggaggacgccctgcggtgtttcttccggtgtgtatgtactcgttctctcgctcgcttctgcttccttcagatttctcccgcggctttccgatttcctcctctggcgcggcggctgtccatcatctttcccctctgtctggggcatgttcttcttcctcgttttttcgtctggctcctcacctttgctctctcggagacaggcgccctggtctctccttttcagggcgcctttcgacttcttttcgacaaagttttcgtcgctctcgcctccctcagagaacagtcttctcctacgaagttccctcctcctcagctttcttctctcgacctccatccctccgttcttctcttctgcctttctctctcgcgtcctcttctctctgttctcttcctcgtctctcttcctctcttaccagaactgaggttcgttgcccggcctccctcacttgtcgtcaccgatttctcctgcacacgagctgcttctttttttcgca

SEQ ID NO: 3895 - DNA, 1870 bp, Toxoplasma gondii
cacctccgccgtattcgttcgaggaaaacgggaggcgcgagaattgctcagagcctcaagactgcatgttttctcctgaacgcggtgcatgtctctatccggggagtgggggcgacgcctcacatgtgcagccgggacaagttcaactccacgacgatttccaagtcgtcctcctcgacgagagagacttttttttgtgacagaaaatgtttcttgccactggggctttgcttgcttgtctacgttcggggatgtttttctcttgagttgtttcgcttcgcgtttcgctcttctatctgggtttcggaaggtttctcgtttcgtttcttgcctagagggcgcgtcccgattcggagtctccttctctctatccgcgtttgtgtttttgcctcgacgtcgaggaccgtttctctgctgtgttcgtctttgatttccggcgtctggcgacaaacgcgcgcgagtctgcgaagctagacgcaggtcctcactcgagaaaaaggatggcccgcgctcagcgagtcgttctctgtaggctccgaaccgcacgcagagtcgtcttctcgcgacagacagcactacgtggatatgtataccggaagggatgcaaatgaacatctacgtgaccaatagagacagataatcagatgtcgatagattgacagataggcatagatcgatatatatagatagatataggtagatggatactgatagattgatggatagatgcagagagatgtagatatagatagacagacagacagatagacacaaatatatatatatatatatatgagtttagggtgtccgcagcctcactttcgacgtgtggtggatttcctctttccccagttatttgccaaccagacaaatgccatggattggcaacgcgttgccctgcgttttcttgctggattcatgagagacgttgactggatggactatctccacacaacagagcacaaggtcataaatttttgtggtggcgtgtaaatgaggtgaagtcctaactaatccacctattgcggtccgcaccctcgacaactgaaaaaacggggagaaactccaggaaacactgttgaagacatggccttcctcgtgacgaacatccatgaacgctagcatggatagtgatcaaccgccctgcgacgtattccgtagaaacaaaaaattgggcaggagactaccaacgtgcgtatccttgtacagcttaatatctgagttgtgcttttctctccctgctaatgcgacagactgccgtttatttatttcatttgatccatcacaactgtaaacagacagatgtcggtatgtctcttcgtcgtgtgtgtctcgtaaagatggcctgctggctgcggagacagcacggagtttgagaatgtgaggggtatggcatccgagaacatggacgtcgacgaagagcgcggaagagacgaatcacccgcgaaggatcaacagatcaaacagaagaaactgtctttcgtttgcgtgctatcgtccgtatgtgcgtccatggtataaagactcaagacttgcatgacgccgtcgcccgcgtcgagagaggcggaggagaaacgcgacggcagtcgcttcagctgccggactggactctgcaaaaacacgctttcttctttcgtttttcttcttccgtgaaaactcctctttctcgcttggcgacgcggaatcgtctggtggacgtcgagctgagaggtatccgccgagggctctccgctctggacgttcttcggagctccttctgcggcgaaaaagcatggtttgccgtaagagacgttctctgtctgtccactgttgaaaggtcgaagacaacgaacgaaacagagaccaaaaggaggaaggcgaccgtggacga

SEQ ID NO: 3896 - DNA, 4970 bp, Toxoplasma gondii
tctcgtaaggtttccaccctcgtggtgacaattaattcccttcaaaatctctctgtctcaatgctcttcttcgcgcgaacccagaaggccacgggacccgccttaccctctgctgcacttcggccacgggcgatgtcggttcttcttgagacacgcggcgggtcccctcaaatcccacactcgcctcaagcgcggacgtcttcgcaacggcggcagcaagtcccgaagcactgcccctcgcccccggagactcggttacgcccacacccgactctccggcgtcgaggcgcttcgggccccccgtggtagcgagcaacttggcaaggcggccttccgcggttagaggccctgcggcgtgtcgcgacgcagccacgggtgtagcgtcgtcggcagttccggcactgtctcgccgtctcttgacagaggctcgtcttgagcttcggccctcatcccctctgctttgaaccgctccaactgcgatctttgaatcagcagctcgaggagttcggactcgagcaggagcagtctcctgcaaggcccgagtgccccgggggcccgcagtcccgggggtctgccctggcgcagacaaggggagaacaagcgacgtttgagaagcggctacggggttgcattgaggaaggactggtgcgaacgggaaacctgaccagcttgctgccgcggagtcctgggaagacagctgtcctgccacaggcaaggcagcgacatcggagcctccagtgcgatgccgagagactgacacggcgtgttgagccggcttgaatccggaggccccccctgaggatacagagtcggtgtcagcagactgcgccaccgcttgctgctggagtcgctcagctgccagcaaaagcgtttgctgactgggaagtgcgccgtaagtctgagaccacaagggggaaaagatccaatctcaaaggtcaggccactatgcaggcgcatgcagaaactgtgtgctcaaaagacaaatgcatcaccaaaagtccccttgtatgtgttgtaatacgtctgaccagcgtaggagataaccaagctgtctccaaggctcaaatgacgggtgatatctaatgggacgcaaaggaggcacccattaaaaacacagaaaaaaactggacaaccccgctgtgtacgcagaactatgtgcaatgtgtgtgaaagagccgttcacatgacgtaacaaatacaaaggacgccgaagattgtgtctgcaagtatgccgtgttatggatatgtccttttacgaaacacaattttcgggagacgcacacacaattctacaacgtgctagaggactagactatcgtggaagagacacgaacctggacaaagcgaatgaaacactcggcgagacactttgccttctcgtagccgtagtactttgcggaatacgtccgcatgcaccgtcggccgtcttggtagtaccgagttctccactcctgaacagaaaagccaaacaacaaacaagacgaattatcggatcacccaacgacagacctgcccccctcccggatgaaaacaaattaggaactcccaggcagatccatgccacaagcaatccccttgtttctcgcgcgcatctccttaactggttattttacggtctagcaccagcacgccacagtctccctggtgcctttgcccccgcggagcatcacacgagacgtcatccaaaaccccacagccaagcaaaccttccgttccgctacagccggtctccatactaactaaacagacaagaacggtaacgacaaaagtcgcgactcacttgtttgtcagggtggtaagatgccttgttattcccaatgaacactgtcctcggtttctcgccaactcccgcagcctggcccttctcttgagaacccacagcggctgcagccgcgtcgcttccactccttgccaggctgcggcctgttccccctcctcgcttcacttgaccagcgtgagctcctcgccccgtggaagtgcaagcgctgagaccggcggctgtctgtggagtgagcggtgcgtctgtccgcacgcgtgactccatctgggtgcgctctgcgggcagaggctgggtgaacggcagcacgccaaggggctgggtagtcgacgcgcgtgagcacgtcgtgatttgagcgtttgcgaaggctgacagattagctgctccagcagtggagactggcatctgccgagccaactgttgtgcctggagttgctggaaaaacagcaacaaagcggtctcgtcccgccgcttgtcctctggtgtggcgggagcgccgtgctgggactgaaggagacaggagagcgccgctagctcggctgccgcattcgccgaacccccgtgggtcggagacatgcctgcaggtactccccggggccgcaacgcagcaaaggcctcacgtgtctcctgactaggggccacagagacccctccgacggagacactgggtttccctgcgtccgatttcaagtcacccagaacagacaaagggtcgacgcggttggtgacggcgacgccctggtttctggtgaggagttggtgccactgctccttctgggagagaaagacagcgagtccgtctcctggagctccagggggcagtactcctgacgccgcgagaaatcctgcagggtcgatgtgagagggagatctggttgacgagtcggaagcggactcgatgcctcccatagatgtggcacagttgatcgcagcagctgagaaggcactgctgccgctggtgcctcccgaggtcgcggcggacggtgaggcgtctggactcgtcgtgcagttcgtcgaacacgaggaaggggtcgcgtcgacggcgttgacaggagtcagcaaaccactgtcgtctttgcaaaccgccaacatgcacggctgcgacggaatgggaggaaacccacggggggcaggggttaacggttggcactccatggcgccagctcctgcacgcttcacactagttcgtaccggagccggggcaccgagaggcccggagatgggcacccgtgcggaaaccttgaacaatgaagatctaaacagtttcccagtcagtgcgctgacgatgtctcaaggtgcgggcctcacgaagcgtcgacctccactgtcccctggccgcaaggcaccggggtcgaggcgagactgaagggtttctcgctgtttaggaaggcgaagaaacgcgaaaacaccgacaatagacaagagaacgcggcaacggaaggttgcagagcaagacggcaaaaaagcagtgcctgcaaacactgcttcctgaccttgtcaggcgttcacatgcaacacggtaaaggattgcaacacgaacaccagaggagctcaaacttctatcaatacacagacgttcctcctatcttttcgtgatggggggacagggtgtgatgtgagtctccgtgtttcacaagagttccaggtaattaaaacagattagccgtaaattcagcggccgggagacgatacctcttcactaacggactgaagaaaacacagtgccggtggtgtggataccgtagggagagacgcgcatgcaacatcccacatacgcgaaaacgtgttgtgagctataagcgatctcgctattcgaaagcggtcagtgctgcggaactgtttttccgtcccgagtgcctccagaagtggaactgcaccagcagccaacaccgacacgccgtgagctggtgtagaccggaaaagtacgccacgctctcgaatgagttttgcaatttttcctcgatgatcaaaaaaacttgcgaattttgatatcaaaactcacgtactggaggccgagagcgacgaaagggtgcaacagcaccagccgacatctacgaacaagcacacctcaagaaccagcggtttatggactgactcctgagtgttggttttctccaacacagaaaactggagggacgtaatacgcgtccacacacataacgaaacgaaacagcacacgtattcggacagcttctgtgatctcgcgtatatggcacgaggaaggactgtccttcggacagcgtgactcaaaaggccgaatcccgaggaggaaacaaacttgacagaattaggaagaatcggcaagtgaggaataacttccggtgagcggaatggaatagtaaaggttctttaagcaacgcgagaattcatcctctccgcaacgcagcggcgggagggagggcggagggagaaacgacagtgtcgtcgaaacgcgctcggacagtgcgtttcagacccgccaaaccgtcgagccgacgcggaaaaagtggagaaatccaaaggagtgggtttttcccaccggaaaagaaaatatgttccgacaggatcggccacagcgaggggcattcggagggcaaaacccccagcgaccgggctgccttgaaaaaaggggtgcgtgcgtccgaatctaatcgacggaagatgagagagggccggcgaacaatggcagaaggtgttgggaacacgtgcacagagtcgtggcattgaaggaaaatgaatcaactcaccccccgaatcctgtgtatcccgtatcgctagtcattctattccgatctttacgctgggaaattcaaaaagactctgacgaagtgagcaacagtatccgtctcacatctctgcttcgctttgccactcagcactctacaacagtggcggagcccctccaccatatcgccctcctcgggttgagaaaccacgcgacctccaatttcgctggcgacggagtgtacagagtacccacacttgttcctccaaaaaaacaacacccatttcatgcgcgacactctgcagccctccttccctccggcctctgctctggtgggcgggacagggagggcgggaagtgtgttagcgcgctaaccccgataccagagcgacgtggccccattgacgaatggctggtatgctgatcctggccctcattccttcggactcccagtcttcaggtggcactgtcagcgcgacccccgcagga

SEQ ID NO: 3897 - DNA, 709 bp, Toxoplasma gondii
gagaagaagccagaacaagcgttcgcggaagcgaagaagaagaggaagaagaggaagaagaggaagaggaagatgaggaagaagaggaagaagaggaagaaggaagaaggtcaaggcgaagaggaggtagagggggggcagctagaagttgttgaagagaacaagcaggagaagcaatgcgacgagggtggtgacgaaagagccgagacgaagaggacagcggttggcagtttgcttgaaaagcagaagtcttcgaccgcggagagaggggagaggagggagaggggggagatgagggaaggggattacaggaggaggatcttgtgaagccatcgttccgtgaggccactagcgactcacaagctgcgtgaggcactgaagtctgctgggcgtgaggaggcgaagtcacagacaaagaggagggaggaaatagagcggaaggaaaagaggaagacgagacagatgaagggagagagggggatgaagagcgtggtagtttctcttcttctcctgcggcctttggaagaggcgaggccgactcaggtggagtctgggttgtctcgtcagtgccgttggtctccatgtttgccaaagaggcggtgaagaggaaatggaagaggagccggacctcgagaaacggctctcttcaatgaagcgcatgagcaagtgtgtccagttattaagaaggaaacatttaccaaaatccaca

SEQ ID NO: 3898 - DNA, 2334 bp, Toxoplasma gondii
tccttttccgacggttgtcagattgtcgacgcgtttctatacgtttctctacctctctgtgtcgacccgttgacgtaaatccttgtcagaatcgcatttacctctctctgtctctctctacacttcgagctccctagggtctctttctgtttctttctgcggcttcgtttctgtatctttatctccaagggagaacgcgatttcctggcgcgctggaagcaaggacagaagattccagttcgcttctcttgctagaccgtttttttcgtcctctcctccaagctcgcgcgtcgtcggtctcctttccagttccaggtgctccaaggttccttcctctcggtgacttccatgcagacccccggtgctcatctcctgtgtttgttctgctttctccggtaaacagaccatctgcatcagcgtgcatgcagtcggaggacgcctaccttgtcttctgacttttgatgtttttttttcccttggtgaaagctctcgattttctcctgcatgcatgcatcctcgctcagatcccagtgcccagtgtgtggccggcgtctccgttttcccctccgcttcctgtttctactctctccttttctctctcctctctttcatcctgcctctttctcaaggaaaaaacagagtagagagatcctcttttcaccacagtctctttgtacgctgtccaaaaggaactcaaggcgacatgagctcgagcgctgcggcgtctctaaggggcacgctctcgtcgacgacagcttcaccctcctctgtagcgaaggagactcttagcccacacaagctttttacgccacaaacgcgaaccccgaatataagccgttcatgcctccgccactgcgcctgtgtagcgggaccgctcgtgtagaggcttttgagctctggaaatctgtggatgcacaagaatggatttggcagtccgaatcctggaacatggtcgagaagtccgtcgcctccacaggtgtcagagaatagaagcctcgcctctgctggagggtggaagagacagaaaccggttgtttgcaattcgaaagtgaaaaaagacaagatttcagcgagagacaacacgggcaaatattcaggactcggaaaatctgagtgaaacgagcagctgctgttgaaacgtagagaggattctgaaaacgaagaaggatgtttcaaaattgaggaagtctgaacagagacaacagcagcggttgcttcttgtgggctctatctttgttgagagtttagggtgctctcgatgcatgcaagtccactgcgtcgaggcgtcagcgcctgcccgtctgtgccatgagaggtttctgtgagacttgcaagctcttctgctttacagggtcgttgtcttctaggaatgcattctgttgacagagaaggatctcgacatcgtttttgcttgtcctcacatcggaccaaaccagcctttcgattctcctcgagggtggcttcaactacttaaatgcagggagaagatacgcggaagtttcgatgcagtaaatatatatatatataagtatatatatatatatatatatataaataatagcccatatattgtatgcgcacgcgcctgcagatagtatatataggtgtacacatgtaaacgtggatttatggaatgccagcgcggacgggagtgtggtgtaaactggccaatggaagatcggagaggaggaagacatttgtgttctttgtacttttgtcttcctttgtggcatgctgtattcgttggtgagcgccagagtctcgcggctttgcggcgcatcgcaaaagttgcatttgaaaggaggcacgtaaccggtcgaagtagaccagctccgcttttttttttcaaattcgctcgaacataaaagagaattacgcttctcggtgattacggctcgacgccgaagtctcgagaagtcacttggttgcatgcgcccactggtccttggctagtcagtcgctctcccgcttttcccagtgaacagctttcgtgtcgatttttttcttcgttctcatgggactttgtttttcctttcgtttcttccaccgggaagccgcagaaacgcttcggtccgccgcctgcaccctccctttctcggcgagactgtcctgtgtgccgcgccgttgcttggaatgccacaggctttgtgtgtctccgttcctccatttttgagcacatccacagacatccacttttccgtctcttttccttggttcttctcgcccgttcccgcgcttgcttttctgtcttcacctttcctcttctcgtcctcggtactggttgtcttcttcctcatgccgtgacgtctcttccttctgcgatctttctcgcga

SEQ ID NO: 3899 - DNA, 3347 bp, Toxoplasma gondii
gaagtattctgtccgttcttcggctcaatatcagcgagttctacgcgattacaaccgagaggaagacccaccagaggcggatacataacgcaggccatgacctggagaaaaatgaacatggcaaacaccgttgtatttctcattaagcttgtcttttcaaagtacatctgttcaccattcacgtgacctgactcctgtaactcaaacagcatgacaataactgttttcgcatatgtaaagtcgtgaggagacgaatgatgacatcttacgggttctgccaaaacaatgctccagaaaagtcaagcacacactctaacacgccaacttccccttaacggcgacacctgcgaggtgcacacatgaggacggtgcaatgtagaactcttcttcgaccagaaccatcgccggtgacggtgttctgttctaggctggcgtccaacctcttgagcatacagaggctgcgatgatctctgggtttcaggagcaacaggaagtagacgacaacctatctcttccggaagtgttctgacacgcaaagctcaggtgcttgtaagttctgctatcaaccgattcatccttcattgagaaaacgtggacctctgctttctcaccactccttactgtatccagctcgtgcgatgcaacgcatcggttaccgcggcttccatttggcgctcacctgcctataaaacgaaatgggtcgttgtccgagagcttgcggatccccaatattggcaaatatcaactttttgaagttaagacaattcggggattttgttaattgctcttgcagctccagagcacggcgcacggtcacgccgcgcaccgcatactgcaggtaagaaaagaggaacaaaagcacggcagctgaagcggactgtaaaataacctgtgtcaatatgcgaacatgcctaagtccagttatgtatacctgataacaacaaaaccgaaaatgcgtcagtctaaaacagaggtgaccagccgtcccagtgaagctgcaacgcaccttgcattccacaacacgttctggcagagaacacatcgataacgttggctggcgacttagacgatgtcgattttccatgtcaacatcgtctgccaagtgactgcggtgccgatgcaacaaggttccactgccattctcgcgacagtgtgtctccatggtggcgatcgcagactggggcggtgggttctccgcatttacggggttacttggtgctggtgctactgattgtggaagtgacccgttcgaagtcttcgcaggacaagaactgttaactccctcaagcgtctctggcatcggcgccgccctgccacggacaaacttaggcatcatgctaaaatgctgtttcgtagacacaaactgggaacggccaaaaacgccaatgaaaaatcgtttccggtacgcgcaaacaaatggtgaatttagactgtcaaaaaggtgaaagaactgcatgagtcaaaaggaacaccggggacaccagctctggaaaaccaactgcgaagggatacaaacacggacgccaaagggtcaaaaaaacggttctagacatttatatgtcggagacagagtatacagcgcgatgccgagagcagatgtgcctgcagccaacatttcgcgtattcgtctcgtgacgataaacgcgcgtgagacgcgacagcccctggctggcaccctgctacctgggaagttcgggtgaggttgagcatagcggtgacccgctcctttctgcaggaactcgtgatgctcttttctttggttatacactggaaacactcctttacaatacaatcgtaagtgctgctttctctctcacgaacagtgcctcgctttgtcttgacacgctctgcaacgtgggttgatgaactcgcgaggcacggtagtcgatgtcatctgcccaccaaaggccgcaagtatccttcccggcctgatacccattcgtacgggatgcattacaagccaagagaaagaagtattcgcttgtctctttggggaaaacatatcttctgttacttttaaaatccctgcacgaggtgtgctggaccatctaaacccaatatcgagtctgcaatgttgtattgtagtcgcgtaagtggacagatgtgttgcttaggtaaacatttatagaagtaggctgtacacacatgtttgaatactaaaaaaagagaggaaatgtgtatgtatgtagccatgtccattaggcgtgacattcgtcattaactctggagttataacactcttttcctcgagttgcactaccggtctacgtgtactgaaagatatggaccattttcccctttgcgtcaatattctgcatccccaactggtttaaaaccgcttacttcacactggggttccttctggcatttccattcttttttcaaactggccaccttcctgttagccgcaagctacagcacggagggagtcagaggtagagtgcgcgttccgttgcccagcgtaggctgccgaggaccagcagagtggggattcttcgcatgcacatcatactcagaaggcagagattcgatcttctgaattcgcaatcgtaaactttttcgcgagacccaacaagaaaagtggtggcccttttggcggatgaagtgctcttttcactgcgtacgtgatgaagggacggttcctttctgtggatggacgctctgtttttctgaaccatacacctcacttcccggcggaaactggagcaggacagcgcgtaattcagggcgcgaatgttcgtcgggggaaagtgcggacaatcccttccaaaatttgtcatactttgtttgcaggggaaagagggcgtgatgcggcgtaggatatgaagtatctcgacgacaaccgaagaagtgacacgccggctacctattttccatgacatagctctcatgcgagtttcagaatcaagcttctggcttcatcacattcggagcctcgtaccgtagctcgcatttcagagttttccgagactgcatttgtgtgtttcgagcgttgtttctcaaaacagctgcctcgtctcttctctgcagctcaaccgtcggcaaacaaagtggcttcgcgaggcaaaacggaggcaaataagggatggactctctatttacctaggacagtacgcatttgttagtcaagataaggccctccgcaagagaggcgccggtgacttcatcgttgcttctgtcgttctttttgcgcttgagaccccgctgcatgtgatttcaccaggggtggaggcgttctcacgaccgatactcagagggtttccaccttttctccaccgtatgcagatttacgtctctacacacaactagttgatgttgtgagctgcacgcttgtcgttccgatagaa

SEQ ID NO: 3900 - DNA, 2768 bp, Toxoplasma gondii
acacaagtctccatgtcgaaagaaggcgttttaattgcggcatctttccttcttgctctgggtatctctgccccttcctctttgcttccctctcccgttctgcccttttcgttcgcctttttcggatatgttgcagaactgctcttgcctgtcgacgaggagataggcgtagttgtcagagagggtcggaacgagcatcacatctgcaacttgcgccggatcctgcgagaagagaagggagggcaccgacgagagaagatcacagggaatcactgcgtggagatgcagacatgcgcgacgccagaggtcggccctgctgtgacaatgagggaggagcgagcagttgccgggtatcgagcaagtcgatatgttcttgcctcctcaaaaaagggtggtaaacgaatgtaggtgcggcgcacagagaaaggacgaggatccactgcagcgaaaaaagggagaaaacgcagaacaacacaggaacgagaagcgaaaagcgacggctcggagtgagacacacgaaaaaaggcacttctcgagtgtacggacaccgcctgcgcagaacggcctcgcggtggggtgtacgtccaccggagcgagtccgtttcctggacaggcacggagatctcaccaacggatcgaagccgttcatatgcgtcgccatggcgtttctttccgcgtttgcagaacgcgaggagagagccgcggagggaggaactgccgcagagtggagactgcgcgagtagcagaagccgggctgcgcttcgcctccagcgctcgcgggaggtgtagtgacacctgagagcctgagggtgtcggcgaggccggcggaaggcggcaagagcgaaggaagtcgagcagagagcgctctgtctgtgcagcgaagaggcagggaggctgacctgttcaagaagagaagcgaggagcagaagaacgcaaaagctgctcgggacgactgcgaacccggtgcacacacaccggccgcagcggtcgggacggaagagaagcgacttcttgtcgccgacgcagaggacgcgggggcgcacagcagcgaggacgcaaacagagaggaggcaccgcgagagaactggagaggcgacggcgaaaaagaacaactcgagagtgacgcgcgacccatggagctcgacggacatacggacgcgagcgacaagagagcctttggctgcatgcgcgaagaacggctctagtggcacaagacaccacgaatgaacacacaggtgagcacgagacacagtcgctacttttgcaaacagagctctggcgcgttctaccgcagcagcttgcgttcaggtgctctcccgagcttctcaggcagcgaggtaacagatccaagctcagacacacacaaactggcgcatgtctgcgaatatgttgagtcgcatttgctgcatgcagtaagatggacttgagtgcacaacgactcgtcgttttgtgtgtgttttcttgtatctgcgtgtctctcgaacgaatgcagggagagacgttgagagaaagaagggagcctttgtcatgcgcaccgtctgcccgctcaagctgtcggatgtcctggaaatgtctcctctctaaagagaaaaaaacgacgagagagccaagcaagcctgcttttctggactctacgagacacccctcctttgctcaccaaaaaggcaccgttcaaccagcagcctcgagcaccgcgcatgcggcgcgtccgctgccgcaaaaacgtttcgagccaagcggaaacaggcctttcttcgcgtttcgaaagtgaatcgactgctcgcgctcctcaaaagaccaatgcacggtaagacaagttgctgaatccaactggggctacataaatacacataatacatatatacgtttatatatataaatatatataggtgcagacagtgaagttgacgcgcacatcatcgcttctttacacacgtaatctacgtggttgcctgtgcctccaaatatccgtgaaactcgacagccctccctgccgagaatgcaacgggcacacgggagattcagccttccttctttattttcttgtgaaaagtctaaaacttgtctcctcggactctgcgcgaagtacggaactcgcccggtgggacgactgccggacgaggctgcagaccttgtgtccgcggaccgtaatgagaggggctgtttcctcagcaaaagagaggaactcctcggaggaagcgaaatctctggacgacgttggacggttgcttaaatgcacattaaggtgtagagggaaaaatgctttttcactggcattcttccggtgtgcacagagaaatcccccttttccgcgacagcttcgatcgacgcccactcaaaatctctcgctggcgcctccctgtcgacccggctgcccaggcacggttttttctcaccctttttggccagaagatgcgcgtgtttctcacttttgtctttcgaagaacgcaaacttttctcgcgctgcgtgaagaactcgagtttttaccttttttcgctcttcgccctctctctgtctgtctcgctgggtacgcccgacgcgcgagacacacactgcgcgcagtcttccctcctcgtctcgccagctctgttgttcttgtcgggcagctcctttccgccatgcaaggaccgtcggattttctgcaaactgtgttgcggcgtctttgatttgcttgtctcgtttcaaaaccggcgcgagacgaaacaagtcagtccgcgaggaactgcagagcgggactccacctggcgagtctccaaggtgcctggca

SEQ ID NO: 3901 - DNA, 4364 bp, Toxoplasma gondii
ctgtctccctggtctgtgtcaggaactcgtggtttttgaagctacggcctctggtgcgtttgcgtcgaagcggcgcaggtccgtcttcccgtcggttcgcaccgcagcagccgaggagacacctgcagagacacgaccccacacgagtggccgacaggtcggggcttgtcccccagactgcgccggcaggaggcgacgagcaggcggcgcggtcgtcaacatgcgttgcggtcacctggaggacgaactggtgctcgactgcagccgcggactgcctccaggtgtgggtcgaggaactcgacgaagacgagaaagacgacgaagacgagaaagacgacgaagacgagaaagacgacgaagacgagaaagaggaagtcgaggcagggggtctccgttcctcagaaagcagatgaagggatccggcctcgagaccgcctccactctctccgtgcggctcgcgatctccgagcctttcacctgttttctgtctcttctccgtctctgccgccgtctcccgactccaggccgcctcctgctcgctgtgaggtcctcccactgcggtttttttctcgcctgcacatgctcctgcgcttttctcgggaagcagccgcggcagcgacaacagagagacctgcacctgccaggcggagccggggccgaaaccttccacgccgaagggaggctcctgatcttgcactcggtagaggacggactcgctctcgaagaagagacaccagggacagcaggaagagcaccggctgtcttggcagctcggagcagaggcgagcgtcccgcctttagtacaggccgacatccttgcgctctccttgggggtgcgcgcgtcgctcggacatcagccaggtcgaggcgaggcagagacagacaggacggacagagaggacggacagagagacgcgaagacacagaaacggcgccttccagtgtgcgttcaagcaagtaccttcagaatctgctggagaaggaacgaatcgcgcctcacggcgtcaacgcttcagccgcccgcgctacgtcttcgggtgtacagacaccccatggtgccggcgggcagagcagaggcgaaggcccgatggctgagcagcaggcaaagagaacagaggctcagcggcgaaagacgagagacctctctcctcccgcttcatggtgtctgaagggagaaacgaacctgcgtcgaagcgaagcttcccccctcacgctgcagctcctgggccgctcccaggaggcagcgaggccaggagaccgaggagacaagagaactcgcgagagtgagggacaacaagagaaaactggagagggcgggagagaacaagagagaagcctggagaagcagagagggaagcggagagaagcacagagagcgactgtgtccgagggagccgtcgagagagctagagacgcagaaagaggcagagagaagcagagaggagacgcgacgcttccgccgccagacgcactcagggtggtcgagcggagagagagagagagaaaacgagagagagaggcgagggagaagaggacaagagagagccgagacgagggaggagggcgcatgccaagccgagcagctagatgggactcggagctcgacggcgcagcgctcttttctccgcggagagagaggagagcggagagtggaaaacgcgtggacgacgaaggaagcagcaagcggaggaacagcgagctttcctctttttctgcctgcctcgctctccgcatttgacccgtctctccgtcagcggtaactctcgagtgttccggaggcggctgaaggcgcgttcgctactcgaggagctcgatctctccgcagaaaagaatttgaaacctggagaaccacgagagaaaaccgcggcccggcaacagaaacgaaacgcgagtgacagctgtctagccttgcatggcgtcggccgcttggggcgccgcaatgagaacgcgagggtgtgcagttttgcgcgcggcgtcctgcctacattgcaggaaagtcgtcatcgaaggcccggaaacgaggcgacagaagccgtgaaagagtctcggatttccttgctcgagttccagttcagtttccgacaccccgtctgcgccctgaagaaagaggaggagagaacaccgtcgagaagaggaagcaacagccaaaaagcgcgcggctctcgcacactcgccagaaacagaggcgcggctcgcacgaagtggaccgctcccggtgccgagtttttgccgagagaaagatttgattttttccgcttttaaatccgcttagttcacgcgactcgacgccgtttgttgccgaatcctcgcgaatcgtcaagtcctgctgccagacccttcggaaaacaaccgagctatcgaaatgtatctttgcacaaatacgcagacataggcttgtattctctctgtatctgtagaaaaaggtacaacatcgaaggacgtttatacgcagatgtctgtgtatagaaatgtgaatgacacgaatcatcacaggttcagaactggccccctaaggtgtgtgagatgagcagagctctgaaagctcgcttcgatacaagcccagttctccgagcatgcatacggatgactacgcgttccgtctacgactccgttaatatgcccgtccaaatctatggattctcaaggaacttgtttctcttaggcgttaagattggtgtctttggggcatgaacatagtccggtaaaggctttgtctgaaaagaagcgctgtcgactttcttcgacgttcaaggagacgcatcaattcagaggtctcatggaaagagttgtctctgctgtttagacacacacaggtctgattctggtcctcaaagagaggaagaagcgaagaacgggggaacggtcgctagtctgcatccagcaaagttggaactcttgctttttctatcaagtaacatagaaacgcctgcttcattgcctacaaaaagaggagttgccgcatttctgccgaccacaagaaaaggatttctcgctgttctctttgctgaggcgttttcactttttgttgttctctctgttaatgtcgagacaaccttgagaggtgaagcgcctcgctctctcgccttgagcatggacgaaaaaaaggtcgagcgttcttgttctgtctgtcagagaagccgctttgtcgactggctttctggggagcagaaaccggacgaaaccgtttcgagaacgcgcctcgtgcggcgtctggcctctctgccgccctcggaggaagccaatgggaaagagctaggttttctgatgcgtaaatatattcgatttgcgtcataccggcaaagaaaacagtatgtgtgtctcccccttttcctgaaaacagaacgacttggaatcctcggcacatctcatctcgacaaaaaacgagtctctttcttctcttgcctctgttctctctcttgctctccctctctctctccctctcttgttctgtgtctctctctttctctctctttctctctggctctctctcttgctctctctctctctcctgcttcctctacctttttccgtggatgcgaaagtgacggttgaagcgcaatttggaaatgcaactctctgttccggaacgagagtcgcgaggaagaaagaagaaggcattgctttgttgaaggatgaaggaatttttccaaaagggctgttccgggaattgaacccgggacctctcgcaccctaagcgagaatcataccactagactaaacagcctgaccgcacttatgttcctgttgggcatttttcgtggcattccccgatgcaccaagaggggacgccaaaacagcagcaaaaaagcgactacgcaaagagaacaaagaaaacctgaaaagcagaaacaaccatgcaggccggagagggcctgcctccttcctgcctcgcggagtgcacagacaccctcaggcgccccagaaaacctctctgcatgcagcagcctttttcgcttcgcggcgaaaagcagtcgtcgtccagctgccgtgtctgttggtctgttcttggctgcgcggttttaacgctctcgttctttgccgccaaagagagggactgagaggcagcagagagagaaaggagcggcaaagctttttatctgcccttgcgtagctaaacgcagtgaagagaactgcttgcgtggaactcaagcatctctgctgcagagctgtatccgagagaggagagacacgtcggtcaatacggttctgctgaaagtcttcaacgcaagttctcccgtcatcaattcaaccctgtccctcctccacactttgatttcttgcatttcttgcgacctatcgctccaccttctctccctcactttcttctttctttcgcgctcgtctgctcagtcgtcgaatcgcaa

SEQ ID NO: 3902 - DNA, 1559 bp, Toxoplasma gondii
ggtacatacaggcggaggtcgtttttagagaccagaaatacgagggagagaaaagcagaccaccgacccagggggaaagagagagatggcgacaggaagagagaaaagcacaacccaaagagaaaatgagggagacgtagaagcaggaagacgaaacgtaacgcctccagggaaggggagaacttcgaagaactggcaaggacgctgaagctctgtcaacagaagcaacagaaagagagaacagagcagacagagcctcccgccagctacagaagagacacagtttggaaggaaagaaagagagaactcggcgagaattgagaaggcagcttctaccacactcgaagttggagcattgaggtgaggagaaaaaaaaaagcgatctgtcagagacaccaggaagaagagagagaagaactgcacccgaggttttcctccgagaattctcagagttcggaaagaaaaggcagcgctcaccattttggaggcaggataaggagaggagaaagcagtccgaggagaagagcaactgaggcgcgaaccgatgcctttcaagagcgaatcaagaggccgatggcagacaaacaaagacggctttccccgagagcacaactgccacaaggaacggagaaatcctcaacggagcagtcagcggcggcgactgaagattcgcagaaacgaacgagaagaagcaggtcgcaagccggcacacgcggaaaggcagaagcaagggaaaattcgacggaaaagaagaagagaaaacaagagaagaggggaaaaagataaacgaaaacaagactggaggacaagacagagaaacgagggaagagaacaccgcaggaaaaaaacgagtggacaacaaaagaggagaacaagagaaggaaacaagggaggccaagaagagagaagaaagaggcgatggcctcagcggcacaatcgcgtggaagcgaatttcctatgagaaagccggaggcgcgtgagggtgtcgatcgccaggagtatgtacatcggcaacaacgacagaccccagaccaagctgatgtttctttttcgcgttctcggagttgcagagagaggcgcggccgcgcgtttctttccagttttgcctgcctgctttgccgtggtacagacgcgtcgagaccctacggaaattcactctttcgactgttttgcgcatcagatacgaacgaagagcggctcgaagacgagaggcgtttttctaagcagaaaaactgcggacttgtcctttctcgagtctcctttttgctgtgcttggaaactgtccccagcgcgcgtattcttaactcagggagagggtcgaacgcgttctgggagaccttgttccttcatctcacactcttcttctctgtggaaacttcccgtctaactctttcgggtgtctctgtgtcaaggactggcgggagtcttccttcttctcttcttcaccgccggtgcggtgttcgcgtcgttgtgtctccgaagaaggtcctcctctttaagccgactggaaagaggccgttccggccatggagacagcgctttgaggggaagcttttgca

SEQ ID NO: 3903 - DNA, 1957 bp, Toxoplasma gondii
gactcgcgtatggctctctcctcaagttctactgaggagacagcaggtgtgactggggatgaggcaaccgcttcaggcgaggcaactcctcttcttcgtgcgtcgcttctcctcagaggagccaagagactccggggagagtcagcggaagatctgcagaccgatcgcgggagcgggtggagactttctttctcccgaagacagcgtttgtgtctgcgtcggtttttctcgtctcttcccgtttttcctccccggactttctgaatcgatccccccagtctccgacgaagccgagaagcggtgacgacaaaccgcgacagagcagaagaggcaccgagttctcgattctcgtcttcgaaagcagagaaaagagaggaaggagagcagaggggagaggccatccgcgacagaaacacaatgaggacccaagagggggaagacgaggaggggggcagcgcagggatggtcgagagaaaggaagactcagaatcaagcgatgagtgtgaagaaggagcgtctcgagagcaactgggacctgatggagagaaagacagatcctgagaacacaccctcgaggcatgcgtcacgaagagacaagacgtttcgacttctcctcgggtgtctttttctctcccgttttcgtggactcttcgccgtgttcccgagagtttttctcttctttcctctccaaggcactcagcctggctctgtgcaccaccgccggcggtgagaacctggcgacgagctgccctcttccaagggcggtcttcacaggtggaagcgaacattatctccaacgaacaaacgcagcggaagcaagcgagactgcgatttgagcagaggtcccggccgttgtctcctctccgcaggaaacatgttgaagaggaagccagcggcgaagggaagataaaaaaagcgaagaaaccgcggcacagaaacaacgaggaaggagaccgaaggggagacacgacgagcgaattctgctgctctgctgacagcctctctttcgacgtgaggtgatttcctctcgacactaaggcaactgcgagaagggagaaggaaggtgcagcgagtcctgaagagacaaatcgcgcagaagatgaaagggaaacggacgagtgactcgcggactccttttcctgttctttgtttctcagagctcttgcgtcgtgacagcctcgcgactgcagtgaaaaagcgaggcagcgagagcagccgtgacgtctctcgcaaggagagacgacagagagagaggggaagcagagaaaagagacgaaaaaagagaactcgggacaacgcgagtgttgtctcctcgtcgcggctttctctttgacgaaacctctgtgtgaagtgcagtcgaagacatgcgaagcctttccgcgtcatgtgtgtctcctcagcagacgcagagagaaagcaccgcgatctcccatgcagaggccctctgccacaagcctctctgaggaatcaaaaaatgaaggcgccgaccggatccgttcgcctgtcgcacgaggatcgcccaggcgatcgagccgcccaattctctctaggcaggcaaagagaaaagagagacagcgcgagaaaaagagggaaccttttcgcagcgagaggtccagcacgcaacgctagggcagcgagacacggcaagaggctccgagaacagagagaagaggagaaaaaagagcgcagaaggaagcgtgaagagaaaagagaaacagaagagtgacgaagagaaggaatagagtgacgaagagaaggaatagagggcaatgtatgtgcatagaagtctcgacatctgcctccgacacacccaaaaatatccgtatggtcttgtgtttgctcgtatccactcctcagtgttcagattggtttttcttttttatgtgcatgcttcaacagcgacaaacgtaggagccggagggacaatcatggtcaagtcggtcctagagtgaggtca

SEQ ID NO: 3904 - DNA, 4176 bp, Toxoplasma gondii
atcgaattcagtatcatacgtatcatgatgtttctgttagaactgagtgatccgcactcttttcggtctacagaacggctcggtataacgcggtggcagagaagactggcctcaaacttaccctccccgtcgatccactcttgagcacgacgggtctgcttcaagcgctggtaatcctcctctgtcacagtttcatagatttcagcgttctcgtccttgacctacacaagataacgtcgcaaacacgcagcacgcgatgatatttgccatcctcttcatccagttgtgtttctgtgtcactatgcagactgaacacactgttaacaggttgtcgatggtcgaattgacgttgatgcatcaaaatgagtcgcgggctcaagcatatttagggggcgataaggaatatgtcacgcagctctgcacgccaaatacacaaattcacgcagacatatcgaacaggtgcaccgacaggcatatacagaggtatattggcgcgaactttcctatgtacatacagatggacatttgtttaacatgtggtgcgccgcgtttcactcacttcatactgttcagaggctttggcctctccgcgccgttgcctcctgattttttctaaggctgacagcgcagtctgcttcgagccggacattttactttcgacgggaaaagatgcaaactgtgttggccatcgacgtcgtacacacttcttgaaaattctgtctcttttaaacacatcgatgacttcacggcaaaccgactcaaagaaacaaggtgtcacgaactagagctgcgaccgggtcgagactgggaactcgccggtaactatacgcgtagagacgcatgtgtttatgttgcgggtttcagataaatgccaatctgctgaggcggaaaaacaagtggcaggactgtattacttgtttacacacatgcacacggagaatcttgtgagtgaggcggtgcatttgcggtgtaccctcttgtcgtcatacagttctccctccgcagaaaagcatcggaacatgagacgcttcggtacaaattatcaaggcaccagaaagaatcaaaacagaagaaaaatgacaggtgtgcatattgtgcttccgagaaagtcgtgaaagcttttcacccgcatgcaagatacgtcattcctccgttcgtcccggcggtgaaaaacgcggagcacggggtttatttccgccagcgaacacgaactttggctcagtgttccttcagagttcagtggagaaacaaagcgacaaaatactaagaaaaagaaccagaggtggggcaattttgtggagatctcgagggtgtctgcgcaagacagaggaccccgaagccgccctccttggagcctgggatatatgggggggcggttggtggagcaaaagaaccaacaagaaagcgcatgctaggcactactgagaaaaacggcaagtgaaaatcgacagcttgagagataaaaatatatacgctgtgaaggaagggtaaaaaacaggagacgagcttcaaccgatactcaagacgaaaccattatgtctgacgctttcctctctgctgcggcacacgccgttttagaggaaacgaggaaggtcgttttcctgtgaagcttgccactctcaatgttctatgaaccacggtttgttagcatgtctcggcgatcatcacggaatagaggtgactttcggcgggcttccctctctctgaagaagaccagcacgaagtgtaataaatgccttcaaaaaggtcgcactcgtttcaacgagttcccggccgtcatttttttctgaaactggggcgtgttgacgagacacatgcatggcgcctagtcggtggtacacatttatgttttggaggctcttacaaaagagtaggaaaaacggggaatggcctcaacaacgatcgaggatagaagtgaccagcatcccagagtgtgttagaaaatctggtttgtctgcgcgggcgtatgagaacacccggtaacgaacggggcattctgtccgttgaggtgtgcggccgtctgatatcggcagtgggtgcgccagcataaccttttccagaatcattgagacatcgcactgatgaatgtgaacaggataaaaacacacaggaacgcttgtcgttcgtgcagccatgatacaactcgctatttcagtgggtttttcttgtggagaagttcgcgtttcccacgtccgcttccccgcagacctgactagacaaatactctgtttcaagtcctggcaagtgaataagtcgttgttcatcagcgtcatgtgtgaggggtgactgcctatctatgtgattcgttttgttccttcctacagtcggataattcacaagtgtcagacaagtgtactccgaggttgttgactcagacaaagtggctgcagttggagtgaaccacaaacactctttgcagcaccatagagctggattcgtctgtgagccgctgtttgttcctcgtgtgcagttgcctcctttactgaaggatggctccataaggagaaaaagtaggagggacaatacgtttattcccgaatgtttcgctcctgttttacgggacactacccaacggcttctcaaagagtctgtggcaataggtattagcacgttccttatcgactctagtcatctgagcaagtatcaggagaactgcatgtgatgcgtttctaactatccgcatggcttgttggctcagggctagtggcagacgcgacttgtagcctgcctcgtctttcttagaggtccactgaactcgcgaacctgcaaatgtcgagtcattcggacaaggcaactcaatgatgtattttcttctggcgcaacaagcttcgattcggtatccaggtgtccctggattaactagggacaagggaaatggacagtcaacatggtttgagcgttagagtagcatagtctgaagcataggctttcttttattcagtgttagacgagcatagcttttcttgacacgcaggccaatcgcgagaggagtgaatacgcagtaggtgtgacccggtagggtatcgagacggcctgttagaaaacaactgacgattattggtcagtggaaatgtagcgaataggtttagctgacacgtgaaaaacttatcgagggtcccttcatgctattgattacgagaagagacgtgaggctctctaatacgtttcgtgggcctttgaggtgactaggcacagatagaaggaccagtttcaccagggacaccatttgttccgtacactgcagagatagtaaatcaacacattgtttctaatctgtcacagagcgtctcgtgtcctacccatgtcaccagtacgtaatcatttggatctgaaaagttcacagttctgtgcttgaggcacgatggcagcttctcgtcgagtcagctacccaaagttttacgcgaacccacacttgcagcgcactttccttaccgcatgcggagacgaaagttgcatttcgccgatcggaagaccggccacatggttaatgttttcgcgatgcatatcggatgtttccagagaagacagctgacaacgggctgcctatttcttctaggcgaacgaatgtcttcgcggtagaaaaacacaaagaactaccaaggcagagtattcctgctgcaagcgtgtagatccggtatgcattcttggctgtgcagtggacaggcggacgcaaccaggcctttcacggttatttgtttcatattgtgtttcctccatcaaatgtgttaaactcaggccccgtaacagcggcttgactatctctgttattccaattttttgtgtatactgtccatcgcacgtgatctgtttgacgcgggaaaggcggatgtaccggtgttgaggatccaacagacggtcgttgaaaagcgaatgtttaactcaggtccacggatatgttgtttatagagctgaaacacgcatgcgatttagcaggtctacgtaggtaagcatttcgatgaaaaccgagcgatccttgtagaccgagtgctgcatgctagaaggaaaacgattcagttctcttggtttctctgaaaaagggcaactgctccgggctgtgatgacttttatgtgatttgttctctgtctaagagggtttccaacgtttgattggcagtcggattttccgggggattcgttggttgagcagatgcctgtggaactgcaacacgtaaaaaa

SEQ ID NO: 3905 - DNA, 1884 bp, Toxoplasma gondii
aatacgacaaagttgcaaagcaggcaaacagtacgcggcacaaaacgcacgttttgtagcctcgaccaatctctgttcagccggaagtacagcagcgtgtttagtggttactttcaaaagtgactaataagaagctacggctttagagaaggtcacatactgtgcaccactcactgccacttgaaacctaaaggtggggaaactgtaaagtatcccccaacgagttgtggtcagcagatggcttctgcgtgggggacgcactctcgtggagaggttctcgtttttcttcagtgactgcacaagaggtttaagttcgaagactgattacaacaccacatatatgcgtggctcatgcacggcacgacacgtgaaacctctgcaagaaaggccaactccgacattccacttggaaccgcgtacttagtcgaagagcgagaagcccatgtcgtcttcctcctcctcttcctccttcttttcctcctccttcttcgcagcagcacccgcaccagcatcggcagcgccagcagcaggagcagcagcagcagcgacaccaccagaaggtaccttctggagcttctccatacctgcggcaatcagctgtggaatcaaaggcacaccggaaaaaaaggcgtatttccatattggccgatagggcttagatcctacgcgcgaaatttcagcagttagacgttacaacaccctctagagcgccatccgtttgaccaagccacgcccgcgggactcccagttttttgccgctcccgtcttcagcggtacatatatgtacgttgcaccattcattccacatctcctggagtctacgaaagacaggtgccgaccaaccgcaaaaacaccgcactcgacaagtcggaaccgagtcctactatttggaagttgcctacccccgacagttatcacatgttgcaccccgaacaaaagctacaaacagttcactgggggactttatactttagggtactgctgtagtggtccataaaaaaggaaaaggatgtgtctctgcgtggttgcgaagcgcgaactgaatttgcgggcatccagtcgggaaccgggttctcagcttacctcgtggggggtctttccttcgacagctttgaagaaggcgtccatgatgtcgtcttcaacatcaatacccacagaggagagggttttctcaacctgcttcttggtcggagcgtcggttcccgacagcaccaccatcaggtaagcagcgacgtatttcattgccattttgtccgtggaaacgggacgcgcgaaactggaatattccgggtaagtcaggagacgacaggagagcttccgcagcaagaaatggcgtggagactgacagtgcgcaaggcctgctcaatcactttaaccactgaagaaaatgctaggaagtgcgactccccctcacggccaggttatcctggaagaaatttcgtatcgatcgtcaagagcgcatgcgagctctctgctgtcaaagccccacgagcacattcttccgggtcccccacaaaagcctggcgcatgtaataagcgcttttcggtcccctctattacggttgcatgcgctgcgttggaaagcgttttttttccaggcgcagcagaagactgtctttcctgggattcggctaataaaaggggcttcgcctgctggccctcctgcggggcaacgcgacaggatttcgtcgtggttgacagtgctcgagaggcgaaaagcggggacgttgcaagcgaagacgaaaaagtcgacccccggtgaaaaagtccagcgctgcccgcctgtcacctttttcattgtcatttgtactgaacggtgtaggggcgaaatcctgcacgtggatctgtctctttggttcgcccggtagactaccacaatcaaga

SEQ ID NO: 3906 - DNA, 2675 bp, Toxoplasma gondii
gaatttaaacgcagtgactcacggtcgttcgtatggtatggtgtagtaattcagttgagtgcgtcgtcgttggatcttgaaatgtaacacagtgagctgtgttaggcagtccagtggtgtggtggtgtacagcgatcataaaaagattggtcgtctgtggcatacaactggagtcccattcaggatcctagatactaaaatgtctctgtctattcgacgtgaggtatacagtcttcagtttaacgagctctctctcaataatagttttcatttagagtggtttggtggacctgtcacacccaagtatgttcatacccgcccatcggttcggagtaccactccataccatccctgattggcctctgcgagcctaaactgcggttgtagcagtcattcggtcacggtgacgatctctgtcatccatatgttaacaaagttttcagggaggtaagtactacgagtttgacatcttgtgtacatcttgaaggacgtcgtttaccggaaattgcgttctaatgtagtattggagcattgtcgacatttactgtagtaatgcatccaactgaacaccacagtcacttgcttcgtgacaggaagccgttgtggttcgaacgttccacgaatacagcaaacatgacgacatctggataaacattcccttttttgtcgggatgtggcgacacgtagtcccagcactccagaaaacagacgatcgcagaaagcagcaacgcactcctgctttgcgagaaagagaccaggagagttccatgcagatcgagtcccatcacctgcattttgccgctaagagcaagtaagggaaatgtcaactctcgtggttgaagtggaaaagaacacaaacactttcttccagctgcaagctacttgttggcgctgctcagtatgcttgctctatgcggaacgacagtttgttttgtctcgcatctaatggagtttaatcgaatggagtctcttctcatgtttttatgtaacctacggaagcagcgttgtaccaagtgatcggcagctttcctgccagcgtcgcaaggctcaagaactagcagactgttcatcaacaacagcgttacacatgccacacagttcatgcggaatcaagtcacccgtcgaggcataccggtcatacagagactgaagctagactacctgttagtacatattataaaccggaacttctactccagttacgagatacagacaaccacggtctagcggcgtattctcatttttcgacggtgggaaactggggttaaggactctttgccgaaaaaccttaaacggggacaagacggctctgaacaaattgtggaacctaacgggtgccatgtcagtgcaagcctccaacatgtaaccggtgtttccatgcaaaaccaagagccgcgtcgaacgacggacacagccacgtggctctaaacacgtggtcgaaagactccttctgtgatacacaaaccaaagtgcgtaacaattggcagccacgtcaaatagcttgcgatccgaaaggaggggaaaacggcaatgtcgctcattcgtatgctgacctcagcttttttttaaacttcttcaggagaatttttctacacacacacacacgtggtttctatgtgagccacgttcttcctgtggaaacgagataagcactatttgtaatgctccgttcagttattttcttaaatggccatgaggtgaataagcaagacaggtagacaaggttatacaagcacacaaacacttccctgaatacagatagaaatcgctggattatgaatataaagacggtatctcccccaccccggcacgaccgactaacaaaccacagagcgttgatgtcttgtcaactttacgcgtcgctgccgagacgagtcaggagtgtcgcctaaagcatctttttcctgtgacacgaggtttcagatgatttgcagctttgtcttattgtttctcccatttgttcttgagagcaatgtgagccgtctgccttgtggaaccaggacctcggtcgaaccatacgttctatcacaatcttttgttgggcgctgtcaaagcaacactaagcttaaagactattcggagtttgtttctcaaacagcaagcaaagctgctgaatacgttttctccgcgccgtcatcggcacgtgtctcacgcttctccagataagacttccactttcctgatttgcttttcatgcatctgcttcctcacttcggctcttctgcctttcgttttttaatcttacggggtttctgggcggtcgctcccgttgctcgctaggttgcgtctctccgtgactgtgtttttttcccttgtttatccccgattcatggtggcttgccccgagttcctgtttcctttctttgaaatccgtttcattctcatcttgtgttccgtcgtattaccaccagcttccgcctcctttcttgatcggcagcagcccacaggctgagcggcggatttccacacgtcctcgtatctgacttagctagcgtcgtttgccgtcattgtaactgtcatgatcctaactcccgtttgtggcggaacatagagcgagaaacatctttcctatcaagcgaaacgtgccttcgattgtgtgtcactcccgaattgcttcttcgcctcttcatattgtttacatcttcgtttccgtttattcatctaattcggcagca

SEQ ID NO: 3907 - DNA, 1515 bp, Toxoplasma gondii
aaatgccaacatgcttaatcatattaacattctacgacgaatctgggccagtgcttcacatagacatgtccttcacgtttgcctccaaaaaattacccgctggaacacgttttgccttaaatttgtgtcagctgcaaaagcgtatcaactgccctgatggcattgttgtgatacggctaccggaggaggagggcatggctgttttttcccactgggattcaccatgttctttttaattcacattcagctgtcgaggttgcggtttgtatgcttttccactgtctcgaattactataaaaatactgctctgatggcagcgctcagatcctaacagccgtagaaaaactcgcacattcctctaatagggaagaaatttatgaacggttcaggatagctaatgggaagcaaaacaagggttcataaacgtgtcaccttcatgtgtctcagcaacgtcatgtatgcttcagatgctcttcttaatacacttggaaatgtatgtggttttctcaaaaccagaaggagcttcaaggcaggtaaaaaagcatgcatttttctaaacgtgcagatacattctaaacggtgtgcaactcgtgtcgtcggcgtgtgagtacgatgccgggctcttgtggtcccccaggtttggagactagcattactccaccaaccatcttcttttgaaaatgtggatactcaatcctagatttccgtcatgttcacggttcatgtgtaaggtaaaactaactagggctcacttaagcaccgaaaccgctgcgggtgtggtggcgcggagaccgtcaccgttaccagcgtaacgttctagtacatgctacacacatagatgtggtctctaatctcaaggtgcttttgaaaggcatctttactggaggaatcacctcacatatagatactgcggagcagccgggcacacacgcagtgactttgcgctgccgtatcgaaaagcggtaagaaagtaatgcttatcatctaaggctatggatgagttcagagaaactgtgtttcattttgccgttcactacagtagtggagaggatttcgaagcacggcgtatggataagcagactccccatggacaccgcatatccatcaactacacacagctactcaagcgcgaaacgctgccaacctcggtgttggcgcatgcatccatcgtgcatgccctgcatgtaaccaatttgacttccatcctgccagctcttcatgacgacaaacaaaactgcgtcagtatcggtctgtgcatccttcgttgacgcattcatttttcctctcttctatctgttctttgtcatatcaggttctgagagttaaacaagtagcctctctcccacctgtcaatgctcacgcgctgagacgcgcccgcgcaagcgaaatatgtgtcgctggagcctcgaatgggtcatcgatgttgacacacacgtgtagtatcctttctagtgcctcaaatcagtgtcttgtgttgcgaggagatccccccctgttcaatcgtctgccggtgta

SEQ ID NO: 3908 - DNA, 2361 bp, Toxoplasma gondii
cgtaccagctctggatgactgagagtttgagctattctgatctgatgtttgcgtcttcgtgtgtggaccagatggagcgaaatgaaaaagtgatctggtcacgagtttggtggcttttcgcgaaaaggactcgtcgatgccctttccttgtctaaggatgctgccgggcctcctgtatctgtcagttccctgccagcacattggtctgagcaagggctgtgctctgttgtgtaacagttgtacacacgacaatgtatggctgggtgcgcattctatggagctcacctccatctacaagactcgctggttatatggcgtacaggcacaaacatgcaaagtctttcgatgttaccacgtacagccacatgtcaggcgaatgcgaatactccgtttttggtggcgcagaacttgctagtctcatttgagcaatacagttgtacccgactggtacaactaagcattatgacttcttcggaaacagctgccgccgcatcctgaggagaggcagacaactaatggacccctggtgctgaccgtcacttcagttgagcaaaaaacgaccaggcgttttgcacgtattctgcttcgccgtggcaagcgcatggccttgatgagccccggcaccagagatgataaacgctactggcaaaatgtctactccgccgggtgtttcgcatgccattatggttgagatgctggcggcgctagaaaacgctctagtccatccacctggtaaagaaactcgttgcctgccttccgaacatccacaccggtatgctttcccaggcgtgtcttctagatagctactagggttggagacgaagggagaggctgctctcagtcactgccgaaatcgatgtcaagtcttgaaacccgacatccaaccatgacgtgccataacgtagagaggcattcatttcttcactgaataccatccccagtggataccactggaccgcattcgacttccgtcaccggaaggttcaatcttgtatcactgccttcgtttttgaatcgggcttctaagactagcagaaccagccaccaacagcctcaagaagaatacaagagagaaacgaagggcaatgttgtagggaatggcagggaagataacaatcgagcggaagggagcggcacgcgaggcgcataccagtagtcaatttcttgcacatcacctgcaacgtgcgcccgttaaaagtttttgcctcaaattacggacgataaaaaccgtcgaatgcaggcattttgcttcattgtcctatgatgcactttttcggtgctgaccaatggacaaactcgtatgcttgtttgtcttcgtgtgccataagatgtgtattcaccattgcaatgtagcgcatgcgtctcatcgaagactatttactgttgtaaagaattccctcgtttccgttcatgaccaacttctcctcctgcccatcggctcgtacaaggccacctgctgtaatggcagtgatgtctcctgctccagccgcatcgctacgacagtctttcttcagtccctgctgtcggttggctcgcgtgcaacgagaggcatgcaatccgtgtccatctatcacgggtacatcagcgaaccgatgcttagcgcgaagacagcaagaggaatacgaccgtgttaccccagacttcgtattgttcaaggccagaggcgaatttttcatatggagccgaaagaatcggggggctgtatactgaattcgttttcctcgtcagtcgccctgtgcttcaacggcgcctgcagcatgcaaagaacggcgggtctgattggttgcgcgtgttccccttccctctgaaactgttgactaaaacgtgccggaatttcttttctggaacatcggtcgcgtaaattttagcactatgggaagcctcatccgtttcagtggcatgccagcctctttgtagggcttctgtgatttgcgtgttacaggcaccagcgcatgcacatttttttggtgagagttttgggggctagtctcgctctttcgtcgccttctgaagctcgaattgtgcttacggaccatatgcacatatctgaatttacttcgcttctccaaagctgcattggctttcatttatttatgcccggcctctgtgtgtgtttccagagtataggaagataacgagaagacatacttacatcagcatgcttccctgtttcaatctgaacatgtttatatcaacatgtacgtaccaccgcatatgtgcggacatacatactcgaatttgactggaccccgtttttaaaacgacacatacatagcggaccgatgtaatatatatatgtatatatacatataaaagcgtgcatccggggacccagtttgcttcagagggtagtttactata

SEQ ID NO: 3909 - DNA, 4057 bp, Toxoplasma gondii
gttaatagaaggctccgtccaacaactctttgttggcgactgtcggcgtagcctgtgttttttccggatgtgcctcgtactacatcctgtaggtttagtacgggggaaagaagtgaaataagttccttctgctttttcctgcaaagtttttcaaacgcaaaggacggagaccggccacgaaaacgagtttctcgtccgttggagcgttttcaagttcttcagtgcgaacgtacaatctcagcgggggcacccaagcccactcgcatcatttggtgaggatcgagaaaggcctcgtagaggacatgcgctggaacggcgaacagttcttcaacacagatttgggttgccattttgatggcgcgtcctctgtcttcgtggcttgtctacttgcgagcgctgtgcggctccggcattcctctgtctgagcctctcttcgggtcgcgttgcgcggcttccctcctcctagtcggtgcaacggacgaaatgctgacgcgggacaagagagaggaagagagacaaatgtatcttgggtgactgtgtatgagcggccaaatgtcaatcagagccagcaaagacaggcttggggcaggcaagcatacggggtaaaagacgcgaagacagaaacctaggacgaggaacagagtaggaataccacaaagcggacagggagaggaaaggcaagtaaaataggcaagtgtgcaagttctctggaagaaagggtcaccagcagcaaacaagatgagatcccagaaggccgaatgcacaagacaagaaaacgccgaccgtcacaccaagccaggaaactgtgtagggagagcacagcctcgccttttacaacgtatcagccagtgtggctgattcgaataactgaatatataacgacaaccgagaacagagcgacagtaatgcgtcagaaccggtgtgccgcgtggcctagggcagtctcctcaacgacacgaaaaaccaagtgcatgcataccttgcaagttttgaagaaatttccggtgatagtaaatcacggagatccgcatattaaataaccttcggtctgaagttcaagcgaaaaaacagttctctctgcggcttgatttccacttctcaggccggacgctggcagaacgtcaacggcatgcagcagacctaaaaaaagccgcatgcaccgtcgaatcctttctctgggcacactgaatttcccgggttacctcgtcgccatacttggttggttttgtccatccacaaacaaggcctaggcaccggaagggtgagtttagtcaacatgatgcttcacttttcaataaacagaagacacctgaggatagagaatactcgcatagaaaaccctccggtcgttgctgctgtctagatagatctctctcgaagcgactggaaccaaaatgaaagtgactgagactgcatgtgtacagaaacaggagaattaagggaagcacgcttccagcggaacgtgcacctatttactccttgcagtgaatgagaggttcagcattcagagggtggacacaaagtttcgtacggatgtgaatggacgaggaatatcgagttccttgagggttttgatgccgatgttgcaagctactttttttactgtatcttaagaggtccttcagcattacgctctgtcgcgagttcgtgtgtgaaaggggaaccgcggcatcttgtgtgtagtggcactgtcgactacctgagcgaaaaacaagcaggtcacgagctgataatcgttgtatacgtagcaaaggcgaatcacttgatgatggagcatcttcctttcatatggatggaacagttttaagaagaatcttagcgcaaggtagccggacgcggtgaactgtcagagagtagggacaggtgtgaggttgtttgtctgaaggcggctttccgcgttcacactcaagcgccagtgcctaatctgcaagagggaacttgcttaccccgggatgcgggttcctgagtagacatttttttctgcaaaaaggtagacactaacgctcactcccagcgacagactcaggcgggttgtcttagtccgcacattatcagaacgctgtgttggggatgctttgattcagcaaccagatacgaacattcgcgcgggacgggggcacatcctcggcttgctcggcggaaatactggatctctgcattgtttttctgacgtggattcacaagcagcgggtgttttccacgaggcggaaaagagagaggccgaacaagtgtgagatggcggcctcctcgacaggttagtgcgtctggtgtctcaggcgaaaccaccgccacaccgtcaaggaacagagaagacaaataactgagagggaagaaagaatcacactgaaaatcgcggtccagcacatggattaggtcgttgtgtttgtacacggtggacatgcgagaaaccaaacacgcgtcgatagtcttcccccgtcgattgtcaaagagctgatgaggacgtggtagccgcaaagctgacgacggcaacatgacgtcaccagtatgatgcacatataagagaacgggagacagaagagcgcgcctttttatcgctaagcgatttgggacagaaacgacccaattatctgcgtactagtgttactcgctcatgcttgagatccaaccgtttgctttgcgcaaacactgctgttccccgccgagtttcgcagacgcgttgaccaagccttttttggttattcatggcgaatcgccgctgacagacgtgtcaacggtgatgacgatgtgggaaaaactcatcgtcaaaaagaggcactcaggtcgcacctgccttcctcgctcctttacagggaaggcagaccgtttccaaaattgtcattgctgttgcatgtgtggacgtcgcaaaatgtccctcccgcgtgctgcgtcaacaaagaaagtgaactcttctggcagtgtcgtcggctattcggtctgatcaccagcagcctcgtgtcttgttgagtcttcccgcgagtgctgcgacttcagattaggtacacagggtggtactatcaagccttgtcatgtaaaagtcgaactggagaatcagcgtaaatctacaaatacggtaagtgcagaaatataagtagcggtttcaatagcggttaatctgtcctttttcctctgttctcagggcatgaataaggcagggtcaccaggctaggggctttgctgcggtgtaccgacacttcaccgggaaagctgtttcttccctacgtgggcaaatctggactgttggtagacagaaaagttcatctgtcggctgcagaaaatccttggccccaagttttactgttgctcatttcactccgtggccgaagaagaaaccatcgtcagtgtcccggtacggatgcaattgcaacagaacagagaggccggtcaagcgcaaagtcgaggacattcatgtggaaagggagaaacgtgaaaagcaacgggcatcaacgagaagaaggcgcttccagcaagttcggcaccgctgacacgcaaagcaagagctctcgactgagaatgcatgcaactaacgcgcccatcgagtgttgcatgttcaaaggtagttcgaccaattgcaaatctgagtttttccgcttcttccttcccatgtgagtattgactttccctgtcgcagcagacgaattggttttgcttccgttagatttacatgcgaaaccgaaatctatgtctctgcacagtccatccacgtttcaggttttctgcggtcgttgcgccgccagccggccatgcccacggccttgggtcgtcaaaccttcgcatatgcacacggtaaataaattctgatctctcatgagtcgacgctctacacaggtgcgcacatgtatctgcagtatttcctctttgcaaaggtttcccccttttcaagacaagacagaacggtgacccccccgccagtcacaggaaccgtgtctccatcatcgctgtcttcgacttcctttttcgagctgagcatggtcgttttctctcaccgtgcgtctctctgtggaacccttcccatgtgtaaaccttcagtgaggcgcttccctcgtccctcgcttttcca

SEQ ID NO: 3910 - DNA, 1863 bp, Toxoplasma gondii
tggccactcacaatggcggtctgagtgtgatctctaagttcccggtgccggttgtgcacggtgactgctttcgatttaccggttgcaactccgaaagtgaagagaagaccaccgtcaaggctggccctgatatctggcactgtgtgcgtttctgcgcatgttccagaggttcttctgtgtcgagtttgtcctgtcaaaggcgtacctgcggtttgggtctgaatccccttggttgcgtccacaacgaggagaacgaggtcgatgatctgggcgcctccaatgatggttttgatcaaagacgcgtggccggggcagtcaacgagacaaatctggacgttggcttttctacccatttcccccgacccgctcgctgtctcacactcaagtgtacatacacccgagtggcgcgcgtccaccgggcgtggaagtcgcgtcgggtccgcagagggttccgagcccggcgtgtctaggtctgttgcctctctcttttcgtttttctcgaactcggctcggctcgggacagttgcctccggagaagaggctggggaagccccctcgcccgggcgcgagtcgatgtccagggccagcgtgaaggccgaaaagccgaggtcgatggtgatgccgcgttcctgactctgcgggtgtttgtccagcgaggcggtgctccgcacagccgtcagaactcgagccagcgacgtttttccgctatcgacatgcccaaggacgcccacatttgcgtaaatcgggttgccgcagcaacatttgacgcgttccatgattcaggggaaggagcacgagagaaacaccgtgctcgcaagacagctcgcgtgtagacaaacacggaagagtgagagaatagggccagtcagccgggacaccagagacagaaacgaggcagtggaggactacggagaagtgtcacgtgaatttggggagtcggcgtcgctttacaggcgtgcttcactttgaatatacatgtttcgcgaaaaagggtgtctttgcagctgtcgagagtggcgcatgcaacgccggacccacacgataaagctgttcagtcagatctgcatgcgtttctttcttgaatttgaattcactttctcaactccactctgattctcaaggaaattctggaaagaaaagactcctttttctgatccaaggcggagaaaaactcgttcctgcctggggggaatcgagctacccgagtgcctccggcttgcggagaacgttttgagtctctcaacatttgcatgcgcgcgcattcattttctcttcttcgtttctttcgccattgttccttacagttaaagccatctggtttgtccttgtgccgtcttttccaatttcctctgaagaactcgagattactttctccgatgtccctcccagaagaatgcgcccggcaaagcggcctcaatgtcgctagatgagagcttttttcgctttttcctcgtttctccgtctttgcagttccctccagtttttaccttgacgagcttcctcagagagacggagacgcagcggagagagaaccggaaccctgtcgctcgaccactgctcaacgagcacagtgttaacttcacacagcgttctgtcgttgttgaatcaacgttacggtcaaccttcaaagtgaaaagaacgaggaggcctcctcgccggacgccattccacgaagaagtcgatcgacagcaacccgtttctcagggagcacttctcaaacatccggatcttgaaaaggggaacacacttttgcaagctcgcgaacgttttccggatcaagcagaaacggccctctgcatgcgtcggcatgcatgcgctaggacggaggctttatccgtttgccttcttgccgttccttcacca

SEQ ID NO: 3911 - DNA, 4045 bp, Toxoplasma gondii
gcccagacagcgccgtgtctgacgtttctcgttcttcaaatcgtctctggactgcccgcggggaacggcgaaggccgcatgtgaggcgtggagatccctggtagcacgcagagtccggagtctgtgcgctcgagaggggtctccgaaaagagtttctcggaagcggcgacgccgtttggagacctcgacgctgcgcgtctgaaggctgtgcgctctcgcgcatgtgcgggggaggtcgcgatttctccacacctccgcggcgcgcgtgaagaggacctcgcttgtcaggccagcgcgattctggcgtttgagaggggggggtgtcgcctctgtgtgtgcagctcttgcgtgggtatgcgtttctgtttcgaaacaaagaggaagagaggcgagaaggtcagactctgaaggagagaagtgaggagacgaattccggaaaggcgcgtccgcgaacgcctcttctccagcaactctcctcctcgagtttacacgctctttccactgcacatccttctcaacaacctcgcgggtctgtccaagactttcactttttgatgtcatggctttgcggccactgtgcgtttgacaggcgtctggagtcgcggttgcgtttttgcgcaggtcctcgatctagaagatgaacttcgcacgctcgatccccggcaccacacagtctccgccgtcggctcctccagtcgaccaggagaagcagcttctgaggcgacgaactgcatgcagccttcgcatgttgtggttgaaagcttcgagggagtgggggagactcttcagggcgccaccgtcgagtcggcagagagcgtaaaaagcgagagtggtgagggagacaacccgttcatcatcgacaccccctgctcggtcagcaccgtgtgtacagacaccccacgcaggcagcgagggagatcacgcgagtgatctgccggcccgcgtgcagcggacagcgagctttgaagggagtggaggagagaagcaaagaagtcttgctggcaggagaagcaaatctacagggtcgacgctgagcagtgggagcgacgagaaacgcatctggttgaccgcctgagcgtacaccaggagacgataagggcagagagccgctccgcgagcctgtttgtgtgtgaaggcagtgtgctgcagagatatttgcatgcggcgagaagacggggaggaagctgcaggtggaattcgagcgcaggcgagaaacgctacacaaaagagaaacagcatgttgcctgaggagcacaacccgaggtcgacgcgagagccgaaccagcgtttcgactgcgtagacttttctcgcgcgttgacgagcgctcaggagagcgacaaacaccaccaggagagtcttacgtacaaacgcgcatatgttgttatgcacgtaaacgtctttgtatgtctgtgcatgtgtgtggaaaatgcatgccggtgtattatacttagatagttcagggtgcttcgtggcgcgaggcctttgaacgcatgcgagcgcgacaaccggagaactggaaaacaaatgaattgcatgcagagtgccgtccaagtggcagactgcatggggagggcagggaggagcatcgacgctccaagcggattttgagattcgtttttcttgtcactcggctctatgggaacggtggtagggcaagaatgagagtcgcaaattatcgacgatcagcgctttttagtccatatatatatatgtatatatatcggtcaactgtttcaccgataactcatcagaagttcaggaaaaacgaactatggatcagaccctcagagttcacgcacggtactgggaagtaggcggtcgcgttatgccgttgaagaacgagttccgaatcctatttttagctcacaagtagcgagatgttcagagcaaacacggggaaacagttcgatttcaaggacgcacgggtgagtgaactgcaccgacaaggtcgctcacgagcgtgtacacaaatttgtcgaagagtggggagtgggacgcaggcgctaagttcctcgctgaagaacgtctcttgtgcatgtgcaagcgggtgtctagcccaaacaaataagcggatgcaggtgggagaaactcgttggcagctgaaaaccgtgcgcgtccatatctacggacataagcgtcctcctttgacacgtgctggcagtggcagcagcaacgtccccaacatgccgcctgctgtgcgtaacaaaacgtgagatagcagagccgattctcggttcttttcgatgttactagaaaagatcgagcgttctaattggcctccgattcaggtgaacccaataattgcagggggttgggtttccagctggctcctggcggtacatgtgtgtagcttcgccgaccacgtgcgtctccttcgtagacagcgtgggaactaacggtctccctccacaagaaaaggatgaatctcaactgctgaaacattcagagtcggcaacggagaaacgaaggtgttcaggaattctggtcacagccggtggtggagagttccccttccctgtttccgtgtcaccccttgacgaggcaacacacacgttacctcccaaaaacctacctctccactgtccgcagcgttgctcggaaaagtggcaaatctgtgcgcgtttttagttttcgtgctacagaaggtgacccacacgcgatgagggtcttgtgaagtgggcttttgagtggtcgaaagcatacagctctgcaactgcaaaacggtttcacatgctcggggttgacgaacaaagccggacctggcagaaggatctatacaagaactctcgggcggcatccccttcagtgtctgacagtgaaaacagggtttcttttccagcactcccgaaaaaagctttcagtcgcactttcgatcagcgctcgcagagcacgcacaagtccctcacaacggcctttgaggcgccgcgcacttgccagcgtgagagcagctccacgcgcctgacaagtaccgatttccacctctgaatagtcttcgagtctctcgaaagcggatctacatttttcataaggaaacgggaaatcacaaaagtggaatacggaggagggccgtgggatatccgagggctggggttggcaatgtggaagaggagttcacacctcatgctacgtttttagaaagactgttttttacagctcaccaaacggcgtcgaaactctggtttgtttcattttttctcatcttgactgttcctgtgcggtgggaggaacagtgggtcggagaagcttagtgtcgaaatgcgaactttgtgctggggaaaagatgccagcctcgaccggcgctgttcgcgtctcctctcgcgggggctagccggtcatcgacgcgctcgcgcgctctgtggtcttgcttgacatagtcaatgtaactcgtggggaagacggcttcaaaagccggtgagagccgagtttttattttccaaggtgacttcctcgcacattctgacttccattagtccgttctttctccgagcctgagagaaggcggaggctctgccgcctttttccccgcggtgactcagaaatagcgcgataccacgatcctcgccaccgtaagcttcgtcgtagaccagaacgtgcatgtcagacagctggaacgtctgcgcttataaaagcgtgaagaggaataagtgtgtcgatggaaatactgttcgggtcgtccgttatcctgctttttctcggggtgtcgaaatcgttgtcgactcaacttctcaggagagccgggttctctggccggtatccgagcgcgcgtcaagtgcagtgccctggcagcgcctgtgtgcatagaccactcgtcgcagaagctcagttatgttattcaaacagatgaggatcgcgggttcgtgtattcactttttacaagaggcacaggggcttttggcaccgaggcgatatctgcgtgtgtgtgtgtgtgtgtgcagttcgagcgaactccggcgcaggtgttcaaacaaagaagcgtggcgcgctagacttttcgttttagtcagttttggagacactacttcgaaaccgagagtttagaaacaa

SEQ ID NO: 3912 - DNA, 2627 bp, Toxoplasma gondii
tgtgtttacctcgtcggcctggtcgagaattttcttcactgtctcctcatcgatttcgtcggggagcagagcaaggtcgagctctggctttttctctgccaacgctacgggggcgctcggcagctcctgcgagacgccgggcggcgcggggggcatgtccttcgccagcgaaggcggcacgatgccggccttgatcgactccatcgcaaaagcgaaaaaagtggaaaaatgagaaaaaaagagaaaaaaagggggaaaggcaggaaaaaacaggcgaaaaaaaggacggaactggatatacagagagaaaacgagagaacgaggtggcggaacgacgagaaaggaaagcgaagaagaaaggagacggggaaggaagagagacagagaaaaagacgaaatggcaagcgacagaagcacagaaacaggaaaatgggttcgagaaagagaagggaaaacgctcaagactgggagagagaatgaactctacaaggaagggagaggagaggaggcgatggaccgaaagtcgagagaaaaacgaatgacaagagaggcgacacagattggtcaagagcctctgattcccggcagcgtttgcggttaaacgaaaaggaagaaacgaaaaagtgagtgtcggaagagaagcagaaaagcagacgcgagatgatactaaaaggtctcagagagagcagcagaagtcgagagactccagagaagagaaacaagcgtccagagtgcagagaagcaggaaaaaaagacgacgccgccactctgtcggagccgcgtcggcttccctcccgtcgatctcttctctcttttcgttctctcttctgtctcttctgtctcttctctcttttctcttccggtctcggccgcagcaggagagactctgttccatccgcatgcacggcggctagcaaaggggagagaagggtggacagagaaagagaggttgacgccagatattccccggcagaaaagaggagcaaaagaccagacagaaaggggatggaaaaatgaagcttgaaacgccagcttcagggcaacctccacccagaaaagcaaagttgagtgcccacatgcacggacggagagtccgggagagggagaaggaactctggcgttgctaaggcgcgttaaaaaaaaagagggggaaagtctcctctccaggtgctcccgacggatgagtttccttgccatttccaaagaacgattgaaaagagagacatccggacctgatctcactcggtctccatgctctcagagagcgctcggctgaacgcggaactagaagaactcccagaagagcgggggtctctttcaaaccgaagaggagaaaatgcaggggagagagtgtgcggcagcggcgcgcgagttttgacacagctttcctccgaacgggaagtgaatcgatttcttttttgcggggacgaagaggaaacgcgtacgcgaaaaagaaagccaaaaaggaccggaaatccctctaccgttttgccgcgccgcgtcagcttgacgttctcgtctcgcgcctccgagcctgtgaagcagagcgggcgcggttgtcttgacacagcgcgcgccgcggtggatcgacgctccacgagtctctgccgtcctttgcgcggaaaatgaggcagattcccttcgtttctcgaccagaacgcgaaacaatcttctccggagaagaacgcgaccttttccacctcagatgctgccctcttcagcgtgcatcgaagcgcgcgagtcggccctgcacacatgcgaaaagcgcgggtgtctgtacgctctccaacgctggccgggtgtacgtacacccgagcggagatagagagagaggcgggagaaacgcgacagttgtctctcttgctacggcggaggcacccattttcttgtctttatgtcctctctcgccggtaaggaaggagacttcgagcagagctgctcgcgcgtcctgctctggctcctcctctctctgcagagagcacagcgacagcgagcgaggagcagacagatccatcgccggagagaaaaggacgcgtttcttttcgcctctccctccccctcgctgagcttcagtggtcttctctcgcagatcatcgaacatggagcgcaaccgtaaaccgtaaacgcttcttcaaaagccagaacgcgcatggactcggacgccaggcctcgcaggtgacggcgagaagctccgcggcgccttctgcggtgtatctgcagctcggttcgcggtttagcagaagcaacgcagaagtaccgaacgcactgacgttttcaggtgaagagataacgcgggacaccgggtctccggccctgctccggcgcctctctctcctgatttcctgtttctctccttgtgcgttgttcgctttttctctcactttgtctcttgtgggtcttttgaaaatccagagtcttcgctgtttctgctgtgtgtgcgagctgtcctctcggaacttccgttcgatatgcggtctcgctctaaagaagattcgccgtcgtcttgtctttcttcttccgctcctctcgacgcctcttctctctcgctttcctcctcgtcttttcccccgtcttcttcgtcggcgcgacttcgccgcctcccgggtctcctcgctcgctctgctgca

SEQ ID NO: 3913 - DNA, 2296 bp, Toxoplasma gondii
aatcaagatgcctccagctgtgaaaggacgtctgatcgactaaacacagacatgctagtagagtcccgacgctgctcaagtggtgtctccagctgtgagactgactcgggttaaatggacagatcctggagaggagaactgccgtcatgggcgggttcctcctgtggctataggaatatacattttaccgtggagtggtggctgatctgtcggcgcatgcagtttttcgaggcttcaaggtttgaatcgagttcagcaactgtggcttgaaaaggagtggagacgaatgaagtacggaggaggccaaggttgagatgcagaagcggcgacagagtctgctcgcagttcttgtcatgtcgtaaactactgcggtggtctgtgttttcagcttctttcgtcgcatcagtgtcgttgaagtattctgagtcgtttccttactagaatgcctctagaaacctgcgccgattcctcttctctaactattctggatgttcgagagacggatatcgacgttcgtgtccggcagtcattaccgagagacttatctcgtcgtttgtgggtctgatgaagccgcgtaacggaaaagtgcatgctggcgagaactggcgaaaaaaaaagacatagggacgctatccagtgcggtgacgaaacgacaggctgtctccgcctcataactggactgtctctgccattctctttgagtcttgcagacctcaatcagcaacggatcacttcactcacagcagagtgtgcgcagtaagcacggttttgcttgcaaacagccgaactctattctttctattctttgtacagtcaatatacatttctttatttgcagccgaaatacatcattttataggcaatatccacttctatatttgcaggcgaaatatactattttataggcaatatacatttccttatttacaggcgaaatatactattttataggcaatatacatttccttatttacaggcgaaacatcttcttttgcaggtatgctgtcctaagcgcgttttcactgtttgtggccgtgtatttaactttcgtctcttgcaaagagctagaggcactgtttcttctgttacaaacactctacaaggttttctttcctttgcagggagttgcagagatatgcgcttgtaccggacgcttctgtttccttcctggactgctcgccaggacgttagtggccgagcgacttttctcttgcgaaaagtcggggtgtctcgacacctccgacgcacagttagctgtgcggcccaagtcgtgactccaactttttctctgtcaacgtctttcaacgtcgtcagatttgcctccgatttctgttgagacctcatcctgcagccgcgggcactcgccgcttcttctcgccgaattccggggaaaacagacgccggacgcctcgagagcttgcaggccctctccgtcgcagagtgcgcccgagcatgggcgctgtttctgtttggaattgcctctttcttttgaggattccctactaccttttctgcttctttctcggggaaacagttcgctgcgaagaagactctactgtgcctttccttgagacgggctgatgccttcgtctttgactctcgaaatctccacccccgcgtctagcgtttttggggtgtctcgagctcgtggagccgtcgttttttcgccatgtttgatcaaggcggtgtacacgggtgaaaatgtgtttttcgcgtttttcagaaacctttctagaactcccttccgtgtctctctccaggatttgcttggggctggggcgcgggacacagacgtgactgcagatgcaagttttttgcgcgattgtctcggcgcctcgtcaggttgtttttccgctcgttctcccgaatgttcgacgttctccttctcgcacactccaaatttttcctcttcctgtctcggccaaagttacgctcgttcgcctgcgtcttccggccgcgtacacagtagcccgcgagtgctagctttagtctcgggggcaggcggctgcctccgcagcgggactcgaaaaacgacttctcggcttttcctcttgcaagaagagaaatgaaacttattccgttggcgcgcgcttcctccagagaattttccagaaaatcacccgggagcgttcgcgcctgagcccctagcgttccttcccctgccctgcgtgtgcgtatggacgccgtccaccgcgccagtcagagagaagacgaaaggtttttttctcagaaaacgaggcgctcttcctgcgagcagtgtgtcggcttctgcggcctgaccgcgtattcagcaaga

SEQ ID NO: 3914 - DNA, 2027 bp, Toxoplasma gondii
gcaaatgtgaagggcgaagaattcgctcttcctgagagatatggccacgaagttgttcgttcttgtttcgcaacgtttttttttcaagggaacccttcacggctttttcccacgtgacggccgattgagaatttcgtccgtgtcgcgaacgaaaattcccgaaccctgtcgctgaggcggatttcctgctttatgttcttgcgtcaatatttgcaggagtgggtacacatttcgatgtggaaatgatcctttactgtccgtgagttcttgctgtgttgcttgtttgttctgctcccttcacgggccgaacggcaggagaagcttcttgttgcaatcgcgtctcgggacacaacagcttctgcctctactccagattgcggcagtagatttaacaccggtttcaccgtcgaatcgccacactcgaaatacagagagccctcccacagtgtctcttctccgtaggcgaacagagcaacagacacttttggatgcacacatgtgaatcccaacacgaaacagagacaaaatcttgaccatggaaaaatattggctaaaagaactacacaaatcatgttgcacacggccgtctctcgagaaccgtcagtatgacgtgtgctattggtgtatttttgtctattttagtcagtggcattcccgcagttaacacgagttttcggcgaaataatctatgcagaggaggcaagtattttagatcttcgcgggtccagcaaaccagtagagcgcatgatggtcaccactgaagagcgcttccttgaagtcttctgaggtacactgcctggttcactaggtgcctaccattgtcaggtattcatcttatctcacacacactgtcgcatgcgggagtgattttctttggcaaggaaagtgtggtgtctatccaagttctttatgcccccgcatgcttttgccacatccagggtttttttcgattcgtgacaaacaaaatgaccctgctgcttgtttgagagtacctgcttcgtaggttgtttctttgagatacacctgttgatgactttgtcagcttgtgtttcagagtccaaaagacttgctgaagaaaaaaacaaattgttttgaagggcgctttcaagctgcgcatggaaaagacggtcagatcgttcacctggcgtcatccgttttctgcgcaccatcagcctattcctcatcccacatgcggaagttgtggctaatttattcagcagaaaacggagcacaatagtgagcacacgccgctgggaactcttgctgacaacaactcacaggaatcgattaccaaggaccgattgacgcagcaaaatgttgcatgttgcatgcgacctatctagctgtcgaagcatctcgattaggcaagtgcatgccgctggtgtgcacgttttgccgtttcgtgcgcttcggaaggaaatgctgcggagactcgtactccagttttccgtccacacctaagccgtggagaagttccacgctcgcggacgcacagggaatccggccttaacggccttggggctgggcgtgtgcatgcctttcgcgtgattgcctggcacctagaggtggtgcgccctctagcacctcagccaggcttaaagccgttgtggaaccagaccgcgttgtggtcccatttagtaatgaagcttctgttgtcctcttcaacaagccgagggagttaactcgcggcagtcacgtcgttttgctatgtcatgtgttttaccgtccagactctcaagctgcgagtacatgcggattcttagccgacatcttgttgacctgtacaagagtgtaccgcacagacgacgagttagacacgcagtgtgtgtttccagcgcaacgttttcaagttgtgagccttggatgagaaggacagttgatatgcgggagatcgactcgtcatttgccacatctgactgaggaacgccgctctgccatctaccgccgttttgatgtctcaagactgcgacgttaaaaaaaaattcctcgaagtccctcatccgtcctgccaattttgtgacttctca

SEQ ID NO: 3915 - DNA, 4680 bp, Toxoplasma gondii
tccacagagtcggagaagaccttttaaaccgcaaacgcgttctctgttttttagactcctatacttgctttctgcacttgcgaaacgtccgacctaaggtcgtcaatttgtctccgaatggcatcttggagaagtttctgttgcttccacggcgcccatggtcctgcggagttcgttctctcgtcgttctcggcgtctgagagaacaccggcaccgtgcgcccctgtgacgagctccgcggctgaggcgctcgccctctccacgtcttcgtagctcgagcacagatgctcgcacacgcagctgctcttgcctgctgcttgtcgaagcatcttcaccagcagacccgcagaggcctttcctgcctcctcctcgcggacggttcctcccctctttgaacacagtgcacactgggatgcagccgcatctacagctgcagccgcggcagccgtttcgttacagagcgcgggtgcatgctgatctctctgtctcgctaaagagaaaggaagaggaggcttctctgtctccatggtgtatggaaggagaccggaaacgagacaggacgtctctgggaatgcggaactcgattcaggaaaatgtgcacttctccgcgttgacagaaacagaggttgtccatgtgcggcatctgcccgtctccacgcttgaaaaaccaattttcagaaaccggcgaccctcacaaactcagaggagagcggcgaccgacgcgcgccagcgtggggaaccgttttcctaacactgcttggagttcgcgctacgaaaaaagaagacaagcccagcaaacacgcagacaaccccgtctctcaagagttctctgtgcgctcggtttggcggctgttccttttccattcgcgagacaagctggaaggactcgaaagtggaagctcgtctctcgcggcgcaagcgcggagtatgatttttgtgtctcctcgattccggggaattcgctcatgaaccgattcggaagcaagcagtctttgttaaacagctacgcacagcattgtgtggacatggcagagacagtcactgcaatttaaagtctttctccgcacaatgtgtgcgatcagatggtctacacgtttcttgacgttgagagccgtgggtcttgatcgaagcgacacaccctagacgagaaagacatcatctggggcgcctcggtgtacatagtttctacttaaagagcagatgatacttgcatgcatacacagagcacggcgacacgcataaagagaaattgaatgcaatttaaaaagagcctccttgtcgaggcattaccacggaatcagcaaggcacacgcgaatgcaacgactgcgcgcgtccgccgcagctgcattgccgcggaaaagttccgcgggaacagaaggaaacttttctccggttttctgtaagtcctcgatgatgacaaagccaatgcctgaaaacggtgagcacccttgcaattgtcggggaatgttgaaacgaagacacaacatcggacttccggttggactccagaagacacgtcctcgggggatggctgcgacggaaaaaggaacttgaaggggagtttggagcgaaactgcggcgaaacacttcgccgcgactggggttttcagtcgagttcgagtttatcgacctttcacacgggacgcgttttgctaaacagaagtgtgatcattcaaaaaaagagctagtgcacacggaacgcgcgcacgcacatgcaaggggggagcggcagcggagcaagcagcagacagtcagaaaagacggggcaggaacagaatcgtttcttcgtcctgcgtctttgatttgtgaaggacctcaaggaacctcaaaggaagagcgttatcgaggctgcagctcctggacggtgttgagaaagcttcgtgacgaaccgtatttaccggaggggtggcatataagttagggaatgtcaaacgatgaaattaacatctaaagcgaggacaaccgggtaccgaattacattcacagatggacatccttcatccttgagcgctttgtgcatcagcaactccagtcgagggtacgggcagacagtttaccgacgaccactctaaggcgactcccacagtggtagttgtacaccttgtacacaaacggcgttttcctcagaagtacgccggatttccctgtttagacatgtacttatgacgggacgagactcatatgcaatccatctcgtaagtcgcctccagtgagagatagagcagcctcgaaaaaatgttctggcgggtatgcactctcatacgaaccttgttccagagaaactgtataaacctcaccttgtggacgtcgtgcttgctacgtgtcaactgcgtaccaaacaagctcgtgtatggtccgcctgctttcgtctaagatagcattggggataaaaaaatacgtgagacacaagaccgagagccgtcgtcggtgccaaggacgtttgttttcatggaagacagtgcggcactgttcagaatttcagggggtcgttttcagcgatgacatcgtgctaatataatcaggttgcatacgaggcagtcacaaacctacgatccactgtacccttcaggaaaagagtagccttgtactatttcagaggggggtatatgggctgttgctgtgcaggaaaggctcttggattcttcagccggcttccagtgaagatgaaactgctttgcttggcctggaccctttggggtttttccttcacacaactgacagaaacgcgttttgcttgtgaaaatccggggctcatggatactcagctatttttacgatctttcaaaccgtccatgagagacgaaacgcggggaaataattatcttgcacacgtggcggcatgccggcaaaacgtacggtgacgttcgtcaccagcccagcccatcgttcgcctggtacagagaaatcgtatatttcacactcgaaaagtgtctgagtggagttatagttgtttctaaatgatcgtatgccgccccaagtacctcactttcttacgtcaggaagaagcatccgcgctggcctccatgaacttcctgtcaatcgaaaatatccagtggctctgaagatgcagcagctctttcagctaaataggtacaaagaacttgagaagcgttactagatttacatagacaaaagacgtcgcagttcctggcggctgcgatagaatatcgaacctaatacgacttaacgtaggtcacccgcggttgaacgcgtggtctgcatgtattcactcagcaattcgctgcatcgccttcagcaaccatcagttccaacggtggaatgtaccgacaggcgcaaccgaagacaaaagttacgatgacctgtgcatatacacagtatctgtacgcttcgcggcaggcgactacaccatgacgtactgcacgaatctgctgttcttcagggtagaaatcgcattgacaatatctgcaactctcactggtgactttcaagtgtacacaaagcctcaatggggtaagtacgtcgataaaccgacttcatgacggttaggccttccggcgctcaaagaaatgttatgcactccatcgtgaaggttcgcgtatggcagagttgctttatcagttcgagaaatgcgtctgtttcaacatcgtcgcaataactttagcagcgctgtgtagttgtggatgagattcaaacctctccgcccgcttcctcgtagttttctgaggatcgatgtgacccaaaggctacagaccctgaccatcctggcatctctgcacaaatccctccttgcctgaatggtatttgtagacatccaaaacactttgtcgttggcacttacgtcatctaaatgtcatcaaagtaccaataaagaggatgaacgaaaggaccagatttttgttgagtgacttgactctgcggagtctgcggcaacccatgaattaggcatcttgtcaagacaagggtcgctggcgttgttgagtagccctccgctgctgctggctagcgagttcgactctcttttttccagtcctcaagaacctagcgcacggagtgttccgcttttcttgtgcctcgttcaaagctcaggggaaaaggcagttctgctgtttttgactctccttggaattcggcgggaggcgcgttttgtctcatccggccgcgtcgtgagtctgccgctagccaaagtctgcgggccgttaaaccagcattccgcaaactcgccccctttaaaatgcattctttgtgtagacagtgtgttgtttctttgtgctgctcccctttttcgtaaacatccgaactgaagaggacctccctggagtcctctttctggtaaccccaatgtcttgttcgcgcctacacacgctggatcgcagagctccccccaaaagatgtcgcgattccgttactctttctccactgaaggcttattccccgtgataagcgttggaagaagtggctttcctctcttcagagtgtgctgttgagtcgagcgctgcagcacgttcaagaagccagagacctgctcgacccccgcgcttcggcgccgcccccccgagagcgggagctgaaaaatgtgtcctggacacacgattgctcccggaaactcgaggcttttgcgaggcaagtctcgctgaattacccctcgagaatgcaccttcgtcccttgtccagagtttgcaagccctctactttttaggcgccttgcccatggacaacga

SEQ ID NO: 3916 - DNA, 4802 bp, Toxoplasma gondii
tgtggacctcgtcacgcgaccattttgtgggaaaagagcacagccccgagacgaatccgaaccggcgagaatagaagaaaggcgtagtcgagcagagacgccgaaaaaagaggagaaagtgtgacaggcaagtgaagagacaaagcagaaggacgtttctcgcgttcgtcgcaacattttttcgctctggcgaatctttgcagacacacaatagcacgagggaagcgaagagaacagagatacaccgatcggaggggagttcaacctttttccgaagaggcgcttttagtggaaatctgctctcccttcgacttccagacggcttctgccttcctttctgctccaccgccccagcacaggggactcaccgaaacgctgtcgccctctggactgctgaaaaagttcatcgccatgatggacctgaagaaaagagttgctggaaagacagaaagactacacacacacacacaaaggaacaaacaagaaacaagtccgcatttccttcacatgtatatgcatatgcgtgcatgtgtaggcatgtgtctgtgtgtatccgtttaaatatgtccacatacatacatgtatacacacacacctgcatacgtgcatgtagatgcatgtatgtggggaatctttacagctttgaacaggacgtgtatacaaaaagccatcgagaaatcgataggaaaagaaaggtagaaacgccacgtccgctgttggaatgtcgaaatgtttcacgcggacaccagtgaggctggtgttgcgtttgtgaaaggcgcgctgccctaagccgtagaccctaaacaggttggagaggccgacgatgcaagtaagtcggtgtgcgttttttcctgaagagagactgttcccggaaagtttccctgttctttgtctccgcatttccgacacagcttctctcctgcactttccttgagagtccaataaaaacacgcggcgatttgagaaatgtcgaagacgcaactgggagatgtctttctcggtttgacagctgaagaatgaactctctacttcctctcggacgggagaaaactgaaagggaaggaggtcaggagcagccacagttttccataaaaacgcgaggccaagcgagctgggtttcctgagttaaggtatgccctcttgttttaacgccgggaactgttgggcaatgtcctcacatcagttgcgcgcagagtcgccgctaagaagcgcgggacgtgctcctctcttgaagaaaaaagtgaaacagcaaacagtgtcgagtaggttgaagtggactaaccgacgagttgacgtccaggcagggcgaagcaccgagtgcacccaaaaatccgggaaaccgctcagataacagactgagtcctcaggtcgcttgtgcaaaagacatttggagaaggaaagttccacgtccctctcggtgacttttgatgttcctagggagaagaccatgtcttcttgcatgcgctagatcacggcagagaattgcagaaaaaggaacaaagataaaggctcccagcacttcgcgaggtttcgcgtgccaccttagcttaggggtagagcatcggtcttgtaaaccgaaggtcgtgggttcaattcccacaggtggctctgcgattctacttttcaaatgtggaaaagtgttgtctacggcacaggaaatgtcctttctacagtttccttgtattcgtaactgacacagtttgtagtttatctgttgaacaaagcgttttagggtgtccttgcagacatcagtcagctgcctctccggcagcgatggcttttcttgtcaaagggcacccgcatgatgacggggacatggaaacgactcatgtaacgtcgttcggcataaagtagaaaccggtttcggatctcgggcttacttcggcggatgaaacaaactgaaagtgttataaaaagctgcggtgtcaaacacgctggcagttcttccgtggagtgtacaaggagcagtagactgctggtccttcattcgccttgatctggaactgaccacgaggaattatgtcgactagggctccgaagctacaaaaatctcgctgttcgttacaccagcatctcttgtgttggagacccggcattactcgtggagtgactacacttgactccataacgtcgcacacacacacacatttcgcgctagaattgtatttaaaagaagatcgaacctcgtctcttatatgtacctgcggatggtttttttatgtccttcggaagaatcttccaaagaaacctttgattctcgaagtacacggacggttaaggaatccgaacacctcgtacacattgggaggcagggagctgtgacacggactgttctctgacaccgcggagtgaaacacaagagttccaccatggtcccatgatgtttgtgtgtttaatgttttggcaccctaaactacgaagaagactcttccggtgcctctaatggagtccaccgcctcaaaactgcgacggacaaaccgagggcgagcgtgaaagcatcgtgaaaaaactccatgaatgtcacgagacttgtttgctgcagtcagcgccgcggtctgtcaggttcctcgcgtcgtccagtctccccttctttagacaagcatgaacgtaagtggtcacgtaccacaggggaaaccatttgagtctcactgggtttcaggcgcagtggcagcgtcctggaagggtccctcagccccggcaagccggtcttattggaaaaaatgtgtgttacgtgagtaagatggctccacgaggactgcgttgtccagtgttggaggttttagaggtgaccacgcgatgcctggacgacccctaagtgaagtagaagtggtctgcttgagttgagtcaatcaccataggaacgcaacacgcattttctcagtcgttggattgctttggtatcttcctcaaggaaagacgttcatcaaatggtagatcgtctgttttgctctgtggagcagccgtgctgtaggcaaggagtctgtgtgactccacagcaactggcgtcagaggaataattggtgacggccgacgcgatgtaaaccatctggaacgaaattcagccaccttggctgatacagaacctgcttccagtgactccagttggactctactgcgacacccaaagagggtgttccttaacccactggacttctgtgaactaggtcatgttcctatctggagcagataatcagcgggggattttgcagagtggctccgtagcaactgaagagatctagatgcttttgtcccagatcggtacgcaactgcttcagttcagaaacttccgacagaagcacacatacacccctctctgcgaagcggttaccgttgtggcacgctaagcgcgtttagagtgtctgcgaaacggacggtggcgcctaatccccctttgcagagtcgttttagctactctgagtgctatgaacattcggctgagaaaaaatatagtggatatccaggctgcacgtgtgtgtatacaccaaacgcttggggacagagaccacgaacccaacacaagcacactgtgcgaaggacccaacaatgtagtatagcagacttgtgtgcggccataacgcaacgatgacgcggagtgctctgctgaaaatgtatttgcttcctgacgtagctgcttactcggctaattgacctctgcatggagccgtcgatggtgcgcctttccaaaacttggctggtttggggagcccatttgtggtcgcagaaggttttatcagttgtatctaccttgccgatctcgactgtttccctagaataatttgagaacttgcaggagggccaccgacgaccagcgcctctcgacataccagttaacgagctaagtgaactacaacatggagccagcgtgcggttgccggttctttgttctcggccaattaagcgaccgaaatttacgtagagggcgccctgtctaaccacggaaaaggaacacgcgaggctcctgactaggcgatggcgtagcaagggtcggacctctcgccgctgccacaagtgaccgcagcgttgcaagacaaaccccggttcggcttgcacttggtcacactacgtcgctctttcagtgggcatccaccttgtagagactgaaaatgcagttcataattaggtagtgggccaatatatttcaatcaaaacgctttttttggatgtgcgcatgcgcctagtgaagctgatacccgtgtgctaggcgatcataggagggttccagtgtcgcagttcagcttcggctgagttgacaggtgaattttaatgactaatcgacatgtggtgtcatgtatgaggccaggtgtcggcagtgactggacttccagcgaacaaagcagttggcggcggttcgctttctgaaggcacacctccaggaagacggggtcgaatgcggtgtccggtgtgccgtggaccggaagccacttttttgaggcctcttggcttcggacagagtcgctgggtaaccggagaaagaacagtcttgtgggacttcccggcgcacaccgaaccggaagaccagcatcgagctacgcgccaggccggaagatcctcttcccgcttcactgcctctgctgcccttgcccacctcggttgctagttgcgcagagttggctggtcgcggcagcgtggaaaacttgacgctgcagttcattataaacagtctcgattgttcttctcaagttgcttccttttgcttttcatttctcacctccctttcgctcgttctcgaccgttgtcacacatcaactccattcacgccggcctacacttcctacctggtttgaaacccggtcttgtcaaaa

SEQ ID NO: 3917 - DNA, 4773 bp, Toxoplasma gondii
cacaattaagggtgttgcatgttttgactttgcgcgaagcgaacactggtgttcgtcgctcctatcggagaaccctccagaaaggggaagaccttcagaataaatatgagcttggcattttctccagtcccgaaagcgaccgctcagcgcctcgtggcgttgacgcgctctggtcacttgacataggatgctcacgataaaccctgcaaagaaaagtgctatagaaaagccaacaagcctgcccaccctttgctcaaggtacaatttcaaggaattcacaaaggcaagatgtatcgagcatttttctcggtccaaaagagatacactaggcgcctaaacacccatctcagatcctctgctccgcttacgcaaatggctttttcggaccgggctgtcgctaagaagggcgcgacaaaaaacttctgcatgatccgcctaaccttctgaacacttctcacttaccttttcgcccagctttctgactgctgactagtggacgcggagtaccccgtcaaatctgcttggctgtaccctatgtcttcctcgaacggcatagaagtcacactggtcagctcgtcaggagctccagacgctccttcggatccacttgaccacagatgggcgtcctcagactctgaagtagcctgatctgtttcatttttatcggaagacgaacggagtttttcacccagtttccggaaacggtcattctgctccgcgggaccggcagcatcggtgttggccaccgtatccacctcatcagacgttaaacctaacgaagcgccacacaccgcgcaagtcgacagcatgtagaggacggctgagaaccgcatattgataacttcgggcacggaacccggtcaagacttcggtgtcactggatccttctgcccacaagctgctggccgtgatccagtgcatttcggcattcctgatggagagcgattcggttcgttgcttagaacagcgaacactcgcaacgccgtgtcatgcttggtcgctctactctgaatcttctcgagagaggagtggcactgccggcctcagcagcttctgtacagttttcgggagaagtgcctctcaaatcgatgaggagtgcacagaaacactacatggtcacagagaaaactgtgacctacactaacgaaacggcatagaaacggtaacagtgtgcctgcgatgtcaggtagcagcccttctctgtctccgtaggcacacggaaactgtgacccgctgcttcaaaagaaccgaattcgccagcccatcctcgacaaccggtacacggaactgttggtcttgcaacgggaggcgccgtgtaataaacttctaagaagacgcagcatcgccaggttctcaacaattcgatggtcgaacacggcaggagacgggctactactgacgacactgtcccagtctcgagctgcatgcgtgccgcagatggcaaagaaatttctccgcgaactttttccttgttcccgttagccggtcgtttctaatttaaatttggttttccggtctacattatggcagtcaaccgaagtcttcgccggcacagatatttgcccttgttcactgaacacctttctgttcggtaagctgccgcgcatgatcgctgacacgcaaggaagacgcgaacggcgttgaatgttaagagacacaatggaaatcgacacatttttatctccgatattgctacagagcgtatgtcttcgcgataaaacaacggtcagggagctggtagaagaccattccggatcggtagtcactccgtttctttgaaacacacttcctttttcgccgttgagactaaggtaaccgatgctgaccgagagagactttcggacaaaagggttgagaaagcgttgaaacgacatctctgtttacgtgctgctgcccaggtgggacaagaatatgttgtgacagcaactcgctctccagtcaaacagacacttcccggtgcgcggtataaaggtaacactgagacttccccacttttaggtgtttgcttgtttacggtctcatgtatgccctcgccggaggggggatattattttccaccgtcttgatccgctgaaaactcgaagaggcctgagcgaacatcgaatcgcagcaatgctgagcagctgcaaacctcagcaaacaatgctatgagaaatggattggagcacggctcgcaaagcgccactagtttcctgccaaaagtggttcgccgtggaagccggccaagccggagtccgacagtgtaaccggtggagttcgatgtctcgttttagcgtttggcgttgcgtctcgacgatgccgcaaaaaacatacctgccagacgcctccgttttttccactgtcttgactaacctccgatgcgcgtgctggttttagggacagtgagtttggagggcattcgacattgcatatgctcggttgaaagaggcatttttatttggcgccagtctctctgtttcgatgcttccacttagcgggccaccaccaggtgaagtcctggggagagttgtatgtgtagcaaccctgtgacacctcaagttcgaggacatgtcgcaagcgcctgaaagtgtacggggctgaaagaaagagtttcagcttaactacagacgcgccatgatctttctgtacgccatctcgaagcaagcgtaacagaaacgttggcagtgtgcaccgtgtctcaccgtacacggcaagatttacgtcgtcgttttcaaggcaaaatcgtcagacgacaagccgtcaagttgagttcttctcccgttgttgcctccacctcgatgtcttacttgctgtgttcacccgcacatggttttttcccgcactgcagcacggcctttgatatggtctagttcattgtcacaaaaaatgcgagtgtctgtatacccggtgcggatcatcagaagtgaacgatcgcttgtctgtttcattgcaccgtcttttgtatttggagttacgaaagctcactgtaaggaacgaaattcaaggcagcttctcggaagagatatagttttgaattgttttatgtttcttacttacacctctttaacttaacaccgcttcgtgcataagacttctcgctgacgcataccttctcagaatgacgagatccgtttccttaattcagtaatgattgccagtcctctataaatcgtcttccgcgcgtgggaaactctaggaaagccactccgggattgataggaatttcaagggtcttttccgtctttttcactcgttttattgccgtgtctcgatctaagtggttttgtcatcatgtctcgtgccgtcgtcccagcttcacatcccttctacaagggttgtgacggacgcacactcttgtgatacgaactctcgtgtacagttgtacagcaggaagttgtcatccaacaacgctctggaggagccacatgagcctgtctactcaaagtgcatatctgtcgaacccttcgaacagggaagtggcaaatgccaggtgaaaagaaacagagaagcagttggaacgagccaaaaactgtgatacggcaaccgcaacggacgcacataccgggtctgtttcaagcaatatttgtgtttgctagcggccgaatgaacagcatggaaaagcttgtccctccccaacgtctattatgcagacgggcgaagtcagctctcacaaactgtgcaaatgcggcaggcgccagcttcggtaagaagcacaggtggttttgcttgcatgaaaaactgaacacgtgtattgcctgtgcatgcagaatcaaactgtatgttcttctatgaaagaagggcgccgctcctccctacgttgctctcaccatgaaatctagggatcgccggtgccatctactatggccagtgatagcaacagacatatctgcctgacttcatgttgctggcgctggcgaaactccccagtgaaaagactggtaatcacgaaagccattacggattctcaatcttactttccgtacttcctagaaagcgagctggtaagctccgtacccgcgaagacaaatgcaggcgcaccggaggaaggggtattcctcagcgtgttcgtgagaaatccgacgacatggacgaagtacagcgtttctaaacttttcgtgatggctaaaatccgttagtgtgcgactgcttcttttgggatttcgtttgttgctgagggggctgtctgtgaaaaagcggagcttgagtcttctttccgaccgccgacgaacagcgtctggcacagttcttccgctcgcgcatgctgtgctgaacaaagcttttcttcgtacaaagaattgtatttccgcgctggccaggcttaccggccaagctttttgtttgtcttcaaacctcaaaaacggaggttacttttcacgggttctttttccacttcgcctgcccctttgtttgacagagcgtgttttttcttcgcagcctgagacaccgcgcgtgtcctgagttgcccatgtctctagccagcgccgagatcgctcggcattttgtcggagaactgatcacatttgcaccttcacacccgcctgcttgacgtcttccaattgcaagtctgtctgcgcttccgttttatgtgtggtagtggaattttcagccgttgcgtcagaagttttggggtctcgcgttgtcccgaacagaaactctgccctcacactgaatacaaaaccaaatgacggctccttcccagatcggcagctactgaacgccagttttgagtcgtgcacctgtttccagtgctgcagaagtgcgcccctcccagattaccgtcaaatatacacatca

SEQ ID NO: 3918 - DNA, 2376 bp, Toxoplasma gondii
ccatattcgcgagcgcgccgcgaatgattccagagagcagagaaacgtggacgagaggctcttgacagagtgccgcgacggcgccggccgcgtccactccctcgactcgctcgcgtccgtcggcgcgtgttgcggggactccggtgtacgtacacccggcgagcagatctttcgcgtccgcggggcgcagacgtcggagccaggggaggtcgtggtcctggatgacgtatccgccgcggcgattggtctgcaggcggtctgcctgtttctggaagagaacttgccacagatctttgcagacgaatttgagacactcccgctgttcccacatgcgcgtggagagccgcagcgaaagccgctcgaggagtcgaacgccgatctggaagcccgctgcctcgaggaccgcgacggtctccgcgcggtcgcctcggctgcggcgcgctgcgtagctcaccacctcctgctggagcagctgcagtccactggcggcgacttccacgaccggaggcgagagaactgcgggagacgcttgagcagacacactcgatccggaaggcatgaagaatcccggtcgtgctccggagctcagcatggtgcagcgagcgatctgagggcaggcgcaaacgcaggagagtcagagaggagacacgcaggcggagaggaagcgagagagaccgggggaagaggaagagcgatcagagggagagaagacgagagatcgcgggggaagctactggaaagagaagagtctcgacagaggggagagagacatcttggtcttgcatgaggcagagaaactgcgcagaaccggaagagagagagaaaagagacgcgcgaaggcggttttgacaggcgcggagggaggggagtcgcagagaggaagagtcgaagcaaggagacaatgcggaaaaacggagaaaagatgccgaaggcttcgcgaagaaatacacgccgtgggatccaaggagcttgtccgatgacgcttatatttgcgagactatcgaaacgaagaagcgatactgttcgcgaggaagggatgtgcctggacggccaccgttggagtcgaattctttttcacgcagacagaaacagtgatgccttctcggattcgctcgaccctctaagttgggatggaaaccagaggaggcaacgacagcgaaaagtcgaacgcagagaggaaacgagacactgacaaagcgcagtctgcttctggcaagcgccttcactcgaatcggcgcaaaacgcgagcacacacgagacgcaaggggcttccttcccggaacaagcggccgacgcgggggctttctcgagatgctcacatcccggctcctggggtgtagtacatggtgtacatacaccgcggacacgacggaaagagggaaaatcaggaagcccacgccaggcagagagctcgacgggaggcaggggacgcagaaaaagttatctaccagcagagagaggtcacgagcaccggcagatctgtctggtgtcgaggagaaaacttcacgaaagcggacagcagccgttgtaaaacgctgtgcatccactcgacgaagcgtaagccagccgagacacaaaacagacgatgatgagagaggctggaagagacggaagaacctgcgacgcgtttctcccaaatccgcgctcgtttctcgcccgacgaaagggtgtgcatgggagagaggcaagtgtacgtacacccgaagtgtgaagctcaccggaaggcgttttctgtgtcgctttcttttttgactgaggcctctcttctctctcccaacagtggcggcaggctcggcgcacacatcggcttatcttcgagtgcagcgatccgaaaattcagggggttgccagacaaaatgtacacactgcgaggctgcaacggcggtctctaatgaggcgtgacgagctcctcaaaatgtttctttcgacgaaattcatgagcgatacacaatgtgaagaaagcaaagacacaacgcttctcggcctcgtctttctccgacgtgaaaagccactttgagaggagtctttttctcctcgccccgtgtcttcttccagaacgccttcctcttgaatggtgctgttccgcgattttctctgtattccttccctcaaagacgctctgcctccttccatctcttccatttcagtccctttctctcgcctaacctcgactgctgctcctctcttctcagttgtctctttcaatccctccctcaattctcttcgtagtccatccttcctcgccagtctctgctgcgatcctgttgcgtcgttccgccgctctccgccgctctccgctactccgtcgctttcttctctctcggaatcccgtacgtctcctgctcacactgcgctccctgacgcgtcgacacacca

SEQ ID NO: 3919 - DNA, 3681 bp, Toxoplasma gondii
aaggaacggattttcaccggcgaagaaatcggagtgaaaaagagcactccaccaccctcctccgattccccagtgccatgcgactcgtcgctgacgccactgtcgctcctgcgccgcgccgaattcgctggaagtgaaagcacccaaccctgtggcatgcacgcgcctgcagaaacgggggcttcttcttgagaccgttccagtttccaattttctgcgtcttcatcctgcacggcagtctccctgaagcgcctcgaacggagagcttcggtcacgggtggaggattcaaagtcggagtgccatttggaggcgggttggagtacacatctcgctgggatccagcaggcccggaactcggtgacgaggcatagccattgagagatggagcatctggcggagattctgcgcacttcacagcgtgggcggcaccaagtggagacgagcgcacaagcaccgaaggctgggcatacacccgcggcacgggcgcccgtctgagagcctcctggatggggtgcgaagacgcaagaagcgacgcagcctgagaggcagcctgcagctgcccatttgcgttcgtgttggaagactgaccgcggctgctgatcgtgctgtatggggcggaagaaaccacaaaggacgccggcgaaagggtgtctacccagctggctcccgcccccgtgtcgttgctgctgcagggcattagaaacgcgagaaaaaacggcgggtgcggggttccccttggagcggagacagcagcttcgaatattgagagctagtgacttgtttcgaagtggcggtcaagtcgtgagttgttagaggtgtcgacggttcaggggttcgcgagtggcagtggcgccttggaagacagggcttcgacgcggcctccgtagggacgaacgcaacgattgaggtggagaagaacagacgtaatagaaagagacgtctgagtacagttttcttgaaaagggcatgaagaaacgctgaacgaaacgcgagagtgaaccgcgtggcggatgacctagaattcgacgcgcggtgctgggaactccggaacagccatatcgtggcaggtcggaatacttccacaggaggaagacatttgatttgtgtcaagcgaaaaacatataagaggattgaagtgaagcgaacgaaatggcaagtgactggagcgcttgactcaaacgccacatcttactcggcggaaatcgcaacagtcgctgccacggcaccccaggtgacggactctgttcttttgcagtccgccgagcggactgaggatatctttcgagaaaacgatgaacggagctggtcgcaacaggaaggcaacctggcaaatgcattggaataatagtcacgagcttgacttccgcgaagatcccaggactttgccgacgaatggcaaaaaacgaacacttctggtatggcacatgcagcaccgtggacacgctcgctggccggaaaacgactcaaaaaccaacgcaaactgaacgcacagatctcggaaacagaaaaacagggcactccgtgccagaattcaacacacaatagaaaacagtgatatctgttcctgcacggtttcccttcagacgagagactgtgaagcgggaaaagataagaaaagattcaatttattgtactcaacgttatattcgctcccgaatataagccgcggcattggtactgaccaagaaaacccaactgagaacaacgccgagaattgactcatgcaaattcgcggtttacattgactctcacccttctattccaccgattcctcggctggcctagcgtgttcactctgacgtctagatggtgtgatggccagatttgcgtggacagaacttcaagggagagtgcactcttagatcgctggcgttcatgcgtgaaacatcttctgcagcagacatgaccgttttcatgtcacatgacagggccgtaaatccacatcaaatgaaagcgcgtacaataattgatcttcgttgtgagcttcgtgagtggaatcgacgcgaacagctgcgccatcactagtgcaactcgagaaactctcgtccctgctctgccacaaactgcactcgaatgagttctttttctctctgcatcacatgcatctacacatgtagcaacgcccactcgctaaacatcagtcgcttcgagcccagatagtcgagctttaagtcatgctccggcacctttggtacggagtacgtacatcatttggataacaacaaatgtacaagcacttcctcgctccatgttttagtgctcagctttctcccattcactgtgcatctgcgtggagcatagcgttttcgaaattggtaacttctgttgctgcccaacacgacgcgagcgctcacggtctggtggcaactgcgcgagacaggctgcccaatcacgtatggttttcatcacagcagtacaagcgtcatggtatgcaatcattttaaagaacacgttctttcatgagttttatctcgatcagatataatgtcgctggtggacggcaatagtagagcggattcgatgacgttcaatcgtggcacagtgtgcagagaaacacagacgtattccgacaggtgatgaatgcttgagcagtagtcattgtcgtagcaccgttgacttgcaggaggagcaagtaaggtagtaggccagtgagtttctgcctttttctgtgtcgtgcaaatcccccggctccgagtgctgcgcaagatgggaccccctgtcagcttactacccagtgccgttcaccaaggtttctcgtggagctggagagcgcggggaaagagaagggggaaagattcaattcgctctgtaatttgtcgttcttgttgccttcacgcctccatcgttgtttcttgtctcgtctcgcgtgtcttgtggggacagtgttaagcttctatcaaccacacaggtcgtagtgctgaaaaggcctatttgtgttgcagcaaggagagttcgtctttgaaactgaggcgtctttcaaagcgaacaccagagtaagacgttacacgttctttttctgcgccaaaacagccgaccgacattatgcgtttgttactctgtgagcaactctcggtgcgcaacgtgcgccttcttttctgtgcgcggtttttgacattggcgacagcgtcggctgaaacgtgctccagagacatcccatggaatatagtgttttcagccctctttttctgaatcgttactttgtcctaggaaacagctactgttcctgcttctccctcgtctccccttttcctagatgaatgctcggagctgcggacggagtcagcgtacgcaaagggtccgaaagcacatcttccgatagctatttgcaatatgaggtcttctatctgcttgttccgggcattattcgacgctatttctcttttttcgtgctatcgatgaagatcgctattggtttctggccggattctcaacccttcttccttggggtccacgtttcgttttcgtgcgcagtttcacgcggccgactgtggtgtgaaggctcacttcaggtggccagagctttgcgcccgctttagcgaggcacacacttctgcgatcacttctttctgcggcagatttttcatttctaaactgcattttcaatattgcgcgggtagccatgtctgcgaatgcgagatgagtgttctccctggctgcaattgtactgttctgagtcaaaa

SEQ ID NO: 3920 - DNA, 2763 bp, Toxoplasma gondii
acaccggaaagaataaactcagcaacagtaaaaccatctaatgccagcagtatgaaagatgattagagacatccagaaaaaatgaatggttacgcatcccatggttggtcttgttccactgggtttgaacaagggtctgcctagtcaactataaaaggcaagtagtcaaccaggcgtcacacttgctcctgcgacaggcacaaggaacttgggggagtctagctagttttgcgaataatcttaccggtgagaggcggagctggtctccatcgtgtacagcgacggatagatcagatacaaaaggcgggaagttttggtagtactgcgtgactatttcttgtggaaatcgagaaaagtctgaaagaagagacagccgcatcttggagtccttatgggtattgtcggagccccgtcgacggctgtgcgccctcatgggagcaagcgacgaaaaaaggaaagactgagagaaacgcaggtagtgaaacgagatgaagcggttctgtgcgtgcccgtgctgtccaccaagaaaccacggtgtttccctccgcagaagatttttccattcagatcagatgataacagtaaggcaagagcaaggcagaaaaggtaaggtgtttactgaagtgacagagaattgaagtcaaggggccaggagacgcaaaaggatagcaattagaaagtcgtcttcaacgacacgtcatacatgggacgcggatgaaatatcccacgagcggcgacaaactgggattcgacagatgagtacaaaggaaccaaacacaaggcaaggacacgaggtgaattcttggctgctaggcatcgcgcaacacatctccgcaaaagcaatctgcggcagcaggagccatatgggcattacaccacagggaattacgtgagaaagacaacgcatgcccgctcaataccatcaatggttattcaatgatcaactctttcatttttagagagttttgatatgccgggactagagaatatctagagctaccgaggcaggctccatgaaaaaaagcagaaaggggaacttacggtaaacgtataacattattctatcaaacagttgcatacaatgcgcaggagcgaaatggagagtatgagcaaaagaaatggggtatgcttgccaatataacctcgtggttcctgttctacgggccagcggacgagttcgcggagagaagagataaggggtggcgttggtacgctgctgcccctgccaattttacaatacggaatacaagggcctcgatgtgtgtggcgttaatgtttggcaagagagaaaaacggccggcagcataaaggggattgtgacgaaagtgtgggaacttctcaagacacgagcctttcacagtcgcaagaaagaaaaacgcctaggaacaaggatcaatggctgtcgatcgttcatcgcgcagcagttcgtatctttcgccaaaaagaagaccaaggaacaaaaaccgagatgcgaaatggtaagcttgtcaaaaacaggcactttcaaacgtaccctcctgcccattgcatttcgatacccgccatagtggactcttccggccaagagccagagccagcaaagcgatagctccgctttctgttctgggccccaagtgtgccatgaaaagccacggaagatgacgatggaatatgctgagttaaaccagtggaatgagcttaaaagaggaggatcgaatactccccgtcgtcgagtactgtagttgctcggtcatgcaagcaacccaagcagccacgatctgcgatgtgacgagtcagtaaccgcagtgggacgcgggccgacgcgaaggatcgaagagtggatcccggcagggggatagtattcgatcgagtgaactatggtattcagctcatgctatagttcgaacagcaatgctccggtatattgatactgtcgagctttccattactttgtagcatggtcccctgttcctgtccccggctagctctgtgtgactgagtgaggagctttttaagtcattcacaagacaggcgggtgggccgcctcaggtgcgcggcggcatgcaagggcaataaaatagtagtattcgtgaaaaacagtaaaaactggctctatattaaggataccgcacagggcatccaaattcaacagcatttttctctgggtgacaaaaagtcgacggtaaccgatttgcgctgcgcggctgtgcgcagccctgaagcacatgtccgcaacgtcgtatgtcgatgggaacagaagggtaatttcggttcagatacgacagcggtttcttgtggtgttctaaaggatggaacaggacttccgagagaaccaacgatccagaaattccaacggacatcccacctattgcgctgagctcgtatcggcccatcgtcctaccagcacattatcttcacttgtacagcataaacggcgacccatctcagcaatccaaaaaaaacagaatattccgcacaagtacatctatgtgtgtgggtaaatgtgctttgtgaaagggttacagggagaaacttctggtatgttttgtgtttcggtgatcgatcaaactccggccgaaagcagattacacgtactgatgaggcagtaactacttgtagatcataatctgaagatgcatacataaagacactgatgtgaggtgtacagacacatgaaacgaacttcccattttgccgccacattcagcagacatgcatgtgttccttaaacgctctcgagtaactcactctactaacatccgatacttcgtggacgtaacagga

SEQ ID NO: 3921 - DNA, 4205 bp, Toxoplasma gondii
atgtatatgttcgtaacgaatgcggacagattacagggattgacgttttgttgtctgctggtgctgcgttgtacaaagaactgtccaattcgttgtgtgcatttgcgctgtggtcttgacaacttcagggtcgtctaaatacctacactgtcgagccacactgttccgtctgtgctgtgcatgcatgtgagcaagaggtgcggttgctttcgaaaggttgtgtacagcgtgtgtctcagtccttcgcctcgtacgtagtctcgcgcgattgagttcacgtgagaagaggagtgcattttcactggaagtaccagcatttgaaagcttccgggaaatgtgtgcgtggcgcgtagactgtgtgttggctacctcggcttctgcacaacgttcagctgaccaggggccaggtagattagaaagcagcatgtggttcccgactgaggcagagccaccttttttctcgactgtcgcgacagcgaagcggggaactgaaaacgcagagaagtgaaagtcggatttgcgcatgcagcggcactagtgagaggctagactttcgtttcggagcactcggttgcctgccaagttgtatgtgcagaggctgtcgcgtctgtgcgagacgccccaagcgaggcacgtagaaagcgcaattccgaccgcgcctggcgttgagaacgacaaaggaatgcctccggcttcctttttcggcgccactgaagtcgccgtgtctgcccggtagcggctaagagcattacgggcgccaagccctcaaactgcgttgggtggagacactgcaccacaaagagacaccgctgcgtgttgcatgcagttaggaaagaagagactttcgtatggagccgcctggaccctcacagagtctcgcagtgcccgcagcagcttctgctcagaaccccctgcaggattgattgcacatgtctcgtctacgaaacacggatttcttgaaaagtaccatctctgttcacattcctcgacgtggagggggacctgccccctcgactttcggattcgcggtcgaagcaatcccgtctagaccacaaaatctcagccttcgcagtccccgagctcgcccgcctactgcgccgcggcgacgtcagtgatctgtccgctgaagaggacgtagtcgtcgctgccgtcttgctttcccgaggccggagtgtagcgaatctgaaaggcgaagggtctgtcgatcgtcacgttcacgatcttcggctcggccatggccatgcgcagcatcatgcccatggccgttgcggcggtcgccacagtcccgttctcgtctacgtcgatgtccgctgcatggaggaaagacgagacgaccaggtcacggtttccagtgatcttggagaagtccgcagaattcacgtcgaacatgcttttgattccgagcacctcgctgaacaccggaatcaggtcttcccggttcgccgcagagctcagcttgaacttgggcatcgtcagacgcacttgctttccccacatagcctcggcagtctcttcgctccgcatctcccgcacaagagactcgatgtacgctacgcctgcgcggaaagagtacacgaaaaaacacgcggcggatatggccgaaaacaactctaagggggaaactccccatgaaaggacgagtttcacgagtcgaccttcccgagaggttgtccggatggacaggaataaaactgcgactccagcaaatgaaattctcccacacaccaaaggatttagagtataaacacactcgaaagtgaacctactgcaaaaaaagcatccaaaccggaaaccgtatgtaatctacgtgtatatttatttatggaaatacatttgaatatacacgcatttctttgtatgatatatatatacatatatatatatatatatggaacagctgcattttgtgtgtttctaggagtggttggaccttctttccctcagtcggcggcgccatcctggcgacctcgtgccctcgtcgttgtttcgtccctgtcgtctcactgtgcttctgcgttgcggtaacttttgatttcttacctagttcggcgctctttttcttgtcgaaaagcgtggcgaggtggtgcgagtctcggggctgaatgatgtacattgcggtgttggggtctgaatagggcagcgcaatggcgacgacgttttcgtccaccttgacagcaagtggcgagtccttcagggttgtgtgcatcatgctgacttgctgctccacgtgcttgccgtttaccagcgcgtggaaagttccagtgtcagttcggtgcttgggaaactgcttagcccaactgcacttgaagtacattgcactgacgaggacgagcttggtgttcgggttgacgtcttgcgccgtcacgagttgtttgatgtgttcgtgcgtctgcttagagacgaagccgttaatttcctcaactgcagccgcggtgtctgcgaaatcgagtgttttggcctcagtttcgcccgcagattcagttttgaggacgctcgcgtacttccggaactgcgggttgccttcgaagtcctggtggacatacacccgagaccccacggcgagctggggagcagcttccggggaaaagccctcttgatcgagcttcgggacggcaggcagggaggaaagtttgaggaagttgtgcatttcgcgcagcgtcggaccacttgcgccgcgcatggccatcgcgaacacaagcaagaccgagaacggcgacatcacaaagttcccgtctctgccttgcgcgcgtttgcgggcagccatcgcgcgctgcagctcggccgcgggagtcgacatggacgccatttcgtcagacttttcgggtttcttgcccgagaaaaaggaagcgagaccctctaagaagtttgacattgttggtgcaatatagagcaaattcacgggcgaacaagcgatgcgtggcgctgggaacgctggagaaaaatgccagggaaaagaccgcgctgcgtcgcgcgtcgctaaaccgaaaaacagggaacgtttttcgcctacctggaaacgatggagctgaacaaaatagtttactaaaggaaaacaagtcgagcaaaactggcgagctcctcaaacgcagctcaaaacataaataaaatggggcgtctcgtcggtctatgcgaaccgtaaaaagctaccctcacgagcgtggagctcaccgcgggagcgactcgtcgcctagccgacatgcacaatagggtctttcagatcccctggtgctccccgtccgccagcgacaccgctgtttagcaagccttttggggcatagtggagccccgtctctgcatttcgcacaaactctaccagggtttccttaaatgaatggtagtgttccctccagtcctccggcgaaggatcggtgtcgtctccgtctcccgacagagaactggcctcccgggctctcctcccaccatttgccactgcccgaaagacgtcaaaagtcaagttgtaccgactgtgtcggcttaaaaacgaacgggtgttccggaaagaaatagaatcgatggccgcgaatgcaaggctctctacatgtcgtttgcttgcgcattaaacctagcgccgcgcccacttgagatgcttcgatgcggctcttgccgttctgtctcgtcctgcacaattgtgccgacaacctttagtaacaccggtcctcctcaattgcacccagttacagaacagtttcacttatctggttcaccccgtcgaattcggttttcattttgtttttccatgcacgcgagaaagaaaagagcttggcagcgaaacagcgcggtggaacgggaccgcgaaaaagactcactgagccatcgagagacagacacaccgcgacagaacagaatgccagcgaggctgtgtagtgccttggaatgaaacccccacctcaatcatgcagagaacgatccgagaccttttcaccatagaaaaagcacctgtagaggtttctgcgtataactttctggtctgctagaagcgccgatgaagggacctcctggggggaagaacttcacggtcgattcgcgtgccaacgcgggatgatgtggcgtaccccccaggttcggaaatctacatgttttttactgtcgcagcacgcggagagagaaattccatttaccgcgtcaaactccgaacggttgtcaaaagaacgcgcctgactaactggtgtcgctgagagtccggacgttcttataccttgactgca

SEQ ID NO: 3922 - DNA, 904 bp, Toxoplasma gondii
gcctttgttttctagagtgccctggacactgtatgcgctgaaatgagtcggcactctctggagcttcaagggcacgtgtttgtccggtgtttttcccaggttttcctttgatgtccgcccttccgctcttcgttgcctttacggtgatgcagagaaggcatgataagaaaggttttctacaggtttctttctgttttgagagaactggagacgcagtcatgaatccctgtgcgaagagcactggaccaagcgactgcaatttactatactttctgcttttctctttagacgtcaaaaagtcgtttcccctgattgcgtccacgtcggtgccgatttaaggcagcccacatgtgtgggatttcttcagaccttctcgaatttttctactctccttcttccaggcttgggcgggatgatgaacggtgttcacagggaagaggccgcgggagagtgtgcttcgtttccttcacgaattttgaacgacaggctcgctcgttgtctgcactacattcacaaaagtctcccgaagcagagtaaaatacgtttctcgacgaaggcggaagtttcctaaatccctatttgttttcggcggtttccccaggtgaagatgcagtagcgctcctccgtcccctcaattccttatcgataccaaaccctagcagattcgtgggaagttacgagaacaaaagtaaacaaagtcacacatagacacagcaaatgaaccgagcagttttttggctacctgcgaatatgtagatagatagatcgctgtattcgcggtataggtgggtcgtattcgctctaccttcttgccctctctcgcaccccattttgtttctcctgcactttgagaggtcaaacactgggtatcaagcccgtaaaagtgtccgcttccttggcacta

SEQ ID NO: 3923 - DNA, 4818 bp, Toxoplasma gondii
gcactctcctgcgaggacgagtgtgtgtctgtgtcctccttttctcccttcctcgcgttggcaacaacgtcaggaaaagcagatcttcaaagaaagcaacccggcactggcggtgggcaggaaacaggcctgccgagttcttgcagacctgaggaaatggccaactctccgtaccaaccggaaggcgcagccaacgtgtgagaaacgcttcttttacccaccgagagaaggaggaaaatgaaatcgctcctgtctcaagaacgcagcggacaccacaagtaggaaaagcagagaatggaggaaaccagtgagttctcgagaggaagaactcccgtcactttagcgtttttttcccctcaaactctctcaaggtccaaaacttcttctttctctgcgacctcgcgcctgtcgttccctccgcgttctcttctgtgtgcacgccgccagaattccctctagttggctactctcctttggtgaatcaaggatgctttccagggtggcccttgacgtgtttctttaggcgagttgtagtctccgcgatggtcatgggagaatcccgcagaggcgaatttacctcttgcggaagttgcagtttgataaaacgaaacccagatccccgtcccgattttttcgcgagttggggtgatctgaaagggaaaaaatctgtctcggttgttggcgggggaagaagtctgcggacgaagctgaggaaaaacaacgggaacggatgcaaactagcgacttgcggaaacgggaaaaggtgacaaaagatgtgacggacgttttcagcgccttcgcgaataatacacggttattaacagcgaccggagaaacaggggcagcgccgccgagagagcagactgtgtgatggagttttacgttacggtggaggaaacagaattgtttggtgaaaaacacggagcaagcgattccgaaacccggtaaaggactgatgcatgtgaacgccggcaatggagagtcattagaaaccttcccttgggaacagcgggacctgcaatcgcgagtcttgaaaaccagcggaaatgaccagcgagtcactagttttgcgtggaaaaaaaagaagtcgtcgacgagacgcagaaaggaaaaagccaccaggggtggtaggatacggacggtcgagcaaccgtgaatttgagagaaaaacgggcatgtgctgcgcgtggcgccccctacaaggcaacgagaggggttccagaaaaaacggaaactcagacacaaagaacacagcaaggctacagacaaatccaccaggcagtgcaggaaaaccagagagctttccaaagctgacgggacgccgtcggggtttttgtcgaaaactccgctgaaaagcctgagaaggaaaccagggggagggggggtaccaactctcgcaatgcgccactggcgagaaaagcagacacgctgattttgcggcgagactcggaatcccacgcagagtgtacatgcccacttgaggaaagaagtccgtttcctgttcaacgagggaagaaaagggaaagtagaaaaagttcagagcgagcaaggaggaaacgatgggacactccccgctgaggggctcaaaaacgcgaggggccctctccgtaaaagcagggttttaaccgtgtgggctgcttgactgcgtagatcttttgacataactccagctcttcctcgcgtgcaaggttgccgaggaagaaagtggaaagtggtatctttgaaagaattttacgagaaagcgtgagaaagccaaacacgcttggggacctgtagtgtcgtataacccgcctgtccgactcgtttagcagtccacgtgccctctgtgtgccacagctgctgcaacattgatacagaagtaggtgtcttgtgtgtttccccaacaacttgagcgtcggttccctcaaagagagttaacggactctttaatcgactcctacgatcatcccatggtcgttaaagctacttgtttctgaggacaacactgtagtaggggctgtcgccgatactcgttatcatcacttcagtccaccactacttgtcggtccgttgcagcttgtccctctgaaccggtctcttgtcatacttgcaggcgccgccatatctgacgttctgtatgtatggtgtactgttagcgctggttttaaccgcgagtaaagcgctgcgcagatgctagtatagtaagcaccatggtccgatgttccgccattctacaaggcggtcgtagaactgccgagaagcccgactctattaaaacggtggctcgtcggagtctgtaaagtatttcctgcgctctctcaactctagtgtttttccccagcagacgacaagttcggtaatccttcccatccacccttctttgatgacccgcagtccagctggagctcgccggttttgttcgcgccagtaaccagagagcgttctttaaggatggttgcctccttaatgcaggatgaggttgcccagtcatcgccgatgtcccttgcagctggacagttttgctgcgagtgagtagaagtccagaatggtccagcaataggaatacgtattgtcattgtcggacagcgaggtcgtcaggagcaccaggctactgagagtccgctgaaacgccttcctcacctttcacagcgtaccacgctccgcggcaaatagcggtgatgggcaactttcctagaacaccggatgtcccacatcgaaaggagttgcaagaatgtcgccagggtgtgagtggccggtaaaaaggattcacgaagcggcaggctgcgaacgactaggcagtgccacccgttagtgtgtcccgggcacattctaactcataccttccccgcagtcgtttggcgactacccaaatctgacggaagcatgtttgctcagcacgtaaagaattcgtctctcgaggaccgttgatatgctgatgacataaacactagcaaaccacgagctttggatgaaattactcccgacgccgcgcaatatgccagaaagaaccattcaggcacaatgtaaatgggtacctgtgatatgaaggagctgacctagccttagctttggattgcacgcattcaccgctgccagaattaccacaggacctcctcaccagaggagatctctctagagggctgtttgaacacgcctttctctgcttcggataggtcaacgtcttctcagatgcagttggcaatccttcaaacatttaaggctttctgacggggggccctctgactaggatttgttcagttgtcctcatatggcacatatcaggaagcaaaaggatgcttatcgagtgtgacagaaattgcaatgaatttcggatagagattttcaagcagttgtttcgtagaagcaagtagaacaggcaaatcgtccagctattgcccctttcatcgctcacacaagcaaggatacaagcacacagtgtggcgtaggatgcccagctaggtttctgccattatgctttgtgccctcgtgttacacgcgtagctgtcaaccatcagagagtcactggcatttggtcgagaggacgcgccacgaaacaaggcgcatcagtcaacgtcggtcacttttcgtccatgcgatggctcaagaggtcgctcaccattatgattgtacgagctgaaggtggtgcgagttgtggcacttagacgagtcgagtgctcaagagtccagaagctattgggcgatccctcctgtttcctgagattgaaatggtgtgcattatatatcagttctacgtgctattgcaacttctttttttttcatcacataactggtgcaccacagggaggagtccatagtggaatgtggaacgttaggaaacactgcaaatatacggtcatacggggcctgggcggcgtcagaactctcagtcgcaccgtctgaacatttctcagaatgaattcgggcacatgccttatctccgtatatatggcgcgatagacacgcactacgcatactgaaaaggatggtgtctttggatatcatgtttagctggaacagggcggtactagggaaggcactaagctttgccaagtcgactagctctggcaggtggctgaaagacattacgccaagctggatgggagcagtatttggttcaaggtggcatcgtacggaagccaatacattaacactgaaacggcatttgagttgacaaatgatcaccacaggttcagttatttcttttgtcaagacgccgtcatcacccgagtacagtagtcattccgctagttggcagggccatagagccattgcgacgcgcgtcaacaccaacggtgtgaaaatgccagaaacgtgcatcaagcccttcttttcttgccgaaaagagatgctgctgatattgcatgaacaacacacgctaccttttccgtctgagcatacctaatttacggatacgggctcacgtcgttttaaacactgcttctgggcgagacgcagtgtgttgttcatcataacctgtagcgctcgtggtgacgatgtcagagtcatcatttcaacgatcgcggaaacagcagcgcgggcgcattcttctttagtttgcgtgacatggattcggagcctcgtcgccgacctccgcattcccccaatcccttgcaagacgtatgttgggcggtgcgtttaagaacgactcgggatttccccgagagttccaagccaactgcagctgtctaatgaatgctaccgagatctcttacccgagtttgttttccatgggttcccttcaacagcatctgctgtcgttgcgctccagtcgtagtatatttatgtcagaaaaaactcgcaagaactaaccacgtgttctaaagctttcaggaggcgcca

SEQ ID NO: 3924 - DNA, 1215 bp, Toxoplasma gondii
aaccttgtgtctgtggttgtgtcggcaggcaaacgaggtgatggaggtgacaccgcgcagcatacgactggctgtgcggtctgcaatgcggaggtgaaagctacattgcggaggtggaactcggagcagtagaacattggaaatctttgtgttctcttgtcattgtttttccgctccatgtctgcgactattttgaagctacccgggtcactgacgcacactgtctgtgtccacctcagtgataaggtactgtcgtgatagagtgcagttccttgttgaagacggaccacgtgatattttgtggcctttccgtgggcgcttcctgaaatttgcggtgaggaaacaccatcacgatccaaggcctgcgtgtaacagtgagggaccgcaccacggggtaacagcggttgccggtcccaacacaacgtcgtacgcgatacgtcagttgatttgagcatcccttagaagacagttgcacaacccttctgacgcaaagaaaattggacggtaggtttttggttcgacccatcgtatagcttgagagaccgcagcaggaggtagggtcgtacagatatcaagacatggaattgatgatggtcgttgagtgactgtagcaggaatcggtcgttcatctcacaagcccgctgccaaaaacgactaaccttgtacgcattccgcacatcacgataggaagtttgctgctgtgctacttgctgtagtttaagtaggccataaaggaacagcccaccacagaaagcaaacagtatgtcccaccacaagctgattgacgttaggcgacatgctgaattatataagcgtgggaaggaggggtgaacctccacggcagaaaacgaaatcaacacgaaaccgatgccaaccaaaaattctgtcgacctctacgggtaactaactctagctgcgccaacactgtgcatcctgtcccagtcaccgagtgcggctgacaccggatttgtatcggcgtttccccttccagcgaactgagctgtttttatgtcgaaataggataggtgggcatgtgcttgtaagttgccacagtgcatatgagcatgacaaagcgattcattaaggtgtctgtacacactgacggcgcaacaaagaaactttgagttgctgttcgccgacatcttcgggagatttctaggcatcgcggatatgcctctgttcctgtcctgttactctgttttccagttatcaaaa

SEQ ID NO: 3925 - DNA, 3907 bp, Toxoplasma gondii
catgcggtcaatgggaggaactggaaagcaaatccaggcgagaaagcagcagagacaggaaggagcaaaagggtggaacctcgtcggcaacgacaagacgaccgagaggtagtccccgaagaacgtgagggagagaaactatcgaccgagcctcgtgaaaaagcagaagaccaagaagagaattcgaggccagaatcgcgtttttttcctctcattttgtgcgactgtcttatggggttttcgtaagaggcgagggaagtccagggggagaggagacaccaagcaggttcagctttgtttttcggagccttgccagtcttagagagactctgccgatggaagtcggcgcgggagcggcgtctgtccacagaggcacagacagaggcgagaggcgaaaggcgttcggaagaaaagggtgcatgcagtgaggaagaatgtgctggcgcatttgctagagcagacatagaagcccatcgtcgcttgtcagcgtcgagaggaaggccgtgcgaaggtaggtagtagggagtttgaaacataaacaaaaggatcaggaaggcgagaacagcgtgatttcgtctccaagttttgcctttctctgcctcacgacgcggcccaccaagccggaggttgttccgcttgtctccgagtggttttgctcctgttactgatcctgaggaattcggtcgacattgccctggagtgacggatacagtgttgcctactaatgacaacttccgtatcgcagctttctcctgtggaagcgttcttcggaagactcgagatggatctttatcgtttcgctctaacagcattccgtcctccatctctccctcgtctaagccttctgtttccatccttctgtagggacggcgactgccgaatcaacgcggacttgacatgcgggtcgaggagtggaaacaagtctcaggcaatgcgcctaggcagaaagacggggtaaagagaaacgaagaaaaacacctagagacgaatgcaggaaataacgagagaagaagggggaaagatcgtcggaaggaacggagacgagacaggaggcgagacgcagcaagagcaggggtcagcgaaacatcgaaatctgcgtggacgtggagggaaccgcgagaaatcgagggaaacgccggaagaaaaaaggccgccagaacatgcgaaagacgagaaaagataattcttggatcacctcgcgtctccacttccgttcctgcatctgttctcacggaaaacgctgctctatcgaccgttacgtcgccctccctttgactcaccaaggcacatttctgtctcctgtgtctcctgaccgttggaacagactaatttacttggaacagaaccaaggataaagccaagtacaggttagggagttttttccttttagctttgcaattttcgacaagcaacaacgggcaaaacggccatgtcttgaaaagttaaggaaagcctcacaggtgcgtattcggaattccggggctgcatgcgcacgcggcaagtctcgtcgtgtgtctcgggaagaaacgaaacaccagtgaaatgtgggaagacaggcagaacaggaggagttttcagcgttagttttcttcttcatttcacctaccattcgcgatagtgctccttaccacgggagtccctactctccataatgcaaggcaacagctcctcccgcacgaaacataccgcttctctatctgtctacttttttgtccatcttcaaagctgcatcatcagaggctttcagctaaatcgcggccttttatttactttcttatttgttaatgcgttttgaaacacgaagcgtccgaatttttccgaacaaagtggcggcccgagtgtttcagcatccaccggatgttatgtaggtcggtagatgaccgtcgcctgcacgattcacatactttatacggaaggtgtagctaggaactacgtgtataaatgaatagaaatatattaaaatgtgcagctgagcacagggcatgtggcaaatagaatgtcgagcgaggtctgcgggtgtgtaccgtcattttatatatcgttgcgcgtatgcggacctggttaagagtatgaactttacaaacattaaataggtatatggacaaagataatttcgtcactcttcaatttccttgatatgcttacagcatacagagattaaggtatgtttgcactactgcaaaagggtataagccgtgctgctgagaaggctgtaggcgttccgtacccacacggcagttttctatgtttcgcccgtttgtttcttgcaatggacgaaaagtagacacacatagagcaacgacagactctctgtcagtctaactttttcatactctcccatcccgctgtcgaagacaaaggagtcatgtttgtttgaaggctggaagactggttagctgcagcgggagctcaagcaattacgaagtatcaagagtggacccagagtcacttggtcgggaaagtaacttacaacggaaaacgaacgcagcgaaattactaagaagcaaatctctttgccgcaatacttcgttcattgtttccatgtacgcgcattcgtttatttatactgtggttccgtcccaccatacttaagagagaactgtctatcggatcatacacaacacacgtgctccttatcgctacgatatcgatcctaagagacttcgtagctgctttcgttgtaatgcagatgcttctcccattgttctttgaattccattttcagtccgctcttgggcagaagttttcgttctatcgccctgaagaatgtgacgaattcgtacgtggacgaagctgcattttttatggattgagccggacattttcttgcctattttatgcccagcccaaatccattccctttggcttcatgcaggcgacatctacaatatttttagagggccttgacaggctgtgttatgctcgagagtgagccctcacagctttttcctacaccggggacacggctcgcaggctgttgcaaaagaatcgtgtgtttccgatacgtccttaattatcctcgctttttgtgaattcattgtgttgctgtgcgaaaggagaaatgctttgtcttcgcctggcacagaaaccgttcccaatccagcgtattatccgtattaccccccgagttagagacgagacctccagaggaaagcgcacacagccatacacgtgtaagccttttccttcggcgttttgcaatggtgtgaaacataattgttttctggttcctgtctcgaagcttctgtctctccagcacacgtcgcgttactggaaaagcgtttgtcagctatgcgcactgcttgtctagctttttgctcggcgccaaggcgactcatccgaactcgctagtttgcagttttctagcttctctgggcaaagaaacgtcaccatttagagacaccttcacagatatcctttcgtagaagagaactactgctggaatgttttcagtgcttcctttcccctgtagcaaagggtggtctcagacaatgcgtcgactcggttcccgcgttggattttagtagagtgaaaagggtgcctgcgtgttttcacaggaagccatgtagattcacgtttcgtattgttcatggactggagccatttttggcattcgcactagtgctggagttttccgttgttaatagtcccttatctttcgcgagtttttccagactcgaatcactggcgaccgtgctggcggttctatcgcgttgagctaattgtaactgtgctctcagacaaccgccgtacgtgctagtttccattcgttttcgcaaacatcactgcattcctttctggcccgcgatcttcgctcttgctgcggaggaacggcttccgttttgatgcgagacacacgtgccggtatctacagctggacttgagatgtagtttttcactttaagaa

SEQ ID NO: 3926 - DNA, 2015 bp, Toxoplasma gondii
attctctacttgtgcctcttcttgtacacataggagtctatgaaggactctcagtaaaccggtctgcacgtagaaaaaaagcgagtctctttcctgcgaggcaggtgcgatggatttcaaatcgagagacacctacgatgcttcgccgccatggtgagttggtgtgggtccggaaggactggttagggagaacgaaggaggaacgaagaagggagagagaggaagaatgtgaagagaggagaggacgggaagaggaaaacttatatctccggcttcttcttagtgacagtggaagagaaagcagctcgtgaagacttccgaactggacacgacgaaagaagacggcagagcgtcagtgggcggaggaaacgaagaatttcaacagaaaactcagatgatcgaaatacagcagacaggcaaagacaaggcaagccgcggaagagagaagcggacgaggggagagccgacaaaactcgtaccgttgaagaccgtgtcgaacagagacgacagaggaacaggacgaggaagggagaaacggaggggaggaataacgaagaggtacgagacacttgcttcgacaacagctgccagtgacagcgccacaggcctttcagaagcagaaagtttgcggtaaggaaagcaaacgggagagaacgaggagagaggcaaaagataacagccggatctgtgtttaacggttcactcagacaacccctgtggcacttgagacatcggtagtccagcagatcgaaactgacggagaaacaaagcaggggagaaatcagagaaagcagagaaaagagataggtaaaggaacgggacacaaacggaagcgatgtcctctctgaaccgaaaatcctgcgttccaccagcaccgaggtacagcggcaaaacctggaaaaaccacaattgtgtgggccaggagctttatctcttcgtccaggccagggataatcgaagggaagaagcagaatgtggtacgtgagcttttcccatgtagtttctgtctcccctcgcgatggcgggacggcattctgcgatttgcatttcccagatgtgtgagtgcatgcgctcttctgtgcttgagcggcttgagcggcagcatcgcgaaacgaagcacgagtcgtcgaagcgcactcgctctcccttacttttttcaagcgtgttctatacagagaagtttctcatgctccattttcctcgtacgtcctctggacccagaacgcgcggaagaaatccgcaaccgcagcagaggcgttcgtaatcccttgctgcaacaaacaggccagccatggttctcggagctgctcgattttctttcctctgacgttgcattctctcaagaagagagtcagatgctcgacgcgcggagactgtctagagagagagcgacgctgtgcgtgtgtctctatagaaagtgtggcttaccgcctgcgtctcttcttccgcgtgaagtaggtctatgctttctccgcatctctccccatttaaattttcaggatgcctaaagatttgcacgtgcgtgtgtatgcagaaagttgagacgtgagtgtctcggaatacaatttcggcctgtgggtacgtgatctgcttgctaacaaaggaaacctgccgacgccagccaccctttttctcgagacccggctggaccggacttcatgacaatttccttttttcccccattattcgtcaacgtgaccaatccacgagggagggacgggcctttccatccttctgctttcgtgctggtgcgtgatcgttgataaaggactctctctagcgttccatatttctcatggttctcttttgcttgaggcggaaacgcctgtttcaggacgagacagatctatagaggggatttcttctcctaccgcgcccgtaccatccgctccgcattttctgtcaattcgtgcctggtttacgtctctcttctggcgcccgggtcggaggccttgaaggacttttcttctgggtggtcgagttctttcttcctctgtttcttctctccgcaacca

SEQ ID NO: 3927 - DNA, 2376 bp, Toxoplasma gondii
aggtatctgcaaggatgacactttcgacgactttgcggacacctagagcgacttcatgttcctctgcagctcctccactccgcgtcacatctgcccgccagtcgccgctgaagggggcgatgcctacgcgacagagcagggacgcgcgctccgctgcgcctccagagcctgctgccccgccctggccgagtacgctgtccgcacctgaagcgtcgaagccctcctcgaggacgccacgctcgctccacccgccaccagaggccgacaccagagctcgacttgcgttgcctgcacccgcgggaagcggcctggggccaaagacaaacgcagccactttcgtgctgccgaaggagaccaagctacggccgtccgcatgcgtgccgacgccaccagaggcaaaaggagcaaggttgttctcttcgctctccactgaagagtcagcttttcgcgggtcggaggcggaagcagggcgagcagacggcgaaggaagcagggagggaacgcaagtcgagaaacgcagttccctcagctcgtggggccggcgtccatctgcgcggagaaactccagggagggaaagagcgtggacagggggtccgaaggcagctgttggctggccatggtgtgagatgttaagacgacgaagaaacgcggggacacagacacagacaaacgcgctcagccgcaggcgtacccggctgtcggaatggacgtaaaggtctagtccatcgcgtgagtcagttcaaagggacaggtcgcgcgggaagaaacaagaactcccagattaacagaccgtcgtcatttcatcagactacttgtgaacgggattcacaccaaagcgacctaccctcttcacattctcaattcactaggcatatcctgagctccaacgacaacgaagtggaaggcggaaacatgggaagagaagcaggcaaagcgtaggaagaattgaagaaatcaggcattcgcccttttcgcagttgaagaccattaacaactcggtaacgcaattgctgcagcgagttgtcagccatgctcagaaaaaacgcggcacgaatgtgaagagactggaaaggagtgacaagcagcagagaggctacttttagaccggagcaaggcaacacatacgcaaggttgaccttgatgcaagagaacggcgtgagacaacgaatacgagggctggcggaaacgacagtgtcaggcagctgcgagggacttggacctacaggagactgttgaagacggatatcccagacacatcagaccaagggaaagctgaactaagacgagatttgttgcgcgtgcattctgattctcctctggaaggataacgacatattttcattgcaagagaataacaaaagatgccgttgagtcgtccggtgccaccaaatgcgcacagggtcgtgcgggttccaccgacaaatcacagcctgcgtctcagttgagtcagccagtttaggaaagtcaacagcgggcaccgtattcggtccgtaatacaacttcgacaaaaaatgaagaatccctactcccaccccggtaggtatcgatgcatgcgcgcctccgcggagcctgtcgatgcatgcctaccagccctgcaccttttctacgatcggaaaatccggtgtcctaccagcatgcagacgagaggagctgggcagctgggatgcagcggtgacagagagaaacaaacaaattcaaggatgcccgactgagtttttgtcactttatcaggctcttcacttcctcccttgcgttttaacgccggtggcgggtgtatgtacacttcgcttatgcgcggagtcgcccagtttgtctgccagtgtctggagcgggttgcatgttgtcttcacttgttttctttgcttctggactgcatttaccgtggaaacaggtcttttcagcgttaaagaaggagaatctctcgtttatcccgttttcccctgttcaccttcgaatcaacgctcttccaatgttccgcccgagccttcttttccggcaggtggcacactgtccaagcaacggagatctactcttgtagacggtctgctgttttccccgttttcgcgcccgtgattcgctttgttcatccgcagttcgctttctctcacttcttcgtttttaggccactgggctgcgtttttttccgtagccgccgctgcgatccgccgcccactcagcggcggcaagtcggcggcgtccgggagcaaaaacgcgaacatacggtgttaaatctctccatcgccgttgaagagtcgatattccttccctctctgcctcgagatgctactagaccggagcgctcgggtcccgtccccgttctgccgaatctgtgcccgcctcactcctgcccctgttgcactcccttgcggcaatta

SEQ ID NO: 3928 - DNA, 3025 bp, Toxoplasma gondii
ctgtgcatacacgcgctcatttgcttgcatcacagacgtcgtgtctctccgtcgagacagttgatgatcacgcccttcacggctgcctctctgtcggcagcagacaggccggtctccccggaggggcgcgaacacacgagcaagccaggagaaaattggaagcaaacacggaaggcgacgcaaggggcggaagcgcaaccgagacagctgatcaaaggggagaaaccgaggctgcacaccaagaagcggagaggagacgcggccaggcgtgtgaaacagagaacccagacgagaaggaagtctgaacgaaactgcggactgacctgccagatcgagagggtaaatgggagcaacagctctccgccctccactgtgaggcatctcccccgcatcgtcgagcgcatggtggacccccattatccttcgccgtcaaaaaacgctccaaggtatttctctgcggcgtccgcgaacttagccacgtagcgccggactcaacagcacccgctgccccacgcaagagagacacgacgatgcagacaggaagacaagaagagggtagaggagaattcgagagacaagacgggcagaaggttcagccagaggaagatccggtgcagaaggacagcacgggagcggacagcaggcggagaagtcgcgcgggcgtggagaccggaggtcgcacaggcgccgccgatatgggggaaagcagttggggcgtggttcgccgaatgagaggcggaaagaggaactgtaaacgacactcgaagtggggaacgacgaaggtttcagggccgaagcgctgcagagaagaaatgcgaagcgagaaccggcgcgggggagggccagcaaatcacggcttgctcaaagacggagacacagacgcaaccatcgacgagtgtggggggtgccgtgaagcagaaacaaaaaaggagaaaaaggtgggagttttctctgacagatcaacggacaaaccgattagcgctgagcgacggtttccccaaaggtcttcgccgcagaccgcatgactctgtgctgcgggctcgtcgatgcgcgcaaaacgcatgcacggggaggggtacttccgagggacaaccgacgggacctgcggacgtctttgatttgaaacagctctggagacgaaaacaggaaaaaagcagaaaaattcatttcacacggcagatgtcgcgtgcgtggaggctcagtcacacaggggcggcgagactctcgccgcgaagcgagacagcgattcgcgaaacgggcagacacaccgcagcgcgaaacgcggcaagcgcgagaggggggtctctgggaggaacggcgggccaccaatttaaggacctcaattctcaggaaaaacgggagattcactccaaatagagtaaggagcgcctactacctgcgttaaaagcgaatagcgaacaactaaaaacaaggacgtgctggaaccgctccggcctcccgtagacaatcgaggtgtatagacacccgagcaagagagggcagactctcgtctcccaccccccggaaagcgaagcgcttcgcgccggagccttttcgaaaagcgtcaaatgtggcgatagcgttctttcatttggaaataaattgtgtttcgacgccacacccacacctgcgagtttgacggtcgtgtaaagagacaccgcaacgaggcagatacagctctcaggcttgccagctggccatccagccggctagagaggcgggtcaccagtttcccagagaaattatcaccacctcctcacgaggtgacgatagcgtgcatactcagcaaaagtttcctgcagatcttctaccttccacaagatcggtttccctcgctatttcctcagcaggagagacatccgacgagggagaaacgccacgcttgacgcgtcgtatgtgccgcggttgggcgcacagtgtgcagctcggaatcgggggattttttacaacagtgccggagagcccagctttccacagtctgtccgaaagcacatttttggaccctcgcggaggtgacgaagtctttgtgcgaagcgcgcctcgagtcgccgcctaccgcgctcgggcgtgtgaggaagccgacacccctcaacggcagtccgcccgggcgggaagggagagacggcggtttccggatctaagccgagtcttcttttctccacgctgttctcacggcagctgggcaactgcatttttagcgcaagcgactatcttttgaacgagcggattcgacagagtttatcgcgacagagcaggccggaattctacgcaaaaagagttttctcgacgagttctcgatttttctcgagttttcgcgtccacgcatgagtgtccacggcaaaaagaacagctccgccgcgcgggcagacagaccctgtttcttttccagttcgccaacaagaggcgctttcggggcctgtcgcgttgatcgcgatttctcggctccttgacgaatttcaccgggttttctcgtccgtcttcgcctgtgcttcgctggacgtccaacgctttcccgaacagcgaactgcctggcgaaccgccactgcctcctcaggacgacgcggcgaaactggggtttctgcgaattcggggatttcctccctcccgtcgcatccggtgccggtcaagtcacgtatcgagcttttgcagacaggagcttcagctgcatgcagcccttttgcgccttctgttgcttagcagaacgtgttgaattctcgaatgtcgaaggcctctgtcgcatcatcgcgaccttctgtcccccagttttcccgcgtgaccgcgtctctctcggtttctgccgccccgcctgaccttttccttcacgccttccagcgtcagtcaacgccggtctcgccattgttttccttctccccttctcctttccccctgtagccgaaagtcatctctgtgctctccccagccttctctccacccttcccctcccccgccttcgccctgtggtgtacgttccctcgagcgagcttccgcgctttgccgctcctgtcgtcgttctctttcgccgcaa

SEQ ID NO: 3929 - DNA, 2097 bp, Toxoplasma gondii
tctgcatgcagccgtcttgcacagattgaaaattttgattgagcgggttctttttgtgtgagggacgagggaacttgttttaatgaaggaaacaagcgaatcaggggaaacggcgggtgagtgcggacacctggcacccagtctatgtggcagcgatgagagtgacaggcttcctagcactgaaggaaacacctttgcgaacagttcgttgtacagaaagaacggaacttttcggtttacaggggcccccagtattatgtaaaattttgcgtttccagtccgtgtgaggtcgcggacacgctcatgcattaccttcgggactcgtcgcgaaaccacattcgtggactgtggggttccgttactgaacatcagaacaaagcgctgaatcgttagttgttccgtgccagcatatgggccgagaagtagctgtaagagcagcaacttctgactgtacagagtctcagctgatggcaaaactgaatctggcctgtaccgcagcataaccagcgcgtgactggtgcactagatgtccacaaattattttcgacagtatatatatatatatatatatacgtataaggagtggtgaagggcagaactacaaaaagaaatcccggtcaaagtgtaagaggaaaaagccggtgacacaacgggtagagtgggtaccagcagtgcagagagtctattgccagtgtaggcgtgtttcaataaaaaagacggctatttcgtgacagaaataatgtcataaatgtcggggtcggtgggccaggatggagacaacacgtgtggtgcttcaaacccatacgccataaccgagagtcaggaggcccttttccccaaataagaataaagcaggcgaaggtctaactagtggaaggggaagagtgtaactaataactgcccctggcatcgaaacaaatttgttctcaggggagccgagacaagaagtacttttgctgttgacctttctgacttctttcggcatctggaatgctctctttagctcaaaggccggaatcattgacgacggtacgattgaagaacgcgaattcgctaacacgtgaaccaactcaagcgggctggtacttgtctctgtcgaggaagtagtgtcacattactccattggtggcatccttgtcgtggtttaagacgcatccaatttcttcgtagaagataaatctggtatgccccagtttggaggctatttgaataagcccaaatggtgtcttccggaagggcaaaatcgtgcacaccatgttcccagcgccgccgcgccctccctcgtccgaacagtgtagacactgaattaatttcggttagcaaaaatgtttgctttccacgtgtccaataagtctgcgttcacgacactgacaagccaccttctggtacgaagtgattcgcctagtttcgggtacgctaacctggaacgggtgggtcactcggacaggacgaggcgtgagtatcgtgcatgcgacgagagccaaaacgttggcatgcaatgcagttagctgactgcctcgcgcttcgtgctgcactctttcgtcgacaaaacctctacaaaatctgtaaaataaaagaatgttcgccattgttcccgaatccgttatttgattccaatcgtgagtacgatgagggtgcactgtgagtacctccgtcgacggaaatcgcatgataccttaaccgagttacttcaagagtgaaacgagacaagtctccaccatcgtgagaaaacttgccttatcgggtgacaggaaatcagctgacgcgacctgtatgaatgcaaattcgtgctgtcccttcttcacaagctaaatttgagccggaggagaaatccttgttcgttgcgacgacaccacaaggagtcagggtgcctcctctctgatatccagcctttttttgatgacaactggtcagcggtccacaccaggatcgccactggaggagaagcgtagggttcctaacgttttcgatggtgccttttcgagtctaatgcgtcctttctgtcgtccagttggagcattgtcttggcccattccggccgttgttgcccgttgctcgctgaatagtggtcaaagcagtttttgccttcaaaaaaga

SEQ ID NO: 3930 - DNA, 964 bp, Toxoplasma gondii
ttcctctggcccacctggtaggtatgttggataccaatgagagtggaaagctgttcgtctgagagctttccgtctgcttgcttgctgaggtcatctttgaatttgtctgcctcggttttcagcagattttctcggttgaaatgcgcattcagcgtcgcgcggaagctcttttcttctccctcaaacgtcctctcctccaccgggtcgttaatgtctgcggggacgaagacgaaggtgaacttcttgtggacgacgtcgtcgagcgacatggtgaagaagtcgccaggaagcagagcgaaggagagaagaaagagagacggcaaccacccgagacagcgccgcggaagcgaagtcagacaaggagaaaccggccacagagcgcagagagaagtccttcgaagaaagtcgagacagacagagagcgaaatgcagacatatgcggaagaacgaaggtccaggaaggagacacacaagagcagacggtgagtgtgagacgaggagaaaaaagttctcgcgatctctcataaaagaccaactgctgcacaggcagacagatctgttgttctctgcatgcatgcactcaaagttgaaaaaaaacaggatgtggatacacgcgactccgagctgaagagtttctgggcatggagtttgtcgagaggcgagagacgcacaaaatcgagaaagaaacaggcgcttccgcgcctccgaagaagggaggagcctcggcagcgagatcgacggagaccgagagactccagaaagagcttcgccggctgtcctctgtgaggcgcgaagaggaaatcgaggtcgagaggaagagagaagaaaaacgaagacactggatgcaaacgaagaaaatgaacgccgcgtttcctcgaaagaaacatccccgcgcgttgccctttgcgtcttcaggagacggaaaattcgcgggaacatgactaaagacttttttttctacaca

SEQ ID NO: 3931 - DNA, 2551 bp, Toxoplasma gondii
cgcgcaggtgctccggagacaactgcttcacaagcaggttctcttcgaactgtctcacgacttcgcgcgagtctccccgagcgttcagcgcttggaagtagcgcatccaacatgcaggatccgagggatgccgcagcgcctgctcctgcaaatgcttcagagtcgaagcggtcgcggacgaggcaggcgagacagacgcagagggggagaagaaggaggcggcgaagcgcggcggagggagagtcgcgaacggacgccgaaggagtgcagcgggcgtctgaggaggacgggagaaggagagagacgaaacgaaaaaggaggagcgaggaggacgtttcagagtcgtgaaaggagacgaagagcagcgcgattgaagaagagagccggatccagaagaagtcgagggggagcagacagaagcaggagagagagagcagacagaagcaggagagagagagcagacagaagcaggagagagagagcagacagaagcaggagagagagaagaaaaggagcgagaagagaaagagaggcggcgatgcaggtggcgcgcggatgcgcacgaggacgcaagtgaaagagagctcgagagaaaagttggcaaccttctgtccccgatttggatccttctcacagccacagtcgacaatgtcccctgcaacgccgcagcctgcgcgggagtcccgcgcggcccgaggggcgcctgagccagcagagaccgcatgctcttgaaaaaaagaaaaaacagacagcttgaaaacgcggagcgaaccgacgagagtcggagacccaacgttctctctctgtcttgcagcaaaaatgggaggaaaaagcaggggagaaagccttccccagatccagaagtccacctctccgtagatagcgaggcgtgacgtcgcaagccgcagaagagatcacagcacgttcagaaacagagggctctctctacatttgtcggctttcgaagacgaagaagaggaggaaattcagacgttcttcctttctgcaggaggcggagtctggaaagtcgagtggagacgcgagagacgagacgccatgaagacactgcttcgtcgcaatctccttcgtctccgtcttcttccacgcgacgcgacgcgtaaaacgagggagagactgtctgtgaattccgagaaagaaaggggtaaacatgcgcgagaaccccagagatacgcgaaaggaggaaagggggaggagacgctgcagagaggcgcggcgtctcgaaacgcattccccaaagcagggcagaaggtacacaggcggcacgatgcaccgggcgaagaggagaagaagaaacaaagaaatgcaggggagagaactgggggcttcggagttacttttctcttttcaaaggaaacaaagagacaccggagaaacgcggcgtttccggcgtaaggaggggcaggagaacattgggagtatttgcgagaacaaacgccagcgaaggagaagaaacgttggtgttgacgccggttgtcgcgtggaaagacaagacgagaaaaaaaaacggaattttctggaaaggaaaacgcaaatgctccgggtgaaaagcgtaccgcgaatgctgcagagacaccgcggcgcggcagatgcggcgcggcagttgtgcagattccttgcgaatggaccagttttctcggcatgaaagaagcgaagacaatcataaaagagaccagaaggaaagactgtcgcgagtttctcgcgagaacgagagcggtgttgtgtccagaaaaaaaaaacttctcgacctggaaactccgctactgccgcgcacgagaaagccgcctctcccgcgactgctgcgaacctgcgcgggggttggaggcgcttttcggtgagaagaagagccgcagaaggctctctaaaaagaggatattgcgttctcgagaaaaaagggggactctgcttctgatgggtacgaaagaatctttaaaaacgcccagaatcgacgcacaaacgaggtccctgcacctggaacgcgcgaggcctcgcgactttgcccccctgtctggcgcagccgcttttcgctgaaacggcagcggctgagaaaagcagatttctacagatgttccctcccagtctcgtcgagagaaggcagcagggagagggaacggacgcaacagaaagcacgcaagggcagcagagaggggagagaaaaccggaagaaagcgaggaaaaagaagagaagaccgagagaagaacgagcgaagaaagagcgaagaacgagagaagaaagagcgaagaaagagcgtgtgcagagacgcggagacagtcgatccgcagacatgcgaaactttgcatgcagcgcgagaacgaaacttggccagaaaacagaaaatgccgcgtttcccgatgcttctcgtctctcgatactctccgcaaatctcgcttttcaagaaactcgtgcgtcttctgccggctttcactattcagaggacgcgacttgcaacaagacgagagagaacatgagagggagaagccgacagaggttacgttcatggagtccagagggagcaggaaagcgcggagtcga

SEQ ID NO: 3932 - DNA, 4895 bp, Toxoplasma gondii
gcaagtggtgagagagggaatcagatgcgagtaagcagctctttccaggagagaagcgaaaagtcggaaagcagagtcaaccatgtaccgattctctgtgaagcgagggaaacggtgtttaccacgctcaccgctgtcggggtgcagctgcttggcaagctcagcgaatttcttcttgatttctgcatctgtgcaagtcgggtggagacccagcactttgtagcagtctacgaatcgacgtgcgagcccatgccccgccatttgcctcttaggacacacagcgaggtaagcaaacgcagagaaagaacgacgaccgatccgcgagacagagctgagtcactcgaggcaaataaacagcggcaccacagtaccagagacactgaatatgacttcggcttgagcgagagtctacccaagacataagacagtagagagagacgaaaaacacaaagagaaggcgctagagaacaaaaggaagtgcgtgactatggggagagaaagccggtgggacgaagaaaggcagagaggacgagggcagaagagtttgcacggagaaagaggcggaagacaacgggacattggcagactactctcaaaatctttgtcacacttttttccgaccacctaggtcaacagcggaaaagcgacggggaaaaaaatggaggcgattcaggggcaacagtgaccaaaacggaaagacagcagaagtccgagagccactctgttgcgctggcttcgctcgtctctcttgtcctctttccttcgatccagaaagaatggcgacaaacagcgtggacgaatccataggagtcgagaaaggaagttagaggaggggtttcgtcgttgtttttgacgaagagccttcgacaaagtgttgcgtgtcgaagaggaagaagcaaagaagagaaaggagactgctgcagaaacgactgcggcgagaacagggtctttgacagaaaagaggcccaacgtgatgcagaagacggggtacggaacactcgaagcaagtcagacgagaagttgaaaagcgacgacgcgggaaaaggagacggcggtttcccgcaaaagagcctcctctgtgttacacatcctttcatgaagagatccaggtcacggccagcaggtggttgactgcagttgccagtttcgcctctgttgtccggtacagcgagaaaaacaaacacgtttctggagcattgcttcgggtgtatgtacacctgccacagctgactcgcggaagttgttcccgaacaaccggctcgtgttggctacgcggatcctgtttcagggatgcacgcagtagatggtctttgcttttgctagcactcaagattcaaaggttctgatggtgaacgcgagtgaaggcagtgaactgtatgccagctgcatgccatgggaaaccatttcacgacgtagcgtcgtgcgggtaaaagagctaccgtgcttccagtcttcggtgtcgcttggaggggcttctctggagagtggcatcagaaataaaaccgaacaaacaaaacgacgaggatgtcggaaacgaagacagagatcctggcagctctcgccgcatctagagagcatcgggacgatgcatctgccacgaacaacgcaactatggaaaccgacagcgaaacgccaccataggagggaccgaaatacgccagaaacctgggttacaccgtgaaaaatgacgcagagtcggttcgtccacgtgaaaattggaacggggaaagtatggtagctaggaaactgtccgtgcgactctgcattgcgttcgagagaggccaacacaacgaaggaaaaacaggaatcggtgttcggacacggcggaacgagtcaacaacagatgcgcaacaaaacttcagtgggaaaacgtggccttatcgtcgcaaacatttaattattctccttcctcctcaatatcacgcttgcgccacctttgtctttgctgttgcactgcgtgtcaactggacgagtgctgaaccgtcggtgtctcgtcgcccgacttcagctaaatccttgtttacggtcacttttacaagttcctaccactgtggcactcacactggtgatgtttctgtcttttcaaaagtgaatgccatttatgccaatatttttgacacacgctgcttgggggcccgacactcggtgcaacagtcttctggtcgagtaagtcttatcctgggtcgacgcttcatccccttccagtttgagatctctgttactgtatgtagtacgttaacgctgagaatattggatttacagaaagcacatgcttccgagtcttctacgttaatgaatgttgttctgttgctcaagtccgcttcgtgaagactgatgtttcttgacatgtcggtgacataatcagtagcactcatccatttacacactttcagggaaacagagaccaactcggcagtgtccaggacagagccgttgttttactggctgtcgggaagacacggtggcgaatcgagcaagtgtcagttgattgaggcaacaactacaaaaagcacggacgagtgtggggaggaaccctcgaacgggtcgcgagttccacttgttcagtgaactcgctttccagaaactgggtgcctttgtcggattcatcgacaacgtagaaaaacgggttgatgtgtcactgggggtgaaggcgaacacacgccattgtcccagagctatagcggacgatacgagacgatgagcatggcgaacagccgaggcaatgcgcagtgaggatgtgatccccaattttagaaacatctgaagagatgttcttaaaaaacgctgaatcttcagggaattttcgagtcgactgaggtagatgggacgagatgtcttcgatgtcgactgagatggcggcaaaaagttcccattcttgcggttccgaacaagaaagccagttccagttctagcaaccttaggccacgttatccgagttgcttccgcctttctaaaggaacttgtccgtgtcagcgacgagtctagaaagactcccagtgcaacgaaaaagggttttcgatgaaggtgctgtacacggtcacgcaagcattcacgctcagagatcgaccgtcgcacgtcttccgtgaaagcgataaaaaaactgcaagagaaaaagcaatgaggagaggcgataccgctgcggagaacaacgcgaaccgaatgcgcatcttctctgtttgccacgtttacccttgatgaagaacgtccgtggttttcgagatcctcttggcgtttctgacacttattttagcccacagaaagctcagacaaacgagttcgctgcgtgaagtggtccggcgacgcacgcccttgtccagaattcgggtggcacttggaaatttcagcgcattctgctttacagaaaagtgccttctgtggccctctcgccaagcgcaattagcatatcaaactccgtgagttcgaaatgtgagtggttgttctgtccgtttcccaagtgccaatttccaatggagacagacacacttcaacatctgtacccacttttgacccagcctaagtgaaaggcagaagcatccgaatgagaaggcaagctaccaaagtttatggccaacggattgcggaacaaaagcaacaaaaccaccttcggagcagctcgctatttagtgtgagtgcgtcatttcagtccctgagttctgttcaactcctctacgtgtgcgcttctgccacagatgtgtgaagcgtgcactctgcttgcatcgtggacacagaaaacagcggtcggaatttttcccgagcaactgatgtacacgatccctaaactgtgttgttcgtctggcgtccgtgaaacagttccgttcattctttcgacacacctacggctgtctcaggagagaaactagaattcaacgttttgccaagacaggtcccagattaccttgactctccttgttgtacgaatgcatggcgttcagttgaatctgcttttagagcacatccacaaacaccaattatatgtccgaaaaagactcagaattttccagagtgaccgtgacaccatgctaacaccacaaaacccggggccggcaacccacgaccaccggtaggatactgaaatccatcacttttagccgtcttacgcattccagtggagtggtggtatacagaaaccatatataccttagtattagtcggttctccaacgagggaaaccgtcgtggaaagaaccctcaacagtgcgggtaaaagatgaggcgctgtttccagcttcgggacgaaaggactctgctcacatcgtccctcaggctgtgttgactgtcggctttatgctggaactgcatgttgccaggttgaggccgtcggggaggctgaacgtggaaaagtctaccttttgttgtggagtctggctctacatgcacatgcattcgataaaacggggagatgaactagttaagtagggcagcggaaagaggcagaaaacgcgaacttatgtgaataggctgcatgagacttccagtgtgtgttacgcctgaagccaagcgtgcgaaaaagggagttgcagagttttccacggaagagtgtactgagagtccttccttagaccacaacagtgtcttttatcttcatatgattgcaacgaagagccatcacaatttggagtcggcccagacagaatctcaacactagttcgagtcaccggagttagagaaacccggttgaaaaccgtgggactttagcttcatggacttccaaacagatatgtgtgtgtgtgtgcctccttgagtcagcgcgggaagtcccagtcctcgacgctggcggagaaaacatgaccgcggtagatagcgtgcagacgcgccaaagtggttcctttcccagttgctttctcttgttagcaaaacgactcgaatgccatcggcaaaaccccggaacggtataaa

SEQ ID NO: 3933 - DNA, 2110 bp, Toxoplasma gondii
ttttcgacattgaatccaccgtcaatccatttgcacaggcttggcaaggactcgaggccgaaccaggcagcagctgaatctagactcgccgttcccttgtttgaaaggggcttcgttgacaaggctcggtcttggagttttttctttagttcaattgaatcctattcatatcgttgattgcgatgtttagaacaatgttgcaaaacaaatatttataaggatgttataattcataaacaagatcccattttttccgtctccttcgcagttgtctctaaatttgcgtagttccatacgaatactgaagtcgttgttccgagggaacaaacgaggatctcgattcgcgcaagattcactcgagtctattccaagctcttcagtcgaaaggctctgccaaaatgcaagcagcaggtgtgtagaaacggtttgtgtttcccggtctggtgacgtctacctctgcaatattattagcggtatccactgtctatgtgcaccagactggcgcctcgtttccattcaaagaaccatctacagttccacggatagcgcaggcacaccagccttacacacaccattcgtcgcgcctttgttgaggtctggaaactcgttgtcacattgagttttccttctgtgtcctccatctgagaaccgtggcctagggtcgcgagccttcttcaagccgttacgtcgtctagggaagtcgtcttcttccacgaagaagagagagcagagaggcggcgaaggcagacgacgtagaccagaagatttccacgcgaacaaaattaacgtcgtcttcctcgtttgagacgacaaggatttttcgcgccgtcggtactacagaaagcaaagaagccgcgtgaggcgaatttctcgctgttcctggggaggaagctctgcacttttcgcatctctttgcccagatgtctctgcaagttgcctgatcagccttctttgtctcgtttccattcctcgtcaatggtactagcagtatctcgtgttgatgcacaacacacaccacgaatatttttccgtgaaaaaagaacactctctcgatcagacagaagaattcctttaattcccttcaatctcattcacttattaaatctccaaaatatgacagatacgaatatgcacatataaatcatatatatatatatatgcgtatatatgtatatatatgtatatatatgtaggttacagatgtgtatgtttctgtgtagtatctctctgagtattttggcgtcgtcctctctgggtgatacccggaaggctggccgtacctccagagataaatacaggaatggttcttcgctttgccgcttctaaaccacggacgaatctacggagaggcgaaaattcattttgaaccggttctttcctttttttcatctcgccggctcggctctcgcctgtgtgggatctctgtctgagcgtgtttgcgtgccactctggtctgcccctctctggggacttgctcccggaacgtctgcatgcgctgttttacttgccggcgtcgtttcggtcggttttcgcgttcttctctgtcgccttcttttggcagtctccggaacgggcgaagcgcgaggaaaacctttcttttgcttcttcatcatttgtgtggagtctgcaccccggctgcggagtgcctgcctttcttacggtgtgtgtctcgacttttcgacaggtgcgtggtgggggaagcctcccgaaagctcttcgttttctccggtcgctctctgtgtcttgtttttctactttatttcctctctttcgcctcatccccgcgcctcttgtctctggtcgtcgaactcgtgagcaaatctgtcttccccacacaggcctccgtggcgcagcatttcccgtccccgaaattcgtttcctccgtcccgttagttctccctcttttgatttgtttttctcgttttcctgcctctctcattccattcgttttctctacccccgcgctccaaacccagacgccgctcttcgctcgctcttctccgcctcatctgcgccttctctcgccggctccgtccctggcgctcgcctgctcgtcgcttttccccgcgtctctccttagtttactccgtttttttcaatcataagaaaa

SEQ ID NO: 3934 - DNA, 3821 bp, Toxoplasma gondii
caacgcgtcatgccatatgcttacgacagacccaaaaatgggaatttgagaggtcagatggacagagtcttcgaaatggttgccgcacgtgcaaccgcataacccaacgcaaaaagtctgctggtctcagaatagagcgacactgtggaaagtgaagcagggaggaaattttttgtcggagtgttttccaggcttcattcatagtatggaggaaacgagggaggcagatctacagtcagatgtaaagtgtcgcttctcttcgtgactgctcctctcagacaaatgtttgcatgcgcgaaatgtggaactcgatttcactgctctcatccgtagaagttgctagaaaaccgaaaaaggcacaagaatgtcgacattcgtggcaatctccactccccaccattatcggctaaggactcatctgttcaacgtaacctagcggtagcattgagcatgtctcatgattggagattcatataaggtggagaggtcggcattgctcgtgtacgattttttcgttagcgtgtcgcaagcgggagcacttcgtttccacttgacgaacacgtgcagcatgacgcgagagttactcacgtgctgctccgactacccacgcagattaggatggtagcgaccagcaaaagagacacaaaatgtgtacggtgtcgaaaggtaacgtagagccatttttcctgtgtacgtgtctctggatttgttcgtatagaggggacaggagtaaggaatgtttaacctcagcgtgctttaaaatagagaaaacaactaagtgagagggctactgttttccttgttcgccgacgggagtaagtcagacggcagtgtatatgcatggatccagcaggaagtctgatagaacgtttcgttccgcaaacccgaattcgggtggtgcgcgctggttcaaaggtgtagtacaaccagatacagcaggttcaacgaaattgtgcgggtgcgtgtaagtttcaaaatatttaaaccgctgaagggttgtgtgtatcagatgcactttacgagggaacgcagtttgctggggctgctcgtggcaatcaccgtgtttacatctaagtgggcctgtgactttgcgagaatggaagccaatcggtgttcttttttctccagtttcgctcctgccacgttttgtacacattttcgtggagggaatcgagggttctccgaaacaggctagtgcgtggtttgctacctgcgaggctgtggaaccgttatattcaaatcgcaagacttacatgtatggtagagttgagtaaacaagaaaattaaagtttggtgctctgctgtttggggggtcacgtgtactccgttcttttttggacaggtcgtgcactgagcatcggactcctttatcagaatagaaatgggcatgggcttctctgtcaccgccatgttttcttgtgtggtccgcctgcagagtagctcccttgatctcttccgtcgctgggtacttcggtatgccgggcagtcaccttgaaaaaagagttaactcgtaggcgcttcgacggacgtgaaaaatgtgatctgtaaagtctggcagttcctggtgtggcagtttttcgactccaaccaggcacaagaactggcatgccatggatgcatagtttgcatgagcaaacgaaaagaacggccgcttgacaaggattcgcatcctttcgagatcagtaggagtatccgctccctgtctatatgaatgtatgtataagcacgttgcataataaataagcaggctcatgtgaaacggaatgtagggggatagctggtggcgtagacactgtgatgttaaggcccgttgacacttgcctcaattggtcctgtcgtgaagttgttatctctagagatacacatgcaacgacaactgatgtttctctccgatgacttttaaagtcgcctataaaaggctacttccgtgtttagctctagaaagatggggcttctaaccgacgagcacattgtgggagttcccggtccaagactatccagtgagcctgaacgaggaacgcgagcgcgatcgaattctgaccctgggactgctgtcagacatcagtacagagatacgtgctcacggacaaggaacgagcagtcgttcgcggaaaatttctttttcgaaaatgaccaccgacaaccgagttctagtgattccaattcgctccttcgccggtgtacggagccgcttcggatgcagagcaagcaacttcaacaactcagtatgaatactttcccttgggtggcaaaacgttcacaccacaactcgttaccccacaagctaccctccggacgcttttcggagtgtccagaaacatcagtcaacaggatcaaacagaagctgccgctgtctgccgtttcgcgtgctcccggcagtgtaccgtggaatgccagcgtcctgatagaaccttgggagcgtaagcgaagagaaagggcttacgaggttccggaagcgcctcccttgtgtaaacggcagtatctgccggcctcgtacgcaagtccacgagtacgcgaaaccacctaggaaaagtcctgcttcaggagttgtactgtgcgcccgtgaccccagcgcgtagatatccactacactattcaaacctaagtatcgattatgactcagaggaccgttccgtcacactcgcgcagccacgaatacttctgtggcgttcccagccgcgtgtttccagcgtgctcagtatgtctgtcttcttctcaacactaaccggacgcctatccacaacattgcttcccctcccgttgaagaactatagaaaactcatcacagcatgtgcatcgatcatagtggtgcaacagaagcctgaagcctttctacaagcccgatcagtgctgatatcgtgcagctttccccgcggcaaaggcggccatgggcgaagcacacgttctggaaaggcaaacgaagcacatgaaaaacaaacagtcctgtgtgcccatggatatgaggatacgtaatatctgtgttggtgtgtctggttgtactgagcacatttttccggtttcatagagaaaatacctgtgtgtaacgcgtgggcttcgagtgtcctgcgttctgtcggttgctcttgtgcgaaggcgcggacagctgcactggatgcagagcttcaggaggaaaggcgaaggtttgcaccggagagacaggctctgtttgagtgcgtaagaaagcaattacccggagccagcaaggagcgctgctgggcagaagtgaggagaatttttgataacgccatgaactacgaaaaacgacgtcctctcgaccctaattacgccgtctttgctaagtgagtccttcttctcacagaactaccaacattctgtattaggaatgtctaccgacagcccgtatctagagcgaaggtaatcggtggtgaatcaaatatcaatgtaattagacagctctgattgcttctaccagcctttgtttctgtgttgccttgccgcaccctgacaacgcgaaagtccccccaacgttggcacacagctgccggattacgcaatgttcgccgcgcccaattcatatcgaaaacacagaattgtttctcatgctggtttcccttcttctgattgtttcttgcatttcgcatgtgcgtaggccgaacttgtcccttacggacagaggaaggaagtacaaagtgtactttcataccgggaaatttgatgtttgtgcgattgatggccgggaggcatggtcgtgctgcctgaacccaagtcgaagctccagaggttgccaagaaaaaactgtcaacccagatgcatggcacttattgagtcccttttgacgccgtcatttgtcgctctgctta

SEQ ID NO: 3935 - DNA, 3971 bp, Toxoplasma gondii
tattagttgagaatatcggaagatcttataaggcctatccacaaccaacagagaagtgacggtactcgtacgtggtggagtcgagggcgatgggttggagttgggatccacggggttggtagatttcgtccgccgaggaattttcaccgacgcagctgaagagatgcacgaatgggagaaaatgtgatctcgggcatctcgatgtggtgagagacaccaaccactgtgcgtcgacgaagactttccggagtctggcttgggcaacagatatccagtgtcacccgcgcgtggcggatgatccttggcgttcgcattaggctccgcgactggcgatgtcgatggcgtcgcattctctacgctttggtgggagtgaagatgcagaagcgaaaaaaacgacatattttcgaagtgtgcgatgacattgaaaatacgagaaaatacagtcctcccaaaccttgaggagtcacgcatgcgacaatcgcatcccacacttgcacggcattttatacgtgcgaaaccaaggggaaatctgtggatcgtagtacccacaagggcaactgccacgcggccggtgtaccggaggatgaacttaggtgcacggatggacacaattaaaccttgtaccgtttgcacctactcgattcttcactggaagcagaaatgtagttcatccggactaaagtccgctgccgtgtgaggaggagggaaagcaacactgacactagaagcactgcctgatagatgacgctgttgtaacgctccggacaggtatttgtgacctgatgggattctccggagtcaacactggacaactgtctccccactcaatccctgtcatctgaatcacgagagcaatagcactcgaggaggacccagcctcctaagcctgaaacacgtagtgtgtggaggccgcgacggcgcaggctctgtagctgagttagagggatttatacactggtgcgcaaaaaagactaacgcgagtcgatggacttcacggcggtgtaaggaacggctctgcatttatgagaaaatacgtggtagcatgcaaaacaccctgtggttgcacatcagctggctgtaccaggtgaacacgtgctatccacctcaacgaggggctgttctttaaactcgtgaaactctccacaaaaaggcactttcaggtgcaaatctaccacccgaaaagaagtttcacctttacaccctcgaaattgaagcgaagctacttgagttggacttgttcgctgatccctgtcccgagcgctggagccaccgtgcgctactacgggaacgaagtcgagacgggggcctaatgacgcaaaaaccaacgcacgccacgaatacaggtgctttcccatccatacagagaggtagttctttagatggcaggaatatcacgcgaagtctttgcttcggggggctgtccgtcattgcatgcggcagagctggaaatgtgtgtggcttgcccctcggaggttgcactcctacaggtaatgccccagtccaaagaacagaaagtaaatgcgtgatcgttcgcaggtgaagggccgggaaaatatacgtaaacgatgataaacgacgcagcaaacccgagttgactctcagcactgctcctaacacctactataggaggattggcttcgctcgctgctaccgcgttgcaacccaggcggggggagacacagggggactgcgctattaacgcgaatgccaagtacgcaaccgaattccacggctctctttggaagtcaacatgagaaaatcctccagaagagttttccttgcgtatgtgactacaggtgactacacacccgctttctcgcagcgggctcgctcgtcccgtgagctgcgctgcagaggaccacgctacctgatcgtacgctccgtctctccgcggtaatcgagaggcacaaacactttaccaaccccacacatgacgaacaaaaaaaatgtcatcttctattcggcttgaatgcaggcgtaccatccactcgatgtaaagtgaccatcttcgataaaattgattgattcgtgccagccacaacttcgcacacagattgcgacggagcgtgcggtgactgcagaacaaaaccgtattacaagcaacgatgaccggagcaggtgagaaccgttccatcatctgactgggcaacgacccgtgatgacgataggtcttacaacgcaggatcacgaataacactcgctttgttcttctttttccttcgctggtccagtacacaatagaaggatagtaatccttcgacccaatgcgcacctgccagttggtacctttctacaggctgacgatcgccatcagcaaatggacgaactaacagatctgcagtatgagctaccacaaaatagagggtataactttacagtatgtttgtaacaactcttggacgggctttctgtagcttgttcacatatcgctttcggcttcagaatgtcctgtagtatacagctgccaaaacaagccaccacgtaaagttcaagggggccggttactggagtgcaggcgtgagggtgttaggacggcacttccgctacttgagctaggcagtgacaaagaagaattatataaaagagaaagagcaaggcatatcgtgattgtttccaggagaatgacgctgataagtagcccttctccacagaaaccccagggagcgagccacggtggatgtatttcacctacttcgttgacagcgctcatgctctcctgaggcgaatttgcctacaccgtctgagaaaaagattttattccagacgaagagtttgttgtaccgatggacgtaggctgaaggctactgcagttaaaggcactgtcatgaggaaacagcgtgctgattgtgtgtgcgtacagtgcgaagccaacaagtgtcatctatgatacaggatccgttggtcattgggtcatttcgcttggaaatgtgacctgaggccgcagtttccttgtgaacgtagcagttctggttgatttgtgttgaagtgctggggagaatgcccagaatcttccctgcaacgtggaggaccactcagtgccgatcgcccactaaactgcccgtcacttgtgtgtgtaagcctgaaaccatttgtcctgaaagaaggtcatttcacacataaagtaataggttacttagaaaggaaggtcctacctcttaccctcaaccctctgaagtgcctctgcaaacgtcgtgaacagcaggcgcgcacgctggacgcttgctgcacacggagcggcgtgtgaccgtcaggaaggtatgttttttcgacagtaactgtaacatttcctgtgttttttatattcgtgtctgccgtaatttctccacgaatttggggggatgtacaggcttcttccctcggtccttgcaatcgcagcatgcgctttgcctagacagttgtagactcgaggttcttttggtcggtcatctggccgttttctgtgcaaagcggaagggggaactgtgagcaggcaaatcagtttttcactagtttgtagtaagatgaacgctgttgagactgttggtggcgtgcttcagggtgacaaagcggggtcttcaccgcgagaaaagcgacctgaaggtggggccagcacgaattttgtgtctatgccgtttttcctctatgtgttcatcacattgatcgttatttgccacgctcttgcatttgccgcttggctgttttacttcttgaaagatcttgcagcgaacaaaacagcgtccgtgaaattgccgtccgtgaaatcggccccagttaagaggcagaagctctaccctgacactctttctgggcagtctacgacagcgcttaagggaggggtgtctccacacgcgatatcgccagaatcgttacgacttcggaaaccgcctgtttcgacgtctgcagggtcttccgcgtccctgaaagacgctaatctgcagtcgcagagcggcccctcttcctctagtagctctcgtgaaaaaaccaacaacgaa

SEQ ID NO: 3936 - DNA, 4928 bp, Toxoplasma gondii
tctcgtcggacaacggaggtacagctcggcgattgataagcgactcgccgcatttgaggcagtactccggatagacggtgggtctcaatcgccccgccacttcgtcgggctgtgctcgagtgtgcgtcctggcctcctccaggacctctccctgtccccggccttcgtctgcaggagacaggaaactccgcgcatgaggggaaaaggcagagggaggatggggagacgaatgagaagactgcgggggaagaggagcggaggaagaatacggcgaatgaggagaatgcaggggatagtgagaggagtgggaaaggggcgacgaaagagagtgaggggagaaatcgagttcgtcacggagaaaagaagggggacgctcccccgagatcactgcatcctgcgaagtgccaagcggcacagctgagacagatacgaggagcaagacaagaagatggaaacgcctacagaacgtaggaggaaagagaacccacgcttcgcgacgaggtcgggcgaccccatcgctgtcaaaccttctcgccatactcaatccctggagaagacgttttttctgtgcatgtgtttgcgtgcgcctttgaagacctttcaaagcgatacaaaggaggcactctttcaggggcgttgcagacgagcgagcactgaggtgaacatgtcgtcacatagctatcgatcttcacatttccttgtctccctcttgcctccacaaaacgctccatctaagcttgccaggtctcccgttcaatcttcctctgccgacgacgctcagtggacgaacagccagagaggaaaagaccggcggcctgtgtccaggaagaaaagaatggtgtggtgaatggcgaggaacaacaacgcagaggaggacgttctgtgaagatgtgaagtcgagaacaaaggacgcccgctcgacgcggaagtggaaaccgcgaaatcctaccgcagtgaaccagcagctggacttgcagtctttgttgcgctatgattgccccggttgccccctgctttccacccatcctctctctccagttacatccgctggttctgcaccaacacacatcttggcagacacaccgtctctgtcccttgggaatttcgcagcgaatgtagcaagccggagcaggcagccatctttataaaggccactccgggagagctgtacatgcaccggaaaacgacaccagggaagaaagcgtttttttttgctgctctactttaaggcagagaaggtttcccggaaaaagaaggcctctgcggaaagcggaagcgaacactttcgttggataccccgaggaaaaaaaagaggtaaccgatgtgatggaggagacacagcaaaaggcactcacgtctcaattcaggggaacgcacgcagcgcgtgaccggcgagcgagcttgcttctcgagcaggtctctttaacacattctttgaagaaatatctctgttttcttgtctcatatccatcttcctgccttccctcacttctcctcacatggcgttcctcttgatcctgttcgtctcttgtttagcggattcgctccttcccttttgtgtcacctgccttttctcgctgtctcctggggtctcccatcctcccgcctcggtttcttcgccttcccaattgttttctcttccgtctcttgtgtgtttcgcttttccccatgcctggtcctctcttccctctctgtttggtcactaccttcgtcttttccgtgccatcgtcgtgttcttttctctttttctggggcttcgagttccttctaccgtctgctctgacctccacgcttccgttttcgctgttgctcctcagtttcgcgtttacttcgtctctgctgcctctatgctttctcgatgtaaacccgcacggcggttgccactgacaagaatcagagctcaccatcgctgcagagcagaacgggacaacggcatgtgtcagcgaaatggctcatgaatgaggaaggcatatatagaggatgtgcgtggcgtacatactttggaaacgagaacgatgtgtgaggagaatcgggacgtttttcggggggggtaagagggggaagcaggcggcaaggcggagaagtcaaatacaggattaggtggggaactttgaagaaaatgttttacgcttacccttaacttgacagcttgccgttatcccttcaggtgaagaaaaggcatggaggcatgtctttttcgtactaactgggggatgcttcgtccactgcctgagacactgcagagttcagacgtcgcaggataccataaccataaggggcctgaaccgcaaagtgacgcgggaggtcgctgggtcacttgctacgcacgggcacacgcccctgatccacggggcatgacggtccgcgtgcgtttgacacaactgcagcatccaccgttgtccaaattgtctgaagttagacacagaatgccagctccctcccgattcgactggggtgtacagacaccgcagcgcatcgctcgcggccgcagttgctttccgtaagcagcggcgttctgaataagttcccccacgtgtcacagaacgccgctctttggtctggtcggaatctgcccatcagatgctttctttttatttctgtcgagtgagtggacacacgaaccccgcagaaaccgagcagcacgctcgaggtttcaggaatccgtctccgaatcaaaacagcactttaggcatggtcatcatgcacggacccacggcgactttccaaggaactgtggtgcagagttcggacgaccctaaaaatcagcggggcttctcggtgaaattgggatgtgaggtagcggagtgaaggacgcgggagttccagaagaacagttctcgtaagcgacagcatggtctctacagtgactgttaccgcctgtcacgtggggacactttgagtctgtgcaagtgaatctctggagtgacaagggttgtgaaaagcgttcagggtcctccatcacagcagactggccatggatgcagggtgtcagttacacagcacactactcgctcacgaattctgtttagctgtaagtggtcaaccggctacaacggattgttccgaggtacgggtgcttgcgaggccctcagccgtgtgggcgttaggagactttcgttttcagaactcgtctgcggttctagtctttctacgggacaggctgggaaaagggaatacagcagtaaacgagcgaattcgccttgtttgctcctcatgaaatacggagaaagcagccagtcgccagagggacccggtgttcgaaggaaacgctgcacgggagccacgcaaatcagaaactttcaagttcccgtcaccgaagctcgactttctggccccagagttgcagggaaaatccttatgcgcgtggactgttcgcttgtctccttctcttcgcatggaacggactgttctcttgttctgccaccctcagtcgtgtctgagcacttgtctcgcttgagccgtgagcggacgcgatcgttggcaggggatcgccgcgcacacaacactttaggacgataaggatgtggaaaataaagtacgtagcaaggtggagagaggcgtggagaagcaaatagaagaaaacagaggcggaagacagaacgacgaacggttcgtatggaccaacactctacttcattagatcacgcatacggtggtttgagacaacaacacggaaaaaagtgtgatgctggcgcggcagacgggtgtcgctcaggggaagtgtcttgctggtttttgtcagccactttgtagtcgtgatctggttttttattcggagattcgccgtttgttcttttcctagactccacacatttcacgccatgtcgattccgcagcaccatttggtacaggctgcttcatggctgacatcctgttggcttggtggtggccgctggccgccttttggatctttcatgtacaaaaattgaattacgaagaagcagacgagcagcagtacacttgggtgtttcggtcacattgcagttgctcgtgctcgcagggttccagcgttcccctgctggctgatctgtttgttcgtgtggtcccgccaccgcgagcttgggggttgagactcggctttctcattcgccattttcatctttttcagctgctcgtttatatgcaggctctttattgttttttattgcatcttgacagcgtcttgtttccgacgtctatgccagccagcagtcccacgcgagagcagccgccagacactccgcgacttgttctgcacgagatgcacgcagaaagctgtaaggaaaccccaccattcttcgtttttcgtccttgctcgttcttctaacaattcaacaacctcagatgctatcgttcttcctttttctgtctcttgcttgtacatcttcgcgctctttactgcattctactgcacagccgcagaaagctcagatgcacagagtgcatgctcgacgcgcacagactgagacaagaggcggccgacacattggagtgccgaaagctgtcacttatgtttttccttttttttggaagagaagcgactgaacgagcaagagccagctgtcccctttcttttaagggagagattcgcatggagtcggcattcacgcgaacgcggtgcccgccgatcgactcaaaaatcgacgaacggatttggctttttcttgccagacgaggtcgtttttgtgccatttcccgcgctgaagtccgttcaccgttcgtcttttgttcctctttgtctgctgactctgcttttccattgggctatccggcagcacggccaacccctccacgccccaactcgtggttccacgcgcgactgtaggcaggaggttcactggtcttccccctgcattttctctctttccttttttccttcgcgcgctggtttgccgcagttgtttcgtccccctctcgcggagacgctccgaccaccgaacactgaggga

SEQ ID NO: 3937 - DNA, 4829 bp, Toxoplasma gondii
ttagaacagacaaaaatgtttccatatcctacccgtatctccttgtcatcacctcaagcatagagatacgtgttaaatgtttatagacattttccatatcacgctcgtgtgcgttgtctctgccgaagacatggatgtgctagcaacattactgcttcgttgaaaacatacgcttatgctccctgctacgaacattggcaggaatctgcctagcctagtattggggacggagtcaagcccaagtctaattttcgagtcgattaaggatgctgtggactccgcgttgaacggctacgacggttgctgcttgttactgggaatgcgaggtaatactgcaacccatatcaacggggaatcatcgagactgttgtgttgtgtcacgatagtcaatcaaggaatgtgtctgtgatcccaccccccaataggcacggttttcgtgctaacaatagaaaacgagatgttctagcctcgcagtctggttgaagcgagaattacataagcgggtgcttaagcttaacgccgcgttttgcccatcattagttacttttcacaggcgcggaggaaactcaccgcttcctaggacaagcttttgctaccatcgtgaaagcgatcaaacagaactcttcaggcgaaaatgatgagtggtgttcggattatgatgccctcacatctgaagatcggggaggcctggttttcgagactgggaagtacgtttgttttaccatcattttgcgcaacctcagtgcaaacttcaagctcacaatactcctcatagaagatgacatgccaacgacatatcagcacaaacctgatcattttgacgctcctcccgaaacattccacgaacaagtggacgatatcaccttcaccatacatcgaatcctgcacttgcgcactgttcttgcacacaaacgtgaagacgtaggcaaacacctctgttgcatacgttcgtatggacactgatgtcaggtttgtgagtgcctttgtaccaagatacgttggtggttcgaaagtcgttttcccaaggcctaacgcgaaatcctatttcctagtacctccagtgaactcttttcgtatgatccagagtgcgcagtgaggtaaatacatataaggaactcgacaagcattactacatgatcctggtctatgcctgcaactcgaattatactctcgccttcctgtgcactgggtgaactgacaggtggctactggaacagctacataataatgcactaacagtacacgaatcctcggaactaggcgttacgtatttggaaatttcccatggagaaatgcgcgacgcgcttggaggtgatgcgctctgtgagctagagcagcctccaggctgcactaacggcccatccaccatacgctttcgcggagcatcagaatggctgattgattctatggattccctcgcgaggattttcatcgccagcgcacgtaagccaatcattgcacgtgaggggaaaaggagaattcgaacgccaaaagagctttgtgccatcgtttgtgtggggaaacatatctctgtttcccaaaacttttatacccgctcttcgaacacatgagacaatcagcataccacatgcggttagggtgcataaattgttctttccgtatgttgttgcagaccgttgtggacaaagcgaatcgcaaccagagctcgatcatcgcgtcgaagagaatatcagacgggcaccgcctcatcgcattgtgatttttaccatcgagcgaaaggaccggggtacaaatgaattgcaacgagggcgcttggtttttctagatctctcttctcacactcgcgatacagagtgaggagaaagaacttgcaaagcatgtcgatcgagtaaacaacatcaccagaacacaccaatcgtgcaaggccagaagcagacactggagcggacgttatattcatgtttcgtacagctctgcgatccatgagttttcagagaacttttacatcacctagggaggtgtaacggaatattttctgacatgcagtgtcgctctgtggaacgatgaaggacacctccggagatgtgcgttgaatcatccaaattcttagttttccacattcgcagcgctgctcgtttactcccaccgcgtaaaacaatgcccccggacacgaccgtcgtggagattatcttgtgttgcagcgcgctttgtgcaagcgacggaagctctccagaagaagcaaacgacataaggctttcaagaaatgcaatattcactttactcgagtctcttctccccggaacgttgagcagcctgcgtggtgacggagcgccaactccactcatggtcagcgattacaacagaacctgtcggtaacacgaaccttgtgtttttctagatcgctctccaaatatgagtatcacttgtgtccagactgtccccacttgattgctcttgcaggctgacggcgactgcggtattctcaggacagttctgaaggcaagtatgccttttaagaagatcgcataacggcttgaaaggcccgacagcaaatactatcggagtaatcgctcagtagagggtttttggatattttaattcttgattgctggttcatgtatcggcagcagaaggcactgtgtggtattgtatgcacaggaaacttttctaaacgaatcttggagaactgctgtgatcggaacagttcctgtgtctgatgtcagcagtccagaagctgaccacctgatcaggtaagtaactgcatgagctcggcgaactagaggctaccctatctgcaacacattgtgtctccttgtatgaatacttcaattgccgtcggagaagctgccagatcttcactagagacagacaagaggatgacgagaaaatcagagaaatttgttgaaggggctcataaatcttggctattcaaaaaacgaaagaaagacgcttttcgttatcgaactgcctcacaggaaataacgacgcaattgatgtgaatcaaattcgctaattatttcctacatcaatgcactgcggaaaccggcttgaatgtccaacgcaggctactgaagacaatggaagccataccaaacaagccttcgtgagtacggccttcacgtggttctctgaaatttgttgcaaccgggcgttgtgtcatcttcaacaaaggaagttttcttgtccagagagtagtgtttacatgaactgtcgaacataccacctcactgcgcgtccaccacaatcgcggccgatctcgatttttcctctcccgggagaaaacgtcgtgagccagcatcagaggtggtggacgatacgttgtgaactgctgtctctgttctcaaacttgattttaagtctcctgtcaccccgtttcatgcttgtccaggtgacttgctatagccccccgaaaagttcattggtgtcatcttggcaggcaatacgacctcgcaacacaactcgacgaggaagtgactgggttgaaaaacagaattgagaggctgcgtctcacgctggaccttcccgccgtggcgagttcacgcattacggagtgccatctggataatctagagagtctgaggagagagctgaagtcagtctaagagaaccatatttagttcgagaagttacaaacgtatttcctttcgcgctcacagacgcttctgtacacgtcttgctgaatcatctgtaaacgctcggcagtttctcctcagtgcctgtgctgaccaatcctctttagaaaaatggctcgctaggcttgatctgccgcatccatctttcctcctggtggagaccatagtaacacactgtggaattatgcgtacagtgcatctctacgtttctttgttattgatcttattctgctacaatggttgcaccggcggcgttatcccaacggcacgcttctcactcatatctcgccagtctggtgacatcagcataagtacatatgcggcacgagataatgtccttgccatatgctatgaccagaatcctccgagtagcacttcagaaacgaggctggcctccgttcgttccgttccctttggttcacgctcgacctcttctccagaatccggtgagcattcacaagctacactacgcctgcaacgttccgtttcaagtgtttcaccagactttccgataattcatctgacaccgtatacctgtatatgttgtaactacaatcacatacaccacatctccacttttgcgcgctggttgattctttcgcaagcagttgtcaaattctcgagtgtattgtagccgggaaacaggatcacttcttctagaacttgcttaagctgagctacggcattccaagcttgttgaccgaaatagataacgagcgttgtttcgctaccaactagaacaggaggcgaccgccggagtagaggcaggcgataccgttcgtacgctgacagctcaccattgtcgattgtaaaacaaccggtgcacagagggcaacagcagctgcgcgtgtcctcaggtgtctctccaagtgttctgcttctgaacgttcaggggaaagatgctttcattaaaatgccgtgcgaggggctcactccgcagctcatcagcctggttcaggtaggccacctgcccttttgatagacatatcctagaggaaaaaggaacatgtgcccggccacactgttcatccgataaaagtggcaatgacgatgatgacgaagggaagtcttttggttatacgttgaaggtgaagcatggccgaacaagtctatcccatgcctcctataagagtctgtgggatttgccggtttactaggattttactggtcattgatgcatcactttaagttcgagtcttgcactgttccttggaactactttacagaggcgtggaa

SEQ ID NO: 3938 - DNA, 2288 bp, Toxoplasma gondii
gacagtgaccgaggaatataacttcatctagcgaccgtcaaaattcgggccatgctggcctatgtcacgattcagataatcgtgtgggggacgtggacgctaatatctgcagcaggttgacaaccgtcttccccagggaccagtgatggacgaacacacaggatctacatttaccgattgaacagtaagtggcacttctcatatcctgaccgtcagagtcggaaactgtggcagaatgaatcgtcggatcagggatactcgtaatcatacgacaatcaagctcctcaacatcatccacgacctcacaagagctgggcaacatgggtcggaatcgatcgttgctttgacctggcgtccttctacctaaactgcaaacatccagtaaatcacccagagaatatggttagcagttacactgcaaacgaacgatcataacttttcgctgaggcgtgggggacacttgacagttctgagtttcgtgaccacgcaacggcaacccgactctgtggttcttgcgacagtaaatttgcacccgtttttcaagtgaacttcttacagtgatggactggcttctcaactgacagtggcaacactctgcgacagcacaaaaagagacaaggtccctctacgaacggtgcgtacaaaccgtactccacagagccatgtagtagcatggcaaatgtccagggtgacatacacagttggatggcatttgcctaggtagtaagcgaacgggcagggtcaccaattttacactttctcattcatgcatagacttcacggagatggacaaaactgctgtcgggccaagcgtggggatccggtcccacaggtacaggcgttaacggtttggctcaacaacgcagagccagggccacaacacgaagaaattaaccaggaaggagttattcatcatcaactgactgatgtttccttccggaacaccaaaggttacactcgcacagatcaagctctgcagaaccattcacgctgtggagagaggatggatgtctcgacaataagcggaccgccgggaaatttccgctgttctcactgttgggtaacacagagaggggggttgcttgtagtcagttatcctcctactgtgagcaaggcgaattgacacggagttacgattgctgaaagtaacatggtccctctgtccttttcaagggtttacataaaaacccgtctcatgcaaaacgaggacacacacgcagagagggttggaatgtcgcggtacgccgaagtgtaacgcgcgcatgtctgtttcgcatgcgtttctacgtcttcaacgcagactggaacccccctattcgcaggatgaaagagagagcgcataacattgaagtgcttcggcaacaagcttcattgctcattttccatgataattttcacgaggaaatgtctctaagttgtgcgcatcttttttcttgacagatttggtggaatgacggagacatttatccgacgcgttgctggtcaggtttgcgcctgctgacgacaggagaatttccctctgcggccagctccgtcctggctatttcacatttttcattcctgttgaaggattaccctgtaccttggcttctaatcacttcgtctcacactgtctgtttacctgtcttcattcttttacattcgcggcaggagccacggcgattcaacagcgtaggggagcgatgattttgtgcgcggccgacgccacactcgtctcgcgcttacggggactggattcacttctgtgttgcggtgcacaaaaaatctgccgttcttggccggatgcagctgggctgacggcgtaggtactcgctaagaaacgagtgaacgccatatgagttacggtgtagactgccgaagcgcaacagggtgttacgacgagttttctggatgaaagactgctgacggtgcggactctgttcagaaccacgaagatgcaaattccgccttgaggacttcatacaggtcttcaagttctgatgtggtttggggtctaaggattggcgtgagcatgcggtgtctcgtgcatcaaaacaaagggctgtaggtggacgaccttgtgatttgacggtgtagaaacgcctatgcaacgcagagacgttttcccccaagatttcgtgtagactacggggttatttacttgttttggctgcagttttggagcttcggtgtttcccctgggataaaacggatgaccacactccgcgtagttggtggtaggaaatttccgttcctttccaacacttttcgttgtcagttttctgcttacggttgcgctctttaaaaca

SEQ ID NO: 3939 - DNA, 2051 bp, Toxoplasma gondii
tgaagaagatcaaagagccgttgtcttttgggtgccgtgctttgcgccggttcttagaggcacttttgccactcgcatccacgcctcttgtcgcaacctcggtggatatgcttcgatctttgctgtcccgaatgcaaacacagttccgctatttgaaggccgcagcggccggcaagcgggcaagaggccggaaacaacctaggattttctttggattttgtgttttccgagtactaacctatcaccccagtgccgtggtgcgatggcagggaccaccgttgttcgtcatggagaaatgtgacgtcaccacatttcaaatgtaaaagcacagagcgcagtgttccaccgtcagaaaaacacggaatacgtccgggttcgccccgccggtgggtgggtccatcatttctttctgcgttcgtgccttacgtcggcacgtgtgtgtgccagccacttttggtcaagtggcagccaagagctgtttcctgcagcggtagaagacaagaaaatgcagtcgtttattcgacgaatcagcctgtgacattgtatctgttttcgaacgactccccagagtgggtacggattacctacggtagtgtggccgcaagtcctatgtccgtattaagaggagtaacacaaccagaacaagaagtattaatatcccggtggatattgtgggtgcgacggctcacggacatccgccaatgtgtgtgctctgtgccacctgtatcaccacaaccgttgtcggccaggtggcaaacagatcccaatttaatgctggggtgcgaaaaacttagcaggtgctgtgttttccgctagcttaggctccccagcaaaattagagcattactagtaaaagcatctagtcagttcagaagacgcaacagagcattgcccagtgagagtcgacacggtttttagtggactctcgtatcagataacggcgcgagaaaactttttttccccctggtttgtgtgtccgcggcagagaagtgtactgggcgcctgtctacagaaagagaaaggttcgctgtcggaccctgagaagaatggagcagattgcttccgttcatcttcaagtcgactcaaatgagtgtagtccgagcctgctacggattttgaaggagctcattcagttaatagagatggcttctgtgtactgagaccacccgtgatgagcgcagtgtagcagcgagcactgttattggcaggaaaagacgaatctaacagaaatgacagaaataatttgaggtagttgacattcgcggcacatcggaacaccagtgttgccattttctggcgtgcttatgcgggctgaccttgtcgaggagacctttggtgttgctgcgttaactacactggcggaccgaggccagtgaactagcataatcaacacatgggcatgaaatactataaaacagagtcatacatacctagaagcatagacgcgtacggccgctacatcgaatgctgaagttgtgaacgtgtgagggagaaatataagggcgccagctagtgctgcagagtatttcggcaaaacgatgtttgttctgttctaatggtaagccgccggaccttcaggtaccatctttgaggagatacgcatgatatagggatgactgcagttctttcattccacaaggagcaagggagatctcccgctgtccgcgtccttcgaagatgaaaataaccaaaacggattctcgaggctgaaccaccgtgtcggtaaacagagtcgtgttgcgatggtttctggcgagctctacagcagcccaccgtctgctgcatagtaacgccaatcctatatattgcagcgtcaacgaggatgtcctccaggcgaatagctcctctaaagacgtttgtgccaaactatcaagcggggaaaacagtggattcgtgtagattcctttgtgccttgacccaagcacggaacacaggaaagtgagaatctgaaaaatctgtaccgctggaagctgtataggtgaacttgtgaaattacgagaagggaaaaaacgcacctgtggcgtgcgaagaggaaatgaccgacttctgag

SEQ ID NO: 3940 - DNA, 2126 bp, Toxoplasma gondii
gcagccttcatgtctgcctcataggctgctacgctgaagacctctgccgcgccgtttcttctgccttctctctcgtcttcttcgtcttcttcctcgccttcttcttctcggacgacgagtccccgagcgcgagctcgctggaggccttgagcctttccacccacaccgcgcggcgcccgcggagcgtctgcggccgagaaggctgcgtcgccgtcgcctccaatgactttcagaaccttccgcatgcgcttgtcttcttcgcgtccgtcctcgcgggatttctgtcccttcttcttcttcccgctggccatgcagcgccgagaaactgcatgcgcgggagaggacggagacgcgcgccacggagaagcgggagcggagaaagaagaagagagaagagaaggagaagaaggcgcggaggaagaagaagagagagaagaaggagaagaaggcgcggaggaagaagaagagagagaagaaggagaagaaggcgcggaggaagaagaagagagaggagaaggagaagaaggcgcggaggaagaagaagagagaggagaaggagaagaaggcgcagaggaagaagaagagagagaagaaggagaagaaggcgcggaggaagaagaaggaagcagcgacggacaggagagacgcacagcaatgggtggacaggagaacgggagaggggaagagaagaaagaagagagcgatctaccagaagaaggtgaggcgaatgaagaggagaggaacgggaggggacgagaaggtagcgtagagagacggcgacgctggacagcgcctggaaaccgagcagaagagaagagagaagacgcagaagagaaaagagaaccggcggaaggggaagagcgacgggaagcgggtgggcctctggccagggagaaggaaggccgcagcgacatcgtggctggagaggccatgcacgaaaagagaaacagaggagacagaattggaaaaagagagaacgtggaaaacgggaaccgaagactcaaaagcctccgacagctgcgttaggagatgagaggaggaagaagaggacggggaggcaagagagggaggaaagaaaatgtaaattgtccgcctcgtttctgcggaacctgagactgcggagagagatgacgcttccaaactcccctcaaacagcagaaggtcgattgccggtctttctctcgatcggcctcctggctggtctccggttacacatggcgtcgaaggtcgcgcggagggagcggagacacagcgagagcggtgaagaagggaagaaggcgaagagagaggcgacgtgagaaaacatgtgaagaaggagaaaaaaggaaaactttggaaagaagagttttccaaaaaagaacgaaataatggccttcagaagcaaagtgggtcgtcgagaagcgtcgcgtgtgtgacttttctcgagaagccgtccagcggattctcctcggtttctcctcgacgatcttggcgctgcgagaacctctccggatttctcctttctctccttttttctgcttgctcgcgtctcgcatttccttcgcacagtttcccccgtcctcagtttgtggactgccttggcgtccagggaagaaccgagaagcccttcgaagcctgccgcttctctcccgtcgattcgccgcgaaaaagagcgcagacgcggaggcagagagacactggggaagacgagcagaaagaaaagagaaagaagagcagaaagaaaagagaaagaagagcagaaagaagagagaaagaaggagaagagcgtgcgtgaaggctgccgatcttcctggacgcttttgggctgctgtcgcgtctccggtctgtcgctgtctgttctttcttcctttttctcttcgcctcccttctctctcgtcctgtctctttccctcgagttcctccctcttcttgacggtccagtctcactctcacgctttccccttctctgtgctgtcgcggaggacgcagaagttctgcttcttatctctccactctctctgccttcttctccacttccccgctcctctctcccttcgttcaacttctctcttcttcacctctgtcctctcctctgttcctccttctctttcctcttcacctctctcgtttcaggtgtacgtacacca

SEQ ID NO: 3941 - DNA, 3387 bp, Toxoplasma gondii
ctgcctagacgtatacataccggtgtgaacatgtgtatcgaattgactgtatgaatatgtatatatatgtatatatacgtatgtacacgcgcgtggctaggtatcagtgcgtcagaatatgtttcgaaagatgttggaatgcggtagagacccctgtaaggaagaagcctgttcacagttttgtgtgttggtcggtttctttcgagagctcttgcgcgcaagccgtcctgcacggatgcgtctctgcgctcacgagtccgtccgagtcgttgaggcgttgctcactcctctccctttcagctggctgtttctcgaaacgttttcatttgaaaacactgcaacagacgttcaactcgggacgcccttcgtcgagttcgaccgccgtcgctgtggcggcgtgcactcggtttcttcgtttctgaggttctcgtctggtctcggaggatgtttgcactgcaggaggaaaagacggaagactcgcggttctgtgcaggcgccgttcaacaagcgctgcacaggacccgcagaacatccgcagttttggtgaatctgccgcggacgtggagtgacgcggagttccgtctcttcgacgcgaatgtcaccgtcgagcgagtcgtctgtgtgcgcggagctcctcaaattggtcagtcgacaaaaagaaaaagaaaaggtccagagttccagccgcgctggagctcgaaaaccggagacttggaattcagacggggactgaggcgtagactccgacacaccgaaggcggtgtctaaatgcgctggccgttgtccggcaaaccggcggcttcgtccctccgcctcgctgtgcgtcaccctcttcaaaagcctgcatgctcggatcaaaaccacatgcatgcgtgtattgatgcatgagacttcaccgcgacccaccatccatgtgcgtctccgttcgttgactcttcggggccttgtcaactggacagtcgctctcggtctcgcggtggactagacgcatttgtgcacgcgcagtcatgcatgcacggcagcgagagagtgagggagctctggagagaggagacagaggagaccacctgattgcgtggagctggcaggctcgtggagacagctctggaggacctaacttgtttctgtcacctctttttccatggcttcgcgtcttccccccaccctctcttggacgagtcgagaagctctccgtttgcctccaaaatgacgtcgacgttgaaagaacgcgactgtagacatatcgaatgcataccaaaatcttcgtcgaacacacaagcgcccctgcacaatgcttgcccctgtgctgcgacagtgccccagatcccctcatcaacaactgtacgctacgcaacggtgtttcctcgcacactggaaatgcctttcggtcatgtaacagtggtaaaaaacgagtctccgacttgcaagaatgcatgctcaaacacaggtctacgtacagacatatatatatatatatatatatttatatttgcattcctccacttgtcacagaatagtgtatgtgcctgataaacagtgcatttcagcttcatctttcagaaacaattacgtttttgcgtaaaaacatctgttgaatgatgcgctcgcgcatacaaagacacattttcagccatttgcatctgtgtttgttttctcttgtgtccaatcagatcctctctcccgcacacaggagcctgaactccacgtgagatttgtgaaatccttgacgcaattctacagtcgaaaggtgagaccaagaccgagagtcctggaaatttcgcatgcttgctagctgctggcatccacgttttctcgtttgttgtttgcctctcgctaccgttgacctctgcttttgttcgtctctctgttcctctgacttcatcatccgcgccactgtgtaaaaaaacatcctgaccagctgcatacctcacctctttctctcccaccgctaccgggtcgctgctgcgctccaaatctatattctttcactcccctttttctctttctcgcatctgtgcttctgtcttacgctgtcgatttctgattctgtttacgatttaacggatggaaaggtacattgcgtatgaaacttcagaaccatattattcacctgcattcaaatttttcatttatctaaattttaggattaagtaataaggctactctttcctgctctttttctctcgcatgctttatccatctcgctggaactctaaggagtgttgctgtgttcgtcttttcgggtctctctctacgttccttgtctttgtgttttttcttctgtctcaacgcagctgaaagtgatcgaagtgacagacgagagcgagaggagcgctgaagacctcgcgactgagatcgtcaggtaggcgacgccttctttccacgtcggtttttcactgatctcttcgccttttctttcgtttcctctgaagaccttggaggccttcagccgcggctcggcgatctggggcaccacccgtgaagcgcaacgccctgtctcccgttgcaaaccgggcgttccaggtttaggccaactcttttctggaccggtctgctgcgctgtccaccgctggagccaagcgtttggaacttgtgcgagtcctctagatcacttcgttgctccgaggagcaaagagaccgcagcctacctgtgtgtctgtgggaggccaccggcctggagagaactgaaaggtgcaaggaggggagcagagctccgatggtcaggcggcaggacagaggggaagagccgtctcctcgttttgcggggccatcgcaggcgtcgacgtcctgcaagaggtattcgtgcgtcgatccacccaagagctgccgcgcgcaacgccgcacactcagtgtgagcgacctctggagcgaggcttgcttctggaggcggacgtttgggctggaacactgggcgggagatcgctgctgaatctgcgactggcgctgccgagcctgcctcgcagaaaaaaccgcgacacacacatgctgaccttttgacgtttcctctccaacagagagagtcgccctgccgtcgtcgcgctcgcagcaccgcccacagtcgacatgcgaaacgtcgcgaagagcctctgcgatgcctgccgctacaagcttctgcctgatgtcggtgagtccggtgtctgtttgacgtctttctttctttctgaccgctctcctcgactccaaagctggagggtcgccgtcaggagctctcttgtcgtctcgtcctcgctcggtctccctcgtctctgcattggccgccgtctctggacgggatgtccgtctgtgttgtctgtctttttctattctgtctctccttgagcaagactcgcgggtcgtctccctcgcgtctcggacaactccattcgcgtctcttttctctcggctgga

SEQ ID NO: 3942 - DNA, 4718 bp, Toxoplasma gondii
aaaaacgcaatgcttgcaaaaactgaatctgcatgtgtggctatccacgctctccgtaggtccgttttttcttcgcgacaggcagaaccagtggaatccgagaagaggagaattctctcggcggtctaggcgcagagcgcccccaggttcagtgtttcgaccccccaagacctggacgtccggccttcagtgagcgcccaagccgattcgcacaagaagttgccgcatccgccgaacgcagagacagcatcccccaaggctcggggagtcaccctctagagcagactcccaccggcggccggtgcagccgcgctgccagaccgcgagagggcagcgacagagcggcagagagtcctgcgggagggtgtctcgacgccgagacgcagctgtcgctctgcggaagaaaaaacgcgcggggcgctgcgctggaagaagagtccagcactcaccgatgccgtggactctgccgcatgtgagccaggttgcagtggcatggccgaactcgtggaagaagacggtcaacatcttgagcggcagcaagacgctgtacccccagacttcgcagtgccagagaatgacggcggccgcgagccaggcgagaacgatcccgaaggtgatccactgccctctttcgcagcatgttgccagcgtccagtcgagatggacgaagtcgcctgcgttgaacgatgccactgcagaggccattttcgagcggtgtgcgagcggaagaccttgaagagcggacacaaaaccgtacgcgggcgaagcgtagaatgtcacttggggacaacttgcttctctgcgtcgaatcccccgcggagaggccgtccagctgggcgctcgaccttcgaggggcagaaggcgcaacgcaggctggacgtcaacgctttggaagtgaaaaaacgtcacggagcggaagacaaagcgcgctgcgacagtcgacgggcgtcggaggtgactttgttgaagggacgcagcgaggcggggaggcttttgttgactgcagtttaggaatcatgtcctcactgagagttcctttggaaggctacgaagccgacgcgagcgagaaacaagagataaagcgagcgtctcgggaaacgcgtttgcctggccgcgcaacaaacgaaccgttccgaagtgagtttcgcgaaaaagacacatcctccgcggtgaactgcgaggttcatgcgtggaaagaacgaagaaagtagaggagaatccgtgaagaacgaccaaatattggcagacgaagttgcaagccaccccaccagtcgagaaagatcgagacctcttcgaggcactctgttcgcgaggagcgccaggcagaaagcgcctgaggaaacgcaggtcaatgtctcgtcccgaacgttgcttggctcgaaacagaagggccaggagacttttccatgaagcagacgaaacggaactgaccagacgacggcgtctccgagggagagactctcgtcaaccaagcgctggagcgtctgttctcgaagtctcctctgggacgaagagacaggagtccaccaacgtggtgtctctttccaaggaaaaaggtgaaaacgagtgacaaacggaaggaaaggactcagagttcagtccgtccacacttagacgaaaaaattgcgatttccggcctcacacggggttcgctcaaccggatcgaacgcacaactttttcgcttccgcttttccgaagcccgggaccgtccaaaagttttctccgaatttgtgcggcgagagatacctcgacttcggcctgaagacgccgactggcgcgtagccttcctcgtatgttttcaaatggtaaaagtacgccagacgcgaacgcagcgggtcaactctggaaatctcccgacgcggacggggactcggtcccaatcaacgggagtctcgcgaggtgagaaacgtctgtgacaactttgaattttctggaaaaacgtaggcgatttcgtttcgctctccgccttggcaaaccttcagaaaaaacacggctgtgacacagtgtttcctcaagacgcaaacagacggccttcgtctcccgcgcttcttcccgggccgccggcgggtcgaggcgggcgcgacgtgaagacccccgcgaagagacaaaaaaagcgctcgaccctcaagcagaaaagtcatctccagacaagaaccgcgcggttcgcctgcttcgattcttccttcctgactcaaaagcgcctttctgttaacggagctctgccttctattttttcctggctctgcccgtccctgatagagaaacgccttccaaaaatatcgcgcgagctgccggcgccgaggccaaagagagcgagcgagccgtgcggccgcagcagaacgacgggaagaacggccgtcctgcttgtcaaaagaagaagaaaacgggggaaaggaacgtcgactgggggttctccaacttcaaagcgaaatatgcagaagccacaacaacttgaaatgaatgacaaatacgcgtttcgtctgccttcttgggaaacgcgaaaacgtgaaagcaaacgccatcaataatagaaagggaagatcagattcagatttcgtttgcattcccgcgcgatggctggaaagaagagtcgaagaaagcctcagacagacgaccgactctcgtagaatgactaccctcattcgaaacacacatgccgatttcgtacaatctctccaaaagcggaacgtcgaaaagattggccgagaaacttggtcagacacttgcgtcgtcaaacagacatgttctaggcgcgtcaggcagctggaattccgcatacagcccggagatgtcggatctgccccgaaaaaaaggaatttgctttgcctcggaaaagttgtggaatctcagatggtgagaaaccagcccaggctgtctaggactcgaccggagatgtctctgggagcatgacagacagacccccgggaaaagaaccgcttctacgttttgagacttgaccgaattgccttctcgcgcggcaaggcctttcgaaactcgtttatccgggaaatatgccaagaactcgcctcttcttcctgccgtacaccacgaccaaacaagaagttccccgtatcacccatgtcggagtgtcagcgtgggcgaaacgcaacgagagctgttccacttgtctgattggggaaagtccttagcttgcttctcaccgaaatatatgtctgcatttatctgcatgcgccagacgtttatcgatgtgcgcattaaacttgaacaaacaaccacatacacagatacagacatttaggcatagagatcgacatatttacgtcgatagagatggaaatggctcgagactttgggtcggtcgctgtcgtttgctcgagttgcttcattgcagggtgttacttttccagaggttcttttgcatcaagttcatcatcggtatgcatttcttgtgcggaggccaaggagaaagacgcacagtttccctgatttacaggaaaggcgttctccagtgcacaacatccaggtcaagtggtagaagcgaggctgcaaagctgctgcatcatctcttacaggcatcacacttccttgaacaggtatgtatgcatgtttgtattattatttagcgatccgcgaactttcgtttttgtgtgctccttaaatatcgagctatccctatgtgtatatacgcttatccttctctctcgagacagccctctcctctttgcggtgtctctctgcgtctgtcgttttgtctctcttcagttgggagacggacagacactttacagaatcgaaatccctatctgtgcggatgcgtatatgtgcaagcctcttcacatacgcatttacgtaggatttccttgcccgatcttcgactcgttactgctgcgaccggattatacacgaatttcagccgtcccctgtgacactgagacgcagttgcttctgtttttctctgtgtttgagtttgggatttctttgtacacagacaccgtcacacagcggacagtacggtagaggaagacatgagcgagcaatcatctgtggcgcaaagatcactcttaacgcctcaagctgaggagctccgaaactcttcgctgcctcgagcacttcgctgcctcgagtacttcactgccctgcggtgcagcgcctggaagaaaaaagaaatacctcgtggttgcgcgtcaatgatgttttcttgcaggacgccagaggcgcaagagggcaacgcgaagaacatggaggacaaatggaggcgaacaagagtggaactgaagagctccaagtctctcgagaagcaggaaatggagggttggcaaaggcactctttttccactgcaaaaacatgttcgcttacacacccttttttttccctgctctaaaaatgcatgcggcatttttcgcgagcgtctgcttgtcttgtcgcatgcatttcgagtttgatagacggccggcatgtgaacacccgaatcagcttttcttgcatttttcgacgcaaatcctacgcaaaaggttctttcctttcttctgatatcgcgcttcgatggggggacgctgctggcgacggtgtctcgttctgcgtttcccccttttctcggaacgcatgtgaaacgacttttttcctcatttagagaagcgcagccgctcaggctttctcgccttgtctccacgcactgagagggagtggagactccagacctctcttggtttctgcaaagaattacacggaagaacttctcttgtcttccctgctgca

SEQ ID NO: 3943 - DNA, 2387 bp, Toxoplasma gondii
ttttccgactcgtttttctccgcgcacactgcgaaagaggaaacgaactgtttcttcgcatgcacaggggccgatgcgcgtttcgcgatcttcgcacccatagtggctccctcgtcgcggcttcttctcttctcccgtagtctgcgtcttctcccccgaagacatttgacagaacggggagaggggaaagaagctgaacgtatagggcggtgcatataagggcaagtcctctcctagagaccgaaaacgacgcagccgcccagtcgttccactgtgtttcacccttctttgggggaaacgccagacaacaaaagacaaagcgagagcgactatcgcccagagtactcaggtgcatctgcgtcttaatcccgcgcgcttcagaaacgctgctgttcactgctgctcgtacacttgcacgcgttttgaaacgccgtcttttgtgtgcctctgcatgcttctcgttagacacacctcctctgtctctgttccacttttccgatgtcgtcccccccctttttgcctcgtcgcatgcagcgaggggcatgcagttttcctctgaaactctgtcacagcgagatggtgccgtggttcgactctcgctgaaaactctggaatgttttttggaagacgaaccagcgttctcgaggagggggtgagctgcagtgacaccggaaactcgcgcagtgcccggtggccaccaacagacacaactgcatgctccactcttctttcttcgagcattgcatgcacttgtcaaaacagagacactctgcacctcagaaacacgttcccagaaatcatgtgattacagagacacaaattaatgagaaatctatctgaacatatatatatatatatatgtatatatatccatgtgtagttacaggtgcagatggcagatgcaccacatgtgcatggatagtatctctatacacgtatacatatgcatatatatatatatttatacacttatattcgggcgccttagattcttcaccgtttgctggatcctctataaaactgtgcacagaagaaaatactgtgtattccgagagcatttactcatctacaatatatatatatatatatacatgctgaatgagttgtgaaagcttctgggaagacgcgtgacgttgagacgagttgttctggcgacatgcagaagtatctgtttcgagcgtttctcgcttttcagttcgtgaggtccctgagagagatttgaaccttttcctaaccagcagggcctttttccagaaggcagagaattttcagaagttcatggcatgaacaacttcaaaacggtttctatgcctctcctcacacttctttccgtccgctgctgtctctctttcagctccgtcctcgccgacgggggctcggggcctctctccggtctcgacacgagcgctctgaaaacgcgactttcagagaccgggctgcggtgcggcgacaaacggagacggaagagacccgattgtttttctcgcggtttctgctgtcgctgtttccctttttcgtggaggaccttagagctgctgctcaatttcgagcacaagaaacgcgacggggaaacgtggagaccgccttttgtgcatgcaatcggatgtgcagagttcaagcgcaaagacacagtgtgcaaccgcgcccaggaagagagaaagagaaagagaaagagagacgagagggtgttttttggagggtgaaattcgttagaatcctggatggaaagcgacttttcgttctcggttgtctccttctggatttcggcttccaggattgaccctggcgcgcgagaggggaagagatgacgagacagagaagaattcctggagggtgaagacgcaagagctcgtgtgctggcggtcgttctttgttctccccaccggtcttttcctatggtttctgtccgttcttcgcctttcttttcgacaggttggcttgcgggcaggccggtcagaggacgaagcttgtggcctctctcaggtgcaaagaaagcgaaaagggtacataagacaagggagagggaagagagacgccaagaggtctcacctttcctctctcgtttctctttcttctttcttcttttgccctcttttatttctagtctctctgtctcctttgcctctctgtgcttgcttcttcagcctcaccagggtggctcctgctctcctctcgcacgcagctgccatgtagtagtgtgccgttgtgcggcttcgagtgtttccgcctttctgttccttctcttctttctcttcttatcttcctcttttctttcctctctttctttgcctctgatgcgcgggccatttctcttccttcatctcttttctccctccgttcgtttccggtggccgcctcctttgccgggctcctctctgtctccaaga

SEQ ID NO: 3944 - DNA, 2471 bp, Toxoplasma gondii
cttcctgaagtagtctctttcaagcagtgatttttgaccgaagtctgcgtgcaattgttgactcgctgtatgtcaggacctaatcacggcgcgagaagatcttcaacggcggggctacaagttcgagaactgactgtaacatgttccttgtatgaaacgtggaggcgtttacgtggtgtcctatgaatgtagacatcttccgaatgtcgtcgtacacatatggactcatatagaaccgttcgtgtgtacactgtgtagagattgtgccttctgtgcatctgctccacttgctgtgcaccagatgcagactcgtggtcactggggagtccaagttgtagtccctaggtaatttgaggcacgaccaactcataggacgtgatcaaacagaaaccaaataaacaacgttggaggggaccatcctgactgtcgataaattggtgttattttcagatgtgttaatttcagataagcttccacttgtgtctcggacggtatggcatgttccaagaggagctgcatgcttaaacaccattgtcaaaaaacaaacagcagttcgttacaaggttgacaacttacccaacaaacgtcaattttcctttgctcacagatcttgtgcagaactggtctggcttcaagtacccggtgttgtccggatcttccctttcaagaaaacttgctggtcaaggctgcttgctaacggaaatgtctcaacataagtttgtcaattgcttttgggagacacagcgcgtcacttgctggcaaagcaatgtgaaaacatcctagcgaaagcacgactgatcacgtttgtagattatgatgacacgtctcctccaaccatgtaatcgcagatcaagcagtaccagatgtagatgtctggttcacgtgcatacttcattcatcgagctgtcaatacactggtgattaacgtcaaccagattgtggggggcagggaatcctcaactaccacaagctcattgggaatagctgaatggcataactgttgctggtgaagtggccggtgatggcacagaaacggggaatttttcggtgctcaccgaactgtgaaatccagaagaatgttttctagttgcgtgttgctggcagtacagcaccggaagtacgttgtctatagtaatcaaaacttcatgatggtaactccttccttcagtgggaacagacagtttcctctgacagggttcctggttgatctgccaggttattgagaatagctcagcaccttttcgacggcgcgctgcttgtgaggttatccggatgaatttacgcacgtgttccagtgctgcagcagatttttttagggtgacgattggagccaaaatcctcgcgtggacacaacaatttccacatttctggtagctattgtggctattaccggtgatgttatctctatctgccagacgcggcctctaacacgtctcatggtgacgccaggcacatgatagagtcgctgacagaggagtattagcaagcgtatacttaacgccaaatcaaaattgaaatggatttaatgttgttcgtgtcgaccccctccgattcttcatgcgcgacgttgctatgcatgtcattggctagataatgtcttcgctcttacaaaaccttcagtttaacggataaaggttgacccaccatatcgatgtcaaggtatgaaagcagagcatatccatctcaaagcggcaaccccgtggcaatcctttgaatcataaatgtattttgtatgatgtagaaaagcgttgtcttctgatcgttgaaaacgttcacaagacaggagcaagattttcccacgcgcgcagcctgggtgcgcagatcgagcgagccgctacaagggaaccgaccccctgtctcccgtaagacagtgtaaacggctctgagcatttttcaccatgtggtaaggtcatccttggtctaaactgcctgtttttcccgagatttcctgcgaatctctaagttgagaggtccgccatgtgtctaatgtgcggtagtggtccggtctaatcgagagaagacatcaaagctctttaatggcgacaccatccattgaaagccaattcaaaccacagtcattgagtgtcttttaattccacgtctgtaaatggatttttattcggcttgccagggggtagcttgtctctctgtcaggggttttgagtcactgtgaacaagccagaactgttcgagtttgagctcggggactctcgaggtcaccgagacctgcggctttacatggcctacacaagtggcctgtggcggtaagaagttccttgccctttatgttgggatcaatcttttcgcttggattcctcgtggcgagttatggcttgtagatggtcgctgccacccacttcaacgacgcagtgagccgctacagtctccaaccgactgcagacattggttgaaattccctccaaattttatcttcgccgtcaaaaagaactccgttgcgttctcggctgcaa

SEQ ID NO: 3945 - DNA, 1158 bp, Toxoplasma gondii
ttgagcatcttctctttttgctgccggttggcattgtcttgtctgtcggcatcctcggatttctgcctctttctcttgccagtagcagtcgagtttttctttctttcggtgggtttcacggaagaacacgaggcttcgagcgatctgaggatcagaggggggaactgcgagaatggccgcaagctctgaggaagacaagcgaagctttggggccgaggccattgagacgcatcttctccgctttctacaaaggaggaaacacagcttcagacggatgggtacgcggctccaaaaacaaatccagtcagacgcctcttcgcttgtcgcgacagcttccttaccgcatagcttgtagtcgacgcagatgcaggcaacacaccaggctgctcgcgcgcagcgaaggaggggaacttgacgagcctcggcaggaaaagcaagacagaacgcgaaaaggctggctcccgacagagctcccaaccagaaaagagtcttgacacagcgtcgcagaggaaaagctggggccgacagacgagatagagcagccggggagccgcacgaagaagaagctgagaaagcagctgaggaagagaagaagcgaaaggacgtgagacgcgaaaagggggaagagcgacgcaggtctgcgtgagcgacaggaagaggagaaaaaaaagatcggctggttgaactggaaggcgacgcggcagaaggagcgaaacgaacagacgagacatctgaaagacgactctgcatctgcatctgctgcagtcctctcctcctcagaaagaagagaacttggactccccggtgcgtcgccattctgccgtctacgcttcttgtgcttcccctctccttgctgttcttctctgctgttctccttcttctctgctgttctccttcttctctgctgttctccttcttctctgctgttctccttcttctctgctgctctccttcttctctgctgcgctccctcttttcttctctccgcagctaacgcatgcggccggcgtcgggagcttcgggtggggaggcgccggcagagaagaggaggaagcagagagacgcacacagacaaaaaagacaaagaagctctgaaaaaaaacaatttccatttgacgagaaaagtccgccttcgcacctcgtgagtctcgtcgtgca

SEQ ID NO: 3946 - DNA, 1723 bp, Toxoplasma gondii
ccactatgatggctatgtgctgaagtgcctagaacagcatcaagagatcgcgctttgccactgttgcgcagaagcagaggggtgtcggcatgccccagaaggaccatcgattcgtaggcggaagtcgagtattcatcgccatcttcgtcgacgattgtactgtgcaatttcgaggaaaacaagcattgattccttgataaagcgaccaacaggacgtcaccgccagcgtcgatagcacgggaccgatcgctgtatgctccatcagcaataagcaaaatcgcatccttcccttgcgttctgaagttgggagttgcagccactgacaggagactacagtgcgcggcctcagtgaaagggcatcgtctcctttttccacagacatctggcaggcggatcccctggccgaacagagaaaaaagccatgaaagcaacagctcgacgagacaccacacaccacgcgcggtttctggggagacaaatgcaggcgacggtcgaatggtggatgtgtacagagaagcaaatgaagcaacgaacgacctgattccttcacccagctgaccgtaagcactgaggaaggcacatcggccggaaagtggacaacactcggctcgctcactagcctcttcgaggcggaggcgtgtgtacgcgggtgtgcacactggtggatcagcaacagaagaggagaaaggacagacttggaggggcctggatgctgagtgatacggcagcggcacaccaagcgccttggaatgtaaagctacatccgcgctgggaaggatcacccactggggtaactgtggaaggggaaaggagctgtcgactcgagactttgtttcctgacgaagagcgacctggcgagaagtacccgtcaatacaggacaggaagtcacagcttcacgctgccgaggctggcaatccatatttcctttccctgtcggtgaactggtttgattcttcgtacggttggtgttctcacccttactggatacaactgcaacaaaatagccgagtggcggcactcgtttctgacctctcctaccccgtcgtacaggagggcgccaagaaggcttcttatcaacttgtccttgcccaagcccagagtcgcggtagtcgctttccgcacaaaaaagtagaatgcctggtgcctatggtctgtgacatgtcaagctttaatcggactcctccctggaggaggactgtcaaaagtcttgcaggccagcaacccctgtaaggttccagcataagtaacaggataacgatgtctatgactgaacatttcgtgaaattaaagtaaatccagaagtgtgtagatcatggaagctgctggagcccactgaccgcgacacaccacctacagacggggtcgtcacgactgacgaagtgcagcaccatagaagacaaactttagtgcccttcccatgggaacgggtgtgtcttcaagatgaatggtgccagagaagcccagtacgagaattccaaaagtgaaaagatatcttcttgggactgtccattgcacgcatgcgttgtcttccaccatcttccctgcatgcatcagaagacgctcgttcggctacggaagtggaacatgacagaatctttgaaaaacgcgaagcattccagggactcgtattaacgaaggcttttgttaaaatcatgcttgatactgcttagtgtgtcaatggtaccgtgttgtggcggattccgccgcagcggggagcagtga

SEQ ID NO: 3947 - DNA, 507 bp, Toxoplasma gondii
agccaaaatttggctgacgacacgctcagaaggaagagaagtaaagcggatactagggcgagcaggtgaatttcagtagcgaaagcaacatccccttgtaatttttaaaacccgcaacaactgaccgctgctgtctccactctggtaatgtaggcacgtctttatatacgtgtgtgtacgcgcgtatgtggtctggagaatccgtggagtttaaatcgaagtagtaacgactgccagacgcatatgcgtgcaccagtatgcgtgcgcgtacttgcaccatattcgagcttgtacgtccacatgtgcgtgcaacggttcatgcgaatgtcgctgtacaagcatacattttcatatagtcatttggaagcattcgtggacaggtgccgctatggtggggtgtcggttactgctccagtcccccgtaaaccgtcgtttttttggggcttgtttactgtggaagaatacgggcagatcatttggcatttattgtgcatgaaattgcgcata

SEQ ID NO: 3948 - DNA, 2809 bp, Toxoplasma gondii
gttgcggaaactgtgttcctactcgatcctcggcactcttttcatggggaaagcacggacagcgtccgcgaaggcctgcagcgcggtctccgcaacgagtgcctctaaaatgaggcacctgtgtggtgctttctgttactcttttgtgggatgcgtctgtgtgtgcactacgccgcgcccggaggaagtcgtttctggccccccagtccgggcgactcctgtcctggcgttcgtattattcttcagttgtctttgtccgttgtcgtggaagagactatgcaacgcagaacaaaggcgcgttctccgttcgtcggagagattctgccgggaagttacaacgcctgccggctcacgagattcgtacatcaagtggagacaaattcgggaggtacaaccaagaagctgtcacggaaataccaccgcgtaaaaagtgtgtgtttgtcgaatatttctccaatatttacaagaaccagagccctacttgatctttttaaatactaacccaaaacacggaacaacacaccgtggcttccggggctgtgcgaacgcagccgagaaatgactcgcacacgaatgcagctcacgctgctgctccaagtttccccgttccacgaggaacgtctctcgctccccgaaacagaaagtgatgataaaaagagttgaaagaatggctctagccacagcccttgttgagctgccttcggtggtcaatctatgatcttagccagtctcagaatacgaggagcgagatggcccgacgcttagaccctgagcacctctacatcccttgaatcgtccctggattgcaaagcagttgtccacagaaaagatctgctgttgcaggaaactgaaagtcgacacttttcggccagagtgctcgacgactccggtctttacgaaccgtctgggtcgtcaaaagaaaggagagaaactggattcgtggtgaaggcagccgtgtgtgagggtgcctcgagggagtatctccacgaaagggattcttatcctttagctgcgaggtcttctcgccccatcagaccagcgtcgccgtctgtctggtcgtacattggagaaactactgagtataaataaaaacagccacccttcgtgtgcgttactaactgcagtatgtgtgcccatactagagaacctggaatagaaatacaacccatagctaagatcatagctagaccatgtattgtaattatcacattataagtagatattgtctctgtacaaatgatccgctgcacctcagtcacgaaggttccagaccaacataaaggcagaaaacactagccctgtgtaggcgccggtcctcgaagccgtgtcaacagaacagaacttggactcggtaaccaaaaacgtgaaagatctacaccaggaggccaacttgtttcgacgaagacgctgtcgcttctgtgtttccagtaagccgcgagaaaatgcacggcgaaggcacaccttttcctcttggtccgcatcctcctgaatgtaacggtagaagcgaaaagcaaatgactctttaactcttaaaatgaacggccaaggatggtccgactgttcctgtaatttcaataaaacgcatcttctctccacgaagcgtggcgttgtgtttcggagctctaggaaaaagtcctcttgttctccgtggttaaagctcgtggcgcgtgggtctgaacgttggtgacaccagctaggattcccctccccgagtccttgattgttctcgcttcgatgccgccatattctcgtcgagttcctgacaggattcagagctcgaatccctccgtccaatttccgaaacagccatccacacagactcgagaactgagtctggctggggcgttgtacagacacgcagggtcacctgcggtctggcgcctgctgttcgcagcgagttgtttcacgacgagaacgtctgtgttggaccgaaaggcacgcattttagtgcgagtcgctcggccatcggcaagacgcgacacacgtctgacaggaattcctcaatttggaacctctgttgctttttttccggtagaccgaccacccgacgtcagtcgcgggatatacgagagaggctgcggctgcgactgcagcgccagggtcaccctttttccggaggaacagagctccttcttgcggaaaacacagacgatttcctccactttctcctaaacaaagaacagagaaactatgagccgattaccactccgcattcctcgtgcggggcacttggctttttctcgtctcggcgcacaccgtcctcgacgaccgcacacagcgaccgagactgccgacttacgaaaagattcccccttcagaacgaaggcccgcggctgcttctactcgcagacgcttcgatgcagagaaggcgagctttccgctgttcttcggcgatcctcttttcagggacatctagcccaggctcgttttctgccgactttttcccttgcgtttttgtgaaagagcaacacaacgagcacgcgtggacgaggtcgctgcattcagcgcaaaaaggttccttctgcttccttctgtttcctccgtcgttgtctgtcaactggaaaggtcctctcgggtcaggctccgagtctgtttgtgtgtttccccaagaaggactctcccgcggctcctttttttcgcctgtgtgctgcctcgctgctcgaggcaaagtccaagcatcgagctgtcgaactgcttctgtgcttctctctcgccatccacttcatcagagcctgaacgggcgcccctggatttcctcgagaccgccacccacttgcaagtttcgttgcttctccacgaaactcgaaga

SEQ ID NO: 3949 - DNA, 1643 bp, Toxoplasma gondii
ggtggtatccatacgatcgtaaaagagagtgcctgtaagttgaactgtagcggggtttgtaggatcgcgctgtgatccctccatccatttagtccgtttgctacggggtgaatggtttcaggaaatgtcgggattcggaagcaggcgcagcagggcacgcagtgtgcgtaccgaatcggacagaacattgcgcggaaatgccggcggctaggaatatctcaggtggaaatcaagtttagacgcatcatgcgagtgaaccaacttctccaggctttcactgctcatgggctgggagtcactgcaattgctcacgagccgagattgcccaaatgcggtcaaaatgcgacgaaacccagaaagagaagacgcgtgtgactgacacgaatgcaagaggcaggcaaggatgttttgtggacagccttgatctgtcactttttcgtcttcctacgtcaggaacagtcatctgcacgcgtaagggccacggcacggagcatctttggaaaaccactctgagaattcatgtgcctagtatctggtggacttccaggggtggtggaacgtcgtactcttctgcagtgaccagtaaatttgtagggtgcagcgaactgagaacagagcgtacatgactctgcaggtgacgcgatgcgtgcagtccccgttcaagttggagggaatttagagtgaacgtagcttgcgttgtttgctacctgaacagatgactttgaatcatacccctcgcttggttgagcggcgaacaccggaaaaatttgggaatatcatgaggcctttttcttcaacttctggctctgaccacgatgcatgggcacacaacacagtagcgacttatagaattaacagcaactcatgccgcaatatctgtccgttagtctagtgacactatctgatgcggtaacgcatagtcaccaagaccagtctaccatgcgatagttttcgctttgggaatgagtctgaaagagccaactcttcagacggaaataagacacgaagtcagaaaccaagcatgcttgaaacgcctactgtcaaccgaccgtcaggagatggctccagagaataacggaaatgtcataaatgctttggcagacagcgccctgtcaccacgacttctctaacgtatgaacgtagcatcaggaaacacagtatctacgctgtcaaaagcgataacgctttagattggtacagagccttttttggcaggttgggacttctctggataaaagttcttcattcttcgtccgctggtcatttttgtgacgacacactgcttttaatccgcatttgctgtgttagtatactcgtgagacgaccatattcagtcggccccataactgtagagtctgagcccgctggcgtgaccgctcaaaaattatggatacgcaatggcagagctcaagcatctgcctggatgtggaacccggagatgtcgcagtgtttagcgacaatggaatggcggcaactgcttcgccatgggaagtgtaaaactggcatcatgagcatgcagctgcggacaccgaaaactattataaggctgtagtcctttgctggaaaaagacaaggcgaagacattgtcttttgctcggtactgatacatttcttccgaaaacatcgacagtatgcatcaccga

SEQ ID NO: 3950 - DNA, 1829 bp, Toxoplasma gondii
ttgctgaagagaaaaactgaaactccctggagccagaagacactcctcccgatcagagaggcgaggataagacgtaagatgtccttttgcggccgtcaacacagacgccaccgaaggcaatgcaccagaggtaaaccctgcaaaactgtaacttgccgttggctcgaccagtagttcatgcatacgctgtcggggccgggacacaaagaaatcgtcattggcgtccgcttgtaggtcgcccgcagcgacgcttgtgaaaggtgcaacatcccccaccggtactgctgcaagaacagagctgagtggttccccatcgatggtgtccttccttgctggtacagtgtcaagatccacggttccacctacactgtccacagatgtccattgatcccggacggctaagtcggttggtattggctgaatgccgccgggtgactttcgtctttgtgcagtctgaccggtgccacggtcggctgctgtttgaaccccggtgtgaaactgcgaatcactccacttcaacagggcaggccctactggttttcctgccatggaagagagggaagaccgccccaacctcgaaaatctcacacggctggaacttgcgtcgaacatggtgacgtcatgggagattggacgagaggaaggtgatcccgttgtgaccacggactacgcggagacccactcatgagtggggaaaacgcaagacagaccagaaacagaaactgtgtctgtgtgtacctcaaggctatcccaggagctggaggcttaatgaataccgcagactggcgcaaggctggccaccaaaccgagataagtacagaaaacccgtggtgaagtggggtatccatttgacactcccgatatgatcatgcacaaacctgactcggtaggccagattttgaggaaaaaacggaaaaacacagacggcgacactggccaacaagaatggacaagatctgctcggcgtgcacgtatgttttgacgcttgcctctacgggatccgggctgaaggtggtgttagggatgactaccacgtcaggaccagcaccagcccatcgtggaaatagcaagaccgctaaaaatgtgatttccacttaatatgcgtcctcgaaagaacttatcccgtctttactgaccaggacgttcatcctgcgttgccagctgagatgctgcacatgcagagttggcagccgcatgaaaaaaggcgagaggaagacacagctcgctacatgccgccagactgaagacatctaatcgggggccgctacctggtgttgaggacaagaaaagagtgctgcatcgatgaggccctaacaaatagggcatcatccttcagtgcttcaaacccttccttttaccaatatttttgtccttttcactgttgctgcctttcttggcgtgccggttcaagtctgtcgctcgagttgtctctgtgtcccgccgaggggatatcttcgctcgcacgagcaagacactcgcgttgcggctcaaattgtagctgcagcattcagagctccgcgcaactttacgctgtgctaaagggttatcttttgtgagcacttccgctagcctgcagtttgagacattttgactggctggttaaccgtgaaggcgtcagtaccagctctattaacaccagccaacgattcatcgtgtagcagtcatcgtaaactcggaggactgtgatcctcgttgagcctgcttcatccttttccctgtgcaactccacttgtactttctcactgtgtttactgactgcctgggttccagtggtccaaaattcgctttctgtttgccacattccccagatcctcgccgacctgcaccca

SEQ ID NO: 3951 - DNA, 701 bp, Toxoplasma gondii
tgaatgcatttacagagatgtatacatccaagggctctgtcaagcgacaagcatacgagcctggttgtctgtgtctcgtaactctgtctgtttcgtcgacgaacgaggctggaggtctgagttgcggagcgactgtccagcaacgtaccgaggaagagactcgtgagaggaaggctgacaccgacacggcagacgttccgcgtatgcacaggcgtctcgggcatcacgactgtgggcgcatgcacaactttcgtctcgaagtagacctgcccagatcctcgaactccgtacgttgaccgaatccccttccaggtgtactgacacccgttcgtgtgcatgcaagacgcgctcaaccctgtggaggcgtcgacttccaggtccaagtgggcgtccgccgcgtcgagtcgcaccgggaaaagtgagaaagaggaagaagaagaggaagaagaacaggaagaagaagaggaagaagaggaagaagaggaagaagtagaagaggacttagagggaaggtcgtagacgatgggaggaggcgggccgcgttcctccgcggcaggcggggcagctcggtatggcggggcttgcatggttgcgagagggaagaaggacgttggaattttttcgcggaacgttcatgcattattcgccgaaaaggcgcctttggagcggtttttgttcgcgaactggatggctagaaggga

SEQ ID NO: 3952 - DNA, 4718 bp, Toxoplasma gondii
gtcgaagccttgctcgtatgatcccggaacatcgcttcgctgttcctcgcaggcctgctgggccggcgtcacggctggaaaggcctcgtcttctcgcggttgcgccgagaccgagggcgcgtagatctttttgagttggtagactgcgaagaagtcgaggacgaggaaggccagacccgctgcagctaacaggaacggcgcggaggagagaaaggagacgagcacagaccaaggaacagccatcgtgagagacgctcccgccccccacaaacttccgttcagggggaggtcctccagtctcgcatcgaggagaggacgggaaccacagaaatctctgaaagaagaactcagccaccagccagccgacaactcacgacttcacacacatgtacatctccagatgtttaccgaggtctacagatgccatattagctgttgttgaaagctcgaagacgttttgagacatagacacgcacagaactcgatgcagagacactcatacagactggtcgagagatcgcaagacagagacggagacgaacggatacccttccggttgcatctgcaggctgtacgagtggaggagcagctgagagttctggaagaactggcgagaagtgacggcgtcgcggcgcctcggcaaagcagaggcgtcaacgagacgaaacgcccgacgttcggccccgtcaacaggtaagcaaagacgaggcgaaagccgcgggacgcgaagcctccagaacgtccgagaaacgcgagagaagagagacaacaccgcgagtctctgaggcggcgctcttcctcgacagtcggcagggagcagaagtcgagagccttgcgtcttcagccgtgaaagcttcaacgcccatctcaaacgcgaccgaggaaagtcttgcggctttctctgttgcacggagatggcgcaagagttgccggtcaaaacggcctcgggaacggagagaggcagtgcccagagaggagatgccgacgaagacgcaactgtttctcctgccttttcttggagcatgcagcaaggctgtgttgtggtgtgttctcttttctgccccttaacaaattgagggaaggaacagaagcgaaaggggagggagagaactgaaagaagagacggggaagtaggagagagaggcgaggcggcggtgagttcggcgcagagtgtgcgacgagaaagccggaacaagtattttttcagggactcggcttctctagtttttgtgcgaagagacgacttcgcagtctttgctttcgcgcctgtttacagactgcggaaaagaaagaaaagcggacagcatgcagagcgtgagcggaagttccggtctcgctttttcctcgcgcatgcagtcgcacaccaaggacacaacgggggagacgaaatgactgcgagtaagagacacgaagcacggcagaaggaaagagaaaacgcagacaacaaaggcaggcagcctctcgctttctcggtgtttgaagcagcaaagagcgtaggcgtctttggtgaaggacgcgactgcttgctcgtacgcaagaggagagaagtctggacagcggacgctagctactgtcgatctcagggactctgcgtttgaactcgaagcagcagaaactacaggagctccagttgtagagaagatacaaagaaaagcgcgctgtttcggtggagctcgggaatcctcgacgctggttgcatgtcgagtggcggcgagctgtatgtacagacacccgaacaggcggaggcgacgaagcggagggcttatctggggtgtatgtacacccgaaaacagacgaaaaatgcacacaaggtgggatgcgaagtcgcgtttcacactttgttattgtctgcctctctttctcactcaacccgacttctcttgtctgtctctctgagtcgtttcctcctgtctggtgtcccccttcgtctgaacctcatctctgtctccggcgccttgagacgatgcctgcttcagctcctctctctgtgtcagaaaaagttttcgtctctctctgcgaggcatcccaagcgcctctctggcgagacccaagcttcctgcgaacgccagtgtgctttcgccttcggtgtgcgagtgtgtcggttcgtctcctcactctgtgactttctgtctgcagttctctgcgagaaaggcaagacgtggatcctcctcagtctcttccgagcgtcgcctcgaagacgaagagtcgcggctctgaggggtcagtccgcactgcagcgttcgtgagacgcgaaggaaggcgaaggaggcagctgcctctgggctggcttttttcagtatggcttctgagctttactgggattttccggacagacacgcgatcacttcacggctggttgccacccacttggcctttgaccacaagcgaaacaggaaacgaaaaagagcgcgaaacgtcaaaagaggacttggcgctttcacactgagggtcgccccttcacgagccacagacaagagaatccatccgagaaccgggtgcacatccacctcggaagagggattgcagatagaggaaacgcaggtcctgcgagtcgcgataagcgatcggctcctgcttcttcagtcttaaaaagagagcgtcgactcccacagagacacaacagacaacgcacgagaagacaccaagcctgctttttccacccctctgtttgtacagtagacttggcaaacactgtcaaggttgaggactagagagcgggagatgcaggtccagctcacctcggactttttgaacgaggatcgaatcaaacaagtgacatgtctagtgaggttgagggaggacaatcgagtgactccgtcgcgaggcgctctgaatttctcgaaactacctccccgcgcgaagaagagagacggacagacagaggagaagagacgggaggagcgacagagagcgagaaatgggatgcgcgcaagacagaaaaaaagagagatgagaaataagtatagggtgaaaaaagctgcagaaaaaagggtgggcagacacacaacgctggtttcttagacactagtgaagtttatctggcttctacaaactgcatgaggtcttggaatcgcgagaaagagtcagaagtgaggatctcggtcctgctgtctctgtcgcaaagaaattcgtccggcgagatttcgtgacctcaagactcttttctccttccctcccccgactctttcaatcctttcactttcagtgaaaacccagactgtttcttttcgtcattccatttcaatgggcctttctcccgctctttcctctctccgatgaaacgtcgaattcgtccttctccagtttcctcctcatgaatcgtctcatcttcactcccgcttcctcacctcgcttgccatcttcttgcttgtctccctctctcccctctcgtctctcttcttgtctcccttctctgccttcttctctctgctatcctctctctcctttcttctctccattcttctgagtctcctttcttctctctgttcttctctctctcggctttccgctcctcaccatgaagattcttctgttgtctgcatctctgcctctcttgcagttttctctctccccttcctgctcctctccgtctcccttcctctcgcagttctcgctctcttttgcttgtatattatgtttcactaattcatggcgaccgctggcctctctccaggcgtcttcttgtcacctgcgaaacgcatctgttcccgcagaaggtctcgcgccagcgcaggagagaactcgagagaacagaccggctctgaaaacgtactgagcttccaaaaaagaaacgttcgcaggggaggaagaagagagttgtctggcattgaagcactctgaaagcgttatttttatcgaaggttctcgaaactctctgcagttcacttcgagctcagcaattgtgtcttgagcagaaagctctcctcgtccgccccccgcggcgccgcctgtcccccccagttcgcgggctcctcgggtgtctggacaccctgcacaccgcgtttcccgcgcctctggaaaaagcgagaaaaaacgccggcgaatgccgtcactttgtgtgtggcttcgatgcagattcggggctttgaaaagaactttcttggaggcttcgaccttctcctctcatgcccataccgcctccggcgcccccagtgtgcactcaacctcaggggaaactgcacttcttcatctcgctttttttcgtcgctccttttctcccagccgctatccttttcttggaacctctccgctcgtcggttttctgtgtctgccattcttatccgccgaactggtaaattcaaacttgaagactcgcaggggctctggacgaccagcgagcctctgtctcccgtctcgcctgtctcgtccacacgagactcctctggcctctgcgtcctctctgtctgcttctctccttctttgtctgtttcgttcgttgtttctctctgtcttttttcttcctctgtcagtccctccctgtcttggtcctctccttcgctgatactggccatgtacatccgtaaagtactttcttcctttttccctgtgtgtcttcgcctcggcctgctgggcctttcttctcagcttctcttccttctttgaccaacttcgctttcctccttgacttgcttctcttccccctttgatctgctttccgtccctctcccgcatcgcttctgggcgaagagaaagaaggttcgcgatctgtctctttcgga

SEQ ID NO: 3953 - DNA, 3972 bp, Toxoplasma gondii
gtctcacaccaatttgcaaggtcgcctatgcaggcgcaaacgtaaatccagaagcatgtttcccatgatgtggaaatggctgggtctaggcaagacagaagctcatcaacatgcttctcgagattcatctatatatcaccagatgcacgaatacacactagtccacgtcttgtgagcagggagtgcagccacacaacgacgcgtgcagtggcatgctgtgctgtctggcttacttgtttctacaaccgacccgttgatactgcttgcatcgccgtcgtcgaataggcaatcagcggaacctcccgatgtactactccgtgttgtgtattttgtgtatttccccctggcactgccctcatcattttcagcttgacttcctgcctccaagtcgatatctacaaggtccgcaattgcggtttcgggctctccttccgcacccgagaaaaaccccttttcttgagaatctgtcgtttcggtctggccacatttctctagagaaaatgcgaggcatttgagctcggatcctatttctcctgaggtgctcatgtctgcacaaacccgctgagccgtcacttccattgctccttccgtcactttcaaagaaaaggccagttagaacgtcacctgcctttcccatggcaggtattttcgaacaaaagacagaaccttacacacgcggaaaacgcgacagaagaaaactttgacggcttttcgactgtcttcagagaacaaaaagggaacacgaatacgaacgcagatgaaaccgcgagccgaatgtgtcagtgctaaacccaggcggtgaatgcgactaaaggacgtttcgttctaagccgacgaaatgatggcaagcagagaccacccgaagaggcaacgcagactggctgcttcttctttcaacgaaaagaacaatattcggtatctgtgatatgttcgcacgtcggataagcaaatatacatatatatatgcacaaccaaaagaccgcaagttaaaagacgggatacgctcaccctcaaagcttatggccacgcgtcttcagatagcgaaaaaagttgcaatattttcgaacgagcaaatgaaataatggccgagcacacacatatgagcccgataatgcagtacagagcggaatccacacacggcttgggacgcgtatgttgcgtggaatatgtttattcctgcgactgcagataatgtaggaaaaacgtcagaagcatcggtgaaataagcctgcctgctatttttgtgaatggtgacgcgaggaaaagcgaaccacaaaaggcgtgtttctctccacacttcagcggcgggaaaaaacggaacacagaaccagccaagatagccttatgaatcgtgtttcatagagtggaaaaacgagaacacgtcgaaaaactgatggacataaaaaccttttgcaaaccttttgctgcaaaaagcaagagaaaaacacacaacaacacttttctaagtcgttttgtttgagccaaaggtcgcagtaaaacaagaaatgagctcttgtcggtcatcctcttcaaaaactcgaattccacggacgatgacgattcgtcaaaaaatctgaaaagctcaaaaacaggtcggatcgaccgagacgcagataacgtgattgtagaagccgcgcgaacgcgattgcccacacgagcagctggaaaccacatagccacgacgttcggtttcgggtaaccgatcctttgtcattcgtttcatccacgggcattgtgcatgaatgaaaacctcttagatggttatttgctgtgcgcagacgacttcgattgcaaggcagtaagacagtcgtaacgtgcggatggggcaatctacgcagaaacactacgtagtttgtctttcttcagatgctaagaccgtaaagactgtggtggcagccgtaacatgcgtcttcatagggatattccggcgactaggcataacaacgaaacgcgctcaccatatcaggagagcttcactggagctgtatgtggcctacggcagtgctacatgtccaccgcacatatttcacaagttgaggttggaatccgctgacccacatcccaaatcacattgtatatcgcggtggctagaggcgcactcaagacgccaacgatgctgctctactgctagaacctcttacagtgcactcgacgacttcctgtggcaacttaagccaatcgttgacatcgtgttaggtgtcagcacatcattaccgtttcatttgagcagtgtgaagagctcatcattttcattcaagtaggaccgatgagtgaatcagcgcttcgtcgatgccagctgaatcctggattcattttttcggggccagttttggctgtaacacgtaacaggcacgaggtcaattatgctgagatcagagcgaagaaatgcgtcgtgcccagtcggggttcagtgcagccgctctctttcaggaaaaagaattgtcaacgacccgttgcacctgttgtccgaacgaaagttggcgaactgacatctgtactgaggtgaagtagccagctgtaagggggggctttgaacaattgatcggcgtgtctctgtctccactggtctactttatgctcatacgagctataagctgatacttttcgtacagtatagtggctagtgagttttgtttgatacgccccaaaacatcccgtagttctctgttgaaagggcaatatatatatatatatatatatatatgagagagagagagagagcgtatctacctaaagagagtgccgacgttgctttgttacgaggtgcgagaagaccttgaccgagaaaactcgatggatttataaaccttataccatctacatatataaatataaatgttagctaatggtatatctgtagacgtttccagtgggaactggtcgttttccggacttatcttgcaacgagcgttcaatcggcgccctccgtagaaacgctgatcctcttcgtttgtaggagtacaggcgtctgcgggtgaagctaatggaaggatacttgggcgtgaaatacatttttctgtcgtgcttcactggaccaacagttccaccgcagcggcttctcgctctccgctaaacactcatgagcagctgcgttcaggtgaagcacgagatgcatgcatgcaccgcggcagacacacgcgaattcctcgcttcttactgtttttaactagtggaaccggtgctgtccttaaccaagaactctcacctgtccttcaccgccgctgtaactgtcactctttttttcgtctctcggttttccaacgccagtcatcggtctgtatggccgtgcattcgatccgtttgtctccgggcaaggatcgcttttccctctgtcgggcattcggattcggaggacgaagttctttgagttttttctcgaaagtgtctggctcctgatttccaaacgaaaaagtatccctctgggggttctttgggaaagacgctgcgcggcttcagagacacccaatttctcgtcttgcctgtctcaccaatttttgtcacggcgtattgttccagatccgctatgttgtcgtctctaagctacccccaaaactctttcactgcctcttcaccagcgttctggcgaaaagatcccgagaagctgtaaaccacaaccgagcgggaggaggacagttgtgtcggatgtatattatccacttttcaattcaatcgtctcgtcctacatctctcacgtacattgatacgctaaagtacacctctgcctggctgcgcatctgcagacgtataaacagacagatgcgcagctaactctgtctctctctctctccctatatatatatatatatatatatgtaggtatgtgaatgcgcacgtgttttcttctactttccagtagtgacctgaaacggtcctagggtggcgttttttttgttggcgtgtctctcacttctcctcggacctcgtttttttccggaatctcttgccctaagcgttcgtgacgcgtctcgagta

SEQ ID NO: 3954 - DNA, 2437 bp, Toxoplasma gondii
ctctagagttgcgcagtagaagatcaagacgtaaacgttccagaagaagtggagagagaaggtcccgaagaagaggaagcaggagaaaatccgccagacttggcctcgctgcaggacgaggttgtagttgatgtacagcgagaacggagacacgatctccaaggtgcacagcagcatcagcgctgttgagcagaacaagtaaaacctcgtcactggcggaagatgtgagaagaacaagtccacctgcgccatcttgcggaggaagcgaaaaacgaacagaaagagaggcagcggaggcgaccgcgaggaaagaaaaagacagaaacccggccgcaacgccgccgcgagagagatgcgtttgcggagacaaagagaaggacagttggagcagaaagaaccgaaacgagacagagaatggcgagacgaaagtgagagaagagagacgccgaggggggaaggcaggagaacagaggagagaaacaggagaaggtgaacaacgaaaagtcaagtggaagagacgaaagaaaagaagctggcaagagctcgtgcgacagacgaaataggaaaacgcgggtgaatctcacagaaaaggcagaaacggtcgtcgtgtctccgcatctgttcctcctcagcagaccgagtgaacgcgttcgcctctgaaccaagaaattccaggcgcgaaagcgccgcggatccgagaaagaagagtgatagacgatgacaagatacacgtggaaaaggggaagaaagagagaggcagttcttcatcgttcagcggaggcgcaccgaaaacagccattggcaacgacccagaactacaccccgaagaggaagaacaactggagaagagaagaaactccagcaaaaatgttgtccatcttgttccctcccttcttcttcttcctcttgttgttgttgtcctgtttgttgtccttcttctgcttcttcctgttctccgcgttctccctctctctcggttttcattcgtcgcttctgcgttctgtcgcgttgtgcctcacagggcgtcgtttcgcttcgtccagggagtcaagtgtagaactgcgcttcgtcttttggcggcaaaacatgagggaaagcggagaacttctgtcgcttcggccgccgagctgtcgactcctttcgagcgaagagcgtctccgcggcaacgcctcggtcgaccggttctctgtcttcctcgttttcgtctctttctgccgtttcctttttgttggtcgtgtctcggacaaagaagccaaggcggtcgacggtgttcgagggccagccgggagacgcgttccggcaaacacaaatacatgaaaagagttgcggaattctccgagcgaggaacggacaggaaggctgggctggccagcggggcactcagtgcacgaattgaactggctggtcaggtcgacttcgaacgcgagagttgagcgggagagagcgcggagaattttttgtttctttttcgaagacagccgcacacacacggagtcccccaagcgagacagagaaaggtgacaaacgctgtctgcttttgtgcgaagaaacgaacagctgagcgaatcgccgaggcgttgctactgcccgacggggacagagagaggaggggagagacggggagaacgctgtcattatacgaagagagaacgcaggaaacagacggcgcgcgtttgtgttttttcgtcgcgttgtcaactgttcgtctttttgcccttttccccccttttgctccctgtcttccctagaaaagacgccagcaagtgcctctcttcgccgaccgctctccccgggggaacggggtgggtcgctcctctttgcttctctccgtcacacttccccgtcgattttcgaggcttctctgtggcgacggtttcgacgttccgcgggaagtcttggctcgctgcggcctgtctcttgcccctctgcaaagtcggttttctctgcggcgctccggcaccctcttccctctctttgcggtacctctccccaggttttcttcgaatcaacctctgttctcccgtttctccccgccgcagtacgcatcgctaaacgactcccagtcgagtctcttccgtacactcttcgcagctgtcgcttcctaccgacaaggacgtccctatattgacacacacatatacacatatacatatatatatgcatacaaatagatgtgtacatatgtatgcatgtatgtgtgagagctgctctttctttcacctttctttctctttgtttcgcctctccagcaccatctgacgctctctcggcggtctgttcttttctgcgtcatctctcatctcttctgtgtatcccctgtcccctctttctctgcctctgactgacttacctcttccctcttctcgctctgtctcctctgcctctcttcttcgagttttttttcctcggtcctctcttttttccaactggaaggaaa

SEQ ID NO: 3955 - DNA, 3496 bp, Toxoplasma gondii
cctgcatccacgtcttgcgcaacatttcgcattatcgactcgattttggcgtcctggtttgcttctcaagaactgtagacaaagagtgcaaatgaagatccaatttccttccatcgctgttaagaaaatcgcgaacgaatcgttaactgagaaaaccgcctaccttcttaagcgcgccattgacgatatctgctgcagtacggtacttggtcacgacgtcaggattgctcagatcctggacgacttctgtctcaacttctgaaccagttgcgtctgccatggttgctatatccgacaaaattggaaaagaatgggagttctgcagactgtatttgccgagactgtcgacggccgatgcccgagttggttgtcgactgaatttcctgtgtaaaggagagcaggagaactctgaaggtatgaacaatcggcagaaaaaacacgggacatgcagcagaaaatggaactaaaggagggtaacgagcaggcggtgtgagcacgtacacacacacgagcgatggaaaaaacagaggattcgtccgaaaactgagcctggcagaatataccagggcactcgaaatccctaaaaataaaactccctgaaacaacgacaaacgtcagaactcctcctatacttattttcaacaatttactcggtgtgacaagtcgaatggtttcggtttgtcattttcacgtctcccccacaagaaactggaacgcaagacggacagggaagcgattgtctggaagagaactgggaaacgcctgcaaggacacgatgttcacgggactacgcgctgacaagatgactcttttagggagaaaaacagccgtttgaagcctttttctttgtgagtgcagttaacgacgcctacttttcgtccgggatacactagggaggggaccatgaatggcgcaacttcggctggcgccttctctttcttaaactgccacagaaaagagagataacggagagaagtaacgtttaaaggacgagagaggcattcagccggtcgcgatgtagcgcggcgaggactgaacaagaggaggggaaatgcgcagggggtctacttgagggcccgaagttcgcggtgacgaaagggagagcacatcggatccctcgaattacaggaaagtgtgtaggcgtgactgagaagaatatgtttgaatttactcacggtgacagagagaggacgacggaatacatgtttggacggacgtttggcatggaaaaatgtggctgtcacttgtctgaatcttgaaacgggggaattcctttggggggggacagagccaactcacctttttccgatatacacaactgcgcatccaccggtttcagcatgtcccgttaagagagcgcaggttcaaaaatggactgaagatggcggcgaagcccaaaaaaaccagagaaaatggtaaacaaagggtgtggccttacccgcacaggcccacacgtaacgccaggacgaagcagagtcgcatgtcctctgtacgcgtttaatgtcagattattcagctcgggttaagccgaccccccttccccccccacccttacccaaagcaccgcgatcgcatcctagatgcgtggagtctctgcaatcttgcatctgactcttcccgtttccggtttagccctctgcatgtgcatgtatgtactctgacctcttgactaccatcatttcaacatttacggcacacaaggaattttccaccttctcaccaggcggataacgctttcacgtcccagcaatttggggcgcatgtaacccgatgccgtctcagctgctcccgtcccgagagtaacagctttctagacggcaaactgatacaagcgtgttgcccggaaacatcgttgcagcaatagttacatggaggcctcttcgcacttttctagatggggaaagcaaatagataaacatccatacttctactgcgaagaacaggagtgttctcacaaacaagagcttatctgacgtttccaagaataactgcatacggagggttcttgtggggtcagtgtcgcccgcgacgaaacggattccgtgcgcgggtgtgcgatcacattgaaagcttttttgtctcagaacgcacttctaccccgttccattgaaacagtgtgctgctttatgttttgatgcgttcctctgagacggcagctcttctgttagcttgcccacccattacgctgcacacccagagttcgggtccagctcgcggcgccccagcctctctctgcgggcaggagctcttagctggcgtacaacgacaggatgaagccccggatcccaaaggaaaggccactgaatggcaattattttattgtgaactgcaaaactgagggccttttgtgcatgccagagagcacgcgagaagggagctcttttctagagtctctgttcactctaaaggccgctgtccgaaacgggggcggaagtacggtccgacacagcgcttcattgcagtacgtagcaccagcgatcagcattccacacgccaaaaccgcgatttccgtaactaggaggaagagaataaagttttagtgcagacgaaaaagacaccgatttgaggaagccgtttgtctcttgctagacacgttcgaatctatccggagctgacgaactcgctgaggaacacgtagggtccagtgctgctcttttcgccttaaacaccgagtacgcggaggcggctgcaacgccgtcttgaccctgggctggttccgtatttcgtcccttttttcggttacgaaaccaacgtatccgcgttacccatttcctctccacagaagaaagactaaatccacttcggttcccgtatcgggcgtcattttcacctgcttcactgttggcggcgtacggtttttttccttcccatcagactgggtttgggattccgtagaactcgttgaaagttcacaagcattccctggagccagaccagagaagattcggtgattctatttttggtttgcccaccgagaaacgcgtcgtgctcgtcccagtgttgaggaaagaaggcgtgcttcgcacccggcagagtctcgaagcagcaccggaaaccgtgttgcggacgttctgctgctgagtaaaggggcccgctccctagtccacaaccgaatagataacagtacacgtcctcgagataaggtactttgatgaaagtggcctggcccactggtggcatgttctgcgccaggaggctctttgtgccgaggatctgcgcgtgcgtctgaggtgctccagtttaggtcattcgccgtcgcgctttagacctagcgtcgctttttcgaactcgaggatttcccttgaatggagataatcgtcccggaagtgtgacggctgtgtaggtctccagttattaaggacattttcgcccaccttggcaacgcgaatctgtgacacctctagaaacccccccacgctcttttaccaatcgactagctcttagcaggttcgagttgtttggaggacatcaaccacacaaaaccacctttcaacga

SEQ ID NO: 3956 - DNA, 2948 bp, Toxoplasma gondii
caatgagacatggtaactgatgacggacaccgtgtagtgagcagtgcccatgtgctcgctgtttttgtctttgttttctgaaaactgctcagccctgcggctgatgcgcaccgatattgcgtgttattgcccaataaaatttcaacggacgtgaaacctaaacgcaaagagatgtttaattgacctacaaaagagcttgctggccagttatcgtgcagaaggtgtgcgcgcactttaggcaaaacgcgtgtcacatttggtagccgaaatggattctcacgcttgaaccagctcttcggcaaaagtcggtagagttcgcgtacgtggagaatagcgacagagaaagcattgaataggtgtcttggcactgcgtcgtttttaccataagaaagtcgtgggagagggacagatccattaacagaacctacgttagtcgggaaatgcgaccagagtcacgtacccgcttagacagaacacgaggatttgacagaattgtactgagaactagtccacgaaactccaattggcgtggtataccactcgatgctgcactaacgccgatcgcgaagcatagttttaaagagatgagtctgttgcatgtgcgtcagaagtcgctccgtaacaaggcattggtgaagtaataggcttcctatgccttccaatagtgagaggttaccggacagccagtttgtcagtaacttcatattgaagctgaacggtgttttctagccgactataccctgctactattttcgtcccaaaccagttttaagtatttgcgtcatcacagcgtttttcattcgaggtgtggtgccatacgtgttctagtatggtatatgtatcctggaggtgtcgaacgtcaagcgatggcgcgcccgcaggaagcggtcatgacatcgtttggctgaagccagttaaagtgctgtcgacgccacctgcggacgccaggaatgcaaaaaatattgagaacggaaatagaagtggacacagatacttaaaatcacagaatttataacgaaggtacggccgtcgctatgtatggccctcgccgttgccacatccggttagttctgtgtagacactgcgttccacggtattttgaggttgatccgtgaagatccttcagcaaagaatgattttgtgacagggagaccaacacttcgggggaccttgtaaaaacacgcggtttgcttgcagcagatgacatcgtagaggagttgctaccgaacgttcgaggagtctgtgcaatcccgcagagacgccagtcatctaatggagcggcattcgctcaaagcgaagccagaactgcgttaggaattccgtgacagataatcacgtatttgaacgcatgctggaaaaatgacgctgctttgtccgtgggtgttggccatccgcgcgcacgtgtacatcaagctacagacggaagcaccagtcattttcagtattaatgttacggctgtccaactgaagtatcaataactatggaaagggtttgcgtaacacactagcaaaacgagtaagatgtcttttatactgaagagtacactggctttcgcccgctagtctccagttacggctgccaagacactccagcggctgggaaaaaatattcctaacacctaccgaggatctgtttcatggggcacctcgtttgtctcgtgtgtgatactatcttgtcatttgcgtgatcgttcaaagtctgtcttgtccgaaaccaccgatcagaagccgtgcatcattctcttccagtgttgccttgtgcgagcgctgcttctcggtcaccgggtcccgggcccaccttccctgtcaagtgtgccggagcaccaaggcatgaaacgccactgtgagtttgtgttggtcacgaattttgtcacctttctgtgcatccaacttgatgctgcgctgcagttcattttcactatcagagccagctcagtgacgaactggaaagtctgctgttgcatttgggacactcctccaatccgtatcgtcagctaatccggtgctggactgtggaggcgggcaacttttacacagcagttttacttctctttttcacgagtgcgcgtgaatgcaagaatcgggagcaaagctgtttcgagcctaactattctggcattgtcgacaattcgcttttcacgatcgtgtacccgcgtgtgtgctcggcgcatcggacaaactctgttcaacggagtgcagcgtctgcatccatttcgtatctgaatcaatgactggcggaactggcgttatgtggtgttgccctgcaagggaaaaatgaatctgatttcaaatttttgcgggtgaaattgactcttcgcaagcaacatacgaaaacgcgtgtctgtgtctcctctgcgtgcgttcatttacttttccccgacgcatcacgttctttcaacgggactagtttgttatttggtcggcaacaggttttgacacttgtggacatccgccgtgcgagtgtgagcacctcctccaaaccgagcgtgcgtagaactctgcatcgttttgtcgggttcaatttgtctgctttatggagtttttcatcgtctttgcggggagcaaatagcggagccagaacggaggctccttttgatgtctttttctccagctgatcgaatgctgagtgtcaccagcagaactcatgtgccagggtgtcgtctaatcagaaagggaacgagaggctcctagatatttgtttctcaaaagttgtgtccgtggaagtattggaattgaagatcctacgacatcaaggttactccaactcggtcgtgtcctgaatctgaaagtgttgaattccaagatcctgcggcttaaggttgttacgcagggtggctgtcgtgtctacgctgcagctccagtgtagataccagcagaatcgaacttggagccgatatttttctgttcgtgtaggtgcagcgggtagcgtcgagtgcctcagtagacaa

SEQ ID NO: 3957 - DNA, 4079 bp, Toxoplasma gondii
gccttaaatagaaaaaggagagtgaggagcaaccactagatgtaagagaggtagctcgacgaggttcgcggaaaaggaggaaggcaacgcctatcaaaggacagagcacggaaaggatgacgcaagaggacgccgggacatgcgaacatttgttcccccgttagttccggcgggaagaaaaattttggtgtttcttcagaatgaaacaaccaaagcaggggactgaatgtggcaatatactcaggacacaaggggcagagcatagaacggtaaaaggaccgaggcaactttccttgccgggaaatttagctccgtgctacgacatgcgatacgtcaacttctaaggcgcacggaagactccggttggacatgcatttccgaagggtcttgccgacgacgcgagcgatgaattgggaagagatgcacaggaagagcctgggcacatcagagaaagaaagtcgtgattctcatcaaaaaagtctgagaaactctggaaaggacgctacgactcagtgtttctctccggactagccgtcgtctttctcccaagatggaaggaacccgagctgtgccagcgagtcacctttttcatcgtgcagacatatagcaattcaatgcgactttccgtctttttccccctcctatcccgtaccttccttgattgctctgtcaaactgcaggacgtcagcggtacggagtgacctcatcgtcggttgagactttgactgccaaaactacgagggaacgtaaccagcagcaagggttcgccgccgcgtggaatagctggcgccagtgcagagcacagcgaaaatttcgtcgggcaaagaaatgggatacagacgggaaaatgagcatgtgcaagggtgtaggcgcgttcgggtggcatgctttcgcaccatgactctcgtgaacactctagagggaaccggggcaatgaatactgacgagtgaagcggaaagaacgcgacgagttaacttttttccgtcaggaaggggctggaaaactctccagaaagtggtaagatggtgttgcaaaaaagacgaatccaagatgacttccgcgctaactgaccagggatttgcatgaggtcacgtccagttggcccccgctcctctgtagctgtcgcgaacagcgcacacgaatgccacggttgctgcagacgcgcgaaaagtgacggatgctgaaatacaatcgccagacactgatcttcgtgtaaaggaggcaatgaacacgcaaagaacgcagctaaggcggagcctggattttctccgagcaagaaaactgctcacaaacatattagttgcctggccagcttgtgccctggcgcatcgcgtctcttccgcccgcgggtcagtgtgtgaccttatttactgaggtgtacgaagagacaatttgtgagaccctgagggagaaagcgttgcctcatttcggcaagttccgcccaaatatctcgtttcctgtcatatgtcaggcagagagcgtttccattacaacaaacgttttccttcccgatgctgcaagctctttcgtagcatcccattctgtgactaattatgttgtaggaagccgcgcttcccgttaagcaactccgatttttgctccggggcgttagacagggtcacgctagttccgtgggaggaacattgtgtcactacatcgttgttcgtggccgggcgaagcacagagggaataactgaaaccctccctcttctgtttgccgtccagcaacctgtgtctagacaggtcaacggttcaaagacaacacgtgttccctggtccagagccgaggaggcacaggagtgaggccctcttcttcatcaacggcacgtcaaataacgttccttatctgtagtccatgtagtgcagggtagccagaaaaaaagtccgggactgtgaatgcggctcatgcggaaagatatgggatggtcggtcggaggcaagccgctcgagatcttcagcgcttctacgtttatacaacagaaactttccatctccatgcatgagacgagattcttttgggcgaacaactacgcacctgtgaatctcttcggcctcctgtattaacgcaaaacgatctgcacagctctgatattgccaccacaatggctgcaacttcttcacactcacaccctgtcccctgtccttgtggatatgtgtctaaatgacctttcacgttgtgccatcattgcactgagtcctcgaacggcgcgtttgcagactcgcgtccagaagacttctgaccgaacggtaaacactcgcgacccgtcgcactgttctgtcacagtggttgctggaacacacaaatgtggtacacatgatgaacaacggaatatccagttaccggagcagcggtcggttgaattgaaccccacactcttgattgctgcctgctacaaccgggaaggggttcactctgaagcttgaaaccaccgtatagacttcttgagaaatgcgcatccagtgggcacacaggaaaataacatcccttcggggcatactgaactagacagtttcatcagacatggggccctcgtctgcacaagaatcgctttcacacacgtctcacattcacacaggaacattgtatagagcacgttcgaatatctcagccaaaaatgtgtacgttcagggaagctgggttttcaagcatcaatgaagatctgctgttccgatgcaacagatcattcaggcgacgggaggaggggagggatgatttacagagatttgtgcttggaaaatattaagtttgggctcgatgccttgactctggaaggtgttttctggctcagacgaagccctttcctctcgcacatccgtcacttaattgaaccaagctgcggcgcagaggagggccaaggggagacgcttggaaaagccaccctccgaagaggcggcaacaggcgattggcttaccttcaccggccctgaataatatcgaatcctatatgagaaccatgacgtatctgtcagagatcaggaatcatcaactgaaatgaccatgcaggatgccgggcatcagtagttgaccgatccgtcagtgccgtgcatgccagtgataacgaaaactgcgacatctacggagtcagcaaatgtgccggccgctttaccgtgatgttgcctcaaatatctcttgcggcagaaaatcagcgtgtaacataaaaggtatgctgaagctaagcaagtaccgagcaaaatgttaagagtaactgcgagcggagcctcacgcgtcttacgcgcgaacgacgtgcataagcggacggcgcgacgacacggtctacagatcagaagcgaattgacttctagaattgctgtctgcggcagttatgcgaaaaattccaaatgtgtgcgaccaaatgtgtgtgcgatacaagcaaggtggttctgctctggagcaggcttgtacagtggcagggaaaacgtgacttgttaccatgctcacaatttgaaaatattaccagacacatcgtgactgcacgtacgcgtgcgctgattggtgtaaatttcttgtcataacaatcatcatattttccaggtagctttctgcagcttcacaggcagtttacgaatcgaatatttcaagcgccattcaggcccatctataagggagtgaccgcgcggcgagccgtcagcacgcggcgtacgcgtctctacgtcgctggagttaattcgtcttgcgctaggatgtttgttaaagctgccattgattagtcatcgtactatgcgttgtcaagcttgaatatgcactgcctgttgtactgcgtagattatgagttaccctatgcgtggacttggactgcgcagtcctagaaacaaatgatacccggatgctgaactgaacgtgttcgcctatcaaaatgatatttgcatgacagacactaaaactcagctaaatgtgatccttggttcgtcgttttgttttgttccctatggggtatcgacaaagcgcttgacgaaacgcagggccgaatgccctgatttgaaccctctgagcttgatctggccctcaacaaacatgaggtgctgagaaggcttttgagcgctgtgtcctgccttcatggtggattgttgattatcaaaa

SEQ ID NO: 3958 - DNA, 1710 bp, Toxoplasma gondii
cacggctaactgattggagtcctctgtttctgtgaattgagattctttcctccgactccttggaagccgcgcttttgtgtcaaccgcgcgttggtgcgccacgtcgcacagaaggccacaacaccttagaatacgttatgtggtccctagcagcagtgcgagcctactagcgggacgtttgcgtccttctggagattcagagtccctgggtcttttcggtgttattcagaaatcaattcgattccgaagtgaccagccacacaccaacagcacacgctcaaaatttgcgacttcctagtacatttcaaaaccataaaggaagtgccaacgagacacctaggagggttcccatacacttagatatgttgtatcctcctgtttatacacacacgtctgtctacatacatatagatgtatatggtaaaaagttgtaagaagcaatagcgcatgtctatgctctttcactggcatgttgcaaaacccaggataagctgcagtcactgattcgaataagcctcactcgagctttcagcccgagtgttcgacgttagcaaacaaaattaacaaatgtctagcatccagccataaagaaacatgtgctccggtatttcgggtattgcctgtgctaaaagtctgggaatctgcgtgaaacacagaaatgacatctagggctttcttcttgatacagcattggccaaaaaatgtctgcgcaaaaattcgttcacaacgagctccccagaaagccctcattcgtgacgtggaagcctatctctggcactagcagacaactgcgtactctcttacaagcttggattcttgagatgttttcgaacatgtggggaggatccagaagtgcaagcactcgtgagaaacgcgagtctgaaatgtctttgtctgccttcatagtctgttggtaagtctcttggaaatttccattctgtaaaacaagtgccccccgcactgtcctgcccctggctgcaatgtctgtgaaaagtgcgtttgtaaacagcggaactggatacgtctcctagtacgtgacactgtaaatagactaaagcagtttagatgtccgtatcctatctgttctgctcagtcaagcaagcgtaaatgcgtttatagttggcagattttctgcggagctgtcggaggctgacgaagtagctcctttcgaaagcaaatggggttaaccccacttttagatacttaccgaggcgaaagttattcttaaccaaagattgatacgagttgacaaaaaagtaatcaaaacccgatgtcttctcaacaaaaaataacaagggcaataccttgtgggagacctgactctcacaccgcggtccgtgtcagcgcaccgtagcgcaaatggatgcgtaaagttcttttccgaattccaacagggaagcctatcagctgttgaaagagtttaactaacgttgacacgcttcactccattatatgttgttcaggcaaaaagaggagtttctcaactcactttgattccttgtcgtcgcaccggcagtgtcgctttgagggacccttttcgtacgtcgagcatgtgtttttcttctttacccagtgcaaacattttctaacctcaatcttcaatcgtttctctcgcaaatttcccgtgcgaaacttccgttttcggcattcttttggcgtctgtcgtctctagatccacttgtctcagaactgcgggcaatcaatcaccca

SEQ ID NO: 3959 - DNA, 1786 bp, Toxoplasma gondii
ctgtgtgaagtcttttagtctgatcctcttccgtcgcatggcacatctcacacgcagctacattggactgacccccgggcaacctttgagcagtgctccataactggtgaggtgtgcaaacatccgcagctggtcgagtggaggatgggctgttctgggtcatataaacgtagcttcggagaccggctaagctggataccactcttcaaggagacgttcaaaatggtgttcacggattcagctcctcctgtcacatgcttcaggatgcgaagaacggacatcgaggcgccattttttcatcactgggtcagatcgttctgcagacttctgctgctgttttaacgtacccgtcaacaaagagactgtcggcatatatcgttttactactgcagcacgagcgcgccgccagaaaacagacaccctacctcaaggacccttcggagaaagcgttgacggtggagacactggagctcgctctcccactgcagacgcgccatgacctttgaaactcctggatgcacttccttggcaagttctgctccttcagccttttttcgctctgcatctcccgactgcagcgaagatacaggtcccccctgaccgtcgagaggcgccgcaccggacagcgacggtccacctgactgagcagatgaagggggagaagaagaaggagggagaggagaagaagacgggagagacgaagaagggagaggaggagaagaagggagaggagacgaagagagaggagaagcagcagaagggagaggagacgaagaagggagaggagaagaagaagtgagagaagcagcagaagggagaggagaagcagcagaaaggagagaagaagaagggagaggagaagaagaaggagcaggaatagactgaagcggctcagttgaaagagcctgatttgtctcccctgcacgagcgacggcactgaagtcttccatcattttttcagaggaggagagagaggaccggggaaacgacacagaaaaaaaagacgagtaagaaaaaacttcgcaggtaacaagaaggccggcaggaaagaggagggaaagaagtgccctgagtgagagaaaagaactcgaagcatgtggagaaaggacggtgtccgtcgggagacgaagcagaaagcgagagcaggagatgagaaaagagagacaaaaaatgccgataaagatgttaagggatcgacaagcgttgagtcgcacgagagatgctaagaaaccattcagatgcagagaatctacgacagcgcagagcgcctaagcctcatgcgcgaccttcagaaaaaggccggcaaagtcaactcactgagaaaaaacgacttttttccgctttaaaaaactgaagccatcgaactgtcccggccgaagtcagtaaaggagaaccgtattgaccagacttgcgaggtctggcatacctccgtcgcctttgggtgagttttctcgctctcacactccacagtgtcttctctctgtgactcttgcctgcgtctcgtcgcttccttcgagttcccatctctttctccgtttctctgtatccttttgaacgctccgaatttccgcgtttctctccgcctttccgttcttttcttgtctatcagtctccttcatctcactcgccgtctctgcctgtgtctctgtttcttcttctcttgttctcaccgtttccttcgtacttgtttctttgcgttccgccgttctcttctgcagacaaagtcaattagcgccaagcgttgcggcctgacgactcgggcagaatgcttcttgctggcgatcca

SEQ ID NO: 3960 - DNA, 2879 bp, Toxoplasma gondii
cactgacaagccaagagccagtcacggatcgaggatttggaatccggagagacttttccccgttcgtgttccggatcatccccccgggagcacgatgcattttgaccgtttctgctggaagaccggtcagagatttttcagtgtcctctttttgctggttcgtgacacgtacctcattggagagagcaaggagtgcatcagagaaatccgtttcgttcgcaagaccctttgcggcaagaatgctgccacgatcttcttccgcgatggagtctgaccgcgacactgccgctgacacgccggttgagagccgtctggcaggctcctttgcctcaaccactttttcttctgctgaggctctccgatgagaatctcttctctcagccctgaccttggcggtgacagatccacgcggtgcgccaggactggtcggcgcacccggaaacaaacttttccggatgtcgtacattgctgccgttctttagaaaggctctgtggtcaaacaagcctgtcgccccctgcaggttcacctcagaagccgcgcggtgacgctctgccctcgaatcacgccgtcctcacagatcatcgtttcgttcgcgtttcgcggaagtctctcgcggttatgaaaaaacaaagtcatcccaatcccggaagttcacccaaataggcggccgctgcgcacacgcaggaaagaaataagacgatcggttgcagaaagaaagtggctccttgaacttcctaaacatcgtcaccgtatgatgacttgagtgtgaacctcaggaagcgtggtcgataaaaaacacgaaccaaatatatttggattgtccgcatgctggtgcggaacccttttgcctacggagccccttatgagctcgtcagcacgcatgtgtcagaaactggatttccatcagaagagtaaaggaagcgaggcgattgtccagtgaaaaaggcacaacgagaagagccagacgacgataaactgctgccaggccacgatgaagagccaccggcgcaaggaagcacggaagggcaacggtagacgaaacgagtcgctccgcataaaactgtggaatctagtacagatgagaaccgggaaggttccgaggggatagagacgtacaagaaaaacggggaaagccagaaagtcctcaagaatgcagaaagaacagccacagacatcggagtctacgttcacggaagcgtgtgaacgttccgtttctcttcttcagttctccgcacattcctcctggatccgttacttatgactcagcagaattgctctcttcacaacactccagcatagtcaagctgaaggcattcctttgtgaaaatgcaaaaacagacttgcaaggccaccggctcctggtggcgtgtctacgctttctcagcccagttacgagagttgtcctgatggcacgtcggaggttgtgagtaagggaattattcactggcaatctattagtgacacggacaaaggcagggtagagcaacagaaatatctcgtccgattccacggaaaatacactacactgatggaagactgcactcgtagacaatatgaacgggcctacacaactcggtcgcagaggacttctacatccttcacgagaactcacgagagcatatcgaggataaaaggagcccatggaaatcacaaacacaaaccaaactcttcgaccacgttctctgtcgttagcgaaagactgtccggtgagtacgcgcggcgttcgttcccagtccacttttcgtgaaattttacgggcagttcctttcggcaacacacaaagaaacactctgcgttctttggaaacaggacgaaagagagaaacacgttctctgtacacaccaggctcaaggccttggtcaccggcgacgtcgatgcattctcagctagttgcggagactttttgaggctcaacttctggatctgggagaggtgcttgccgtctcgaatcgacgaggttgacttttaatcctctagcggctgcaaaaatcaacgtttctcatggcaagggcgttagcgctgtgcctgaccctccttttttcccttcagctgcgtggctccagacaatgcgcagcttttgaagagagcttggcggcgaccacaaagagttccggcttacatgcgagtaatgagtcccaggacagaagcgcatcgaggcgctgaaacgcacgtcgctaccgcttgttggacattgggatagtccctcgaacccacattttctgaccctgtcgtatttaatacgttttccttgtttcatccctaagcatgcagatcagcacaaggaggttgctgctctgggtttgctggcgaaaaagttgactttggtttcttccccgtgtgccgttgcacaaactccgtttccagctggtcgctcggtcccgacttcgattcatcccgagacggtgtacagagcgaggctcctgatctcagccagtgaacagcacacagcacggatgcacggaaagggcagcgtgttgtgctggttctttatcataacagcaagtttcacgggctttgatagcacatcagaactttagagagccgagaagaaggcacaagtatcctcttcttcggtctttcggtcccgtcgtctccgttgaaaccgagacaagaagactggactcgtaggacggcctcgccgatattctgtcgattctagtgacttccacgtccctcctgcgttttctccctcgctgactttcttgtttgattgtcccccgtagacgctgtttagccctgtttttttggcgcggttaaaagttcttgggttgcggccgtcccgacataaggccgcccggcatctgtgcgtgaccttgacatgccgaggctcccatttattgcttgcctaaccgtttttcacattgtttttcggtaaaaa

SEQ ID NO: 3961 - DNA, 2289 bp, Toxoplasma gondii
ggaacgaggaggaagagaaggcaagaagacaacttgaggaagaagaaaaggaagagaaaaccgagagagactgatgagagacaggctcgtggctggggggtccggaccggggtcggccggtaatgctcggttccctgaagtgcgggcatcgtgctggcttccggaaaacatgtctgacaagcgaagatgatgacggagaacggagaagtcgaaacgcggcagatgaatcggacgagcggcggtgagagaatggagaggttgcccaggcggacggcgagcaccgtcgcggcgtcgccatcgccgagggaaaagagaggagacgcacacacagagagagagagtgactgcggtacaagacgaattgacgccggcgcaagagaggaagaaagagacgggtggccaagagaggatgcgcgccagagataaagggaggcgcatccccgaagtacgaacgagggaatacgactgatgaaaaataaaacagacggagagaaagagagaaggagacaggacacacaggcgacgaggcgctaagataaagggactatggagacagaaaagagagcagacactggtgtgcgagactcagaaggaagacaaggcacagaagagggagaaaaggaggggcgcaacgggaagacgcgcctagaagaaacgcgaggaggtgagaatgaatgcagacaacaagagaggcaaacaaagcaactgaacttgtgaaggcgaagaggaacggagaagacggcaaaagagagaggagggaacgggaagtctttaatgagactcaacaagagttgaaagaaattcaattgcgaggcgtttagacgcagaagagctgagttctctccctggaagcaaggttgaggttcaccctcgtaattcacctaagaggagagacccgcaggggagaggtgaaaacaaccgactgctgctgaaaagagcaatcctttcactcctcctcaggcagaaaagcttggggaagcctctgccttgtgccgccacttggactcggaaagtttctccaccattcaatgcgaagtgaaaagaagacgcagtgtcttctgactcgagagcaaccttcatggggcgacactcgagatcattgggaacgaggcctgtgttccttccttcgcaggagatgcagatttccttttcttggtgcaagaaagaagcattttgttctctgttgactccaggagcgagaggcaaagagtctgtgcgacgagactcgctcgacagaaactgtccagttgacgttggattgttggtacactcgaagcccccgggggaggaaagcccagagcgcgactgagaagcagagacaccggagagaaaaaggggatttcgtttcgtttcttgcgccgaggagaggaaattcggcaggacagagaccgcgcgcggctctagagaagttgacagcgacacagcagccttcgttgccgcgcaactgccgagcaaagtctgtgggcgagcgaagaaaagcacagaggcaggagacacagggcgacttgttgctgcgaatcggcgcgagtgtactagcaaacgtccgagtacagcgttgctccgtttcgtctcctggaaaaatgctccatctctgaatatcctgcacagaggaatgtcaaaaaaatcactgccttaagcgcctcttggagtgcatttccacctgacgtctcacgctgagcacagagagacagctgttctgtctgcatctgtcgcccatgtcgtttgaatcgatttttcgcggccgttcttctcgacgacgctgtcccacgcgttcgacgtcgggggtcaacggttgatctgtcgtcgattctgtgttttcttcctcgttgagtccttttcttacatctcttttcttgcctctcctgcactatctctgttttcataggcttcctcaacccaatttggagtctccacgacgcctctgcagctgccgtgcgtcttttctcacccgcaactacagcaggtgccctatcgaccgcgacttttggagtctagcgtcgctggtcttctcgttcgcgccattttttgtgtctttcacttccccttccttcctcttcgtttacttctgttttcggagaccccgtaggtttttcttctctccctcgaggagcttccatcgctgcgtgatcctcatcaacttcctcgtctgaccaggttgcgttcttccttggcaatctttctcggcttgctacttcgccaatcatctctggggcaagctgaggactcgcggatccctcagtggacgaacaaacaaggactcgacttcttgcttctgagtctgaggaaaga

SEQ ID NO: 3962 - DNA, 2517 bp, Toxoplasma gondii
gttttactcacagcaagaacgctttcgaggcacaaaggtttgaaacacacgagatcattcttaggctctcccattttcgacgcagctcagtcaccccggggacccgacatgatcagtcaaccgaactcctgtacagcgtgacactgcgctatccgcctccgcagcctccacgtgtatgtttcagcactggcttctgaaaactaagtaaactagtacgtaccggtaacgaaggcgtacgcggcaatctagttgaactggtacgacacaccactgacattagaagttgcggcacacactcgtttccccgaggcaaaagagttacaaataccgttgcggcaccggtacagcagccacagttaaccagtcgcggttttcgtagcgtcacagtcccgaggaacaagaccatgccaaaggaaggcggagcacatgcgttatttgggaccttctacaaaggggagaggatttgaggaagtaaatgcagcccctgcagaactgtccgcaagggccgatttttgccgctctccgcttaccgggaacagttacggatcggacgggcgttctaacatagatagcctccgagggagagctgagcgtcagaagaagttgatttttaaacggattcgcgcctccggctgctgtagcaaagtgacgagagggcagaacgaacgcgttccaccctcgctggggagccggagcggcaaggctcgcgaagcgggagaaggcccgggcaaacattttaagtggcaaacgtgatggagacgaaacagacacggccacgagaaagccccacgaagactccctttacggagaaaatgtcgttctgacggagcggaaacagttatggcccacaaacatcagccgacggcgcccggttgcgtgcctgtaaacttgggggagtttgcagagtgtccttttccaacacgggcgcactggattttaacacatgctggctctggtttctggggataagtccatctgtgctgaattcagagatgaaacacagaaaatgcgtcagggacgagaattcacagtgtgtaccggaggactgcctggaaaacaacgggaggggaagggtgaatggactcgaaaggcgacgtctgcgtatcacgcgggaagccggcctaaacaaactgaaaaaaagacttgatttgtttcgccgggaccatgaaaacgatatcctgctgggcgaacccatcgaaaaatcggcggacaaaaaggcaacaatacgcgcatgcagtccccggtggtcgtcgttcggcgtgaccccccgtgtttcgtcagaaggcagccacagcctatctggagacactgggacggagacagggctacctccgaataccctgtacgtctagcagcgaacagcacactcgagaacgaagtagttttccgtttttgctctgaatctcaacgagcgatgtaagtttacacttgcactcatctccataatctaggaggccggtcgacataacggacgaacggctgggttggcttctccctccacggagacaaatcaacccagagtggcacttcactgtgtctctgtctcgctctctgcagtccccggtgattgccctctcgacactccgtaaagaaaagtcgcttgccacgaagatcccctacaaaaaggtgcccgtgtacgttgttttaatacactgaaatgaaagttcatggtatcgttcaggggctataaggaagattcgggtttgctgtatccgcagcatctacacacgttttcacaacgtgcggtcaccgaagccggcgatcgggaaaacacatgctgtgactttagtgaaataaatggcagtcaatcgcgaggtagccaatgcgcctttgttctgcccgttattgttgtcttgaggtgtatgtacacaccgcggcgtgagcccctgacaaattccgccgttggatcgaggggtcacagacactccaaaactacttttcttgagttttgttcggacactccgggaagcatcatgccagttgtcgctctgtcctctcaaaaggttgtcccgctggtctttgtctccctgaagccggcaacacttgccagtctagccgttgatgcttggggcttgtccgcatccctgctggtgacggcacgtcgaagttagttaccggcattttgtccgctcgtcttcagtgtcgccatgagcaacgacccttggccagtttattttgtttctggattaacagcatcccgggcatactcttgtcctgtccgcaccgccgccaccgccaaggggtcttcctgttaacacagcctttgatcgtttgtcgtccttgccacgagccaatttcctctgagttccacaatcgttcacacgttctttccgttcatctgtgtgtgccttttcggtgcattttgtccaatacaatcgtttgtatgctgcggctcgtgccatcacacaagacagcgtacagtccattttgtcgcagtgtccgtagcgtcgcggcgctgcttccatctccacttggcttctcccccagattattggggacgtttcggtgaccgcaaca

SEQ ID NO: 3963 - DNA, 2139 bp, Toxoplasma gondii
gtatctacgtagctcactgcccagcttcaggattaggccaaaagagttcactaacgacactgagaaatagatcgcgtaagtgcctggaaaacgacttccgaagcacccgcacttgcagatgcatgtccggtcaggactgaacgtagtaacaacgtggagcaatgcagaaaaggcagcttccctcctcgacaccgactccgagcaagcaacatgtcgcgaaagggcctgtttcggaggacttcccaggggtttccgacggaggactaccaattacccattgctcaatacacttctttgcgtgttttttctgctaaccgtgcaaagaacagcgctgctccaaggtgaggaaaagccgttggcttgaagcctttgtttgtccggacttgtccacggctgcccacacgaaagtgcagggtgctccacactcgctgagacacgcgactatagagggaccgcagaacccccatgtttttttccctgcatgtgcttgtgagactttggagaggaaaaaggttaggagacactgtccaccaagaacttgacgcaaagaagttcagcaagaagcagacgcgcctcggcaaggcaaagccccagcgggcgagacccacagacgcgccgggaactgaccccgcaaaacgcgggacgtttgcagccagaaaagacgtcaaggtcgtcttctttttctgttctgctggaaaaataggctggtttcaaagtggtgagcagatgacacgtgtgccgaagggagagaaaacgaaacggagaatgtctcaagggagaatgaagcctacgcgtgatggatgctcggccaacacccggcaacaggacggggagagagacgattcagaagacctgaaaaaggcaagagaatgcgcgacaaactcaagcgaaaccggctgaaaggctcaccacgaaaccaaactctcgaaagcacaccgacgaaaaacggcgtactcaagacatggggaggcgagcaggagagaggagagaaaagtcgggcctcagaaaaccgaaggcgatacgaaagcatctgtgaaggaagacgcaacaaagcgatatcgttttcactagaagagcagaaaggggcacccagatgcgctactctgtgcgccggtttcagagaacaggcaggagatgaacaaaaccgttacacctgtttgtagagagaacgagaaacagggaatggcggcgtctctccctcgcgaccaggaaaaaactcttccgacggggaaaacgcctcactgattcctttcaaagacatcatgaactctggctcgaagttccacactgcactcttgacagcattcatttcgttcacatgcccaagcagccgtctctgcatgcacactcgagatgataacgtctcgtggaagcctgtgcccttctcttcagtctttgtcaaggtgaaacacaggtcgccgtccgaaaaaacttgatgctttcttctttctgctttttctccctttctcggctctgctcgtccacagctctgcgtcctcagaggggagccaccttgtctccagcgggtttcgttctcagccccggaacgccgtcgttcatttgccacttgttccgctcttctgagtctttcctttctaccttgctcgcatttgtgtggcttctcccccagttttccggcgtcttgtggctcctcccttctgggacgcctcccaggcctcctttcgaactcgacaaatccacctgtgccagcacagctgtccgtccacccatgtgcagaaacacccagagtgcagtttgcgtctgaacagctgtcgactcgaggctaagccttctgcaggtggagtacgcagagtaaacaaaaaactgctgttaaactcgaaagtcaaacgtatttacgtcgtcactgtggacgtttcgatgagaaactcgccaagtgcacgaaccgttttagaggggaaattttcttcgctgccgcaagaaaaactacagaccaggactcgggtgcatctgtttctcgtgtgtactatctcagggaggtgacagacggggagatgagggcttgtccccttgttccttcccttccacttcgttttccttccgcgtctgtcgccttgctctctccgtgagaagcaggtgctctttcttcttcttcttcccctctgtgtgacgactgaacca

SEQ ID NO: 3964 - DNA, 981 bp, Toxoplasma gondii
ggttttcttcacacccgttggagtgaatgtgtactcagtgacgtcgtccaacacctgaacagacacgacagcgacacacactctctcgacatcatagccagcacgattgggcggccgttatcaggtttgctgcggccgcagacggcatgctgacaacggcgactgcacttcgattcgcgtaaaggcttctccgatccgaagagcagtgaaaaaagcaactcttcaggcagccggtctaaaaagaaaccgccgcaacagtgacatctgaaatgcggaacagttattgaaaggcgttcgtactccggctgtttctacaccgcggcttcacagaatgggtgtcgagaattgtgccacaagttaggcggtggaaaacaccgcgtgaaagttggaaaagaagcaatacagacgtaccatgttgacgaagtcatcgaaacctcggagggtcccggctaactccttgtcacctttcatgataatccacatccgacttccgatacacttgtccaccagggcgagaggcaagtagctcggacctccgctgacaacgccactcgttgccggggccgacgtcgctttgggggcagctgcgctcatcgtgaaatagatcagttcctcagaaagcgaatggtatggtgtgacgggatggaaagcagatggtggttccaccaaaaagactgtccttcatatgcgctctcgcgttgttttgaagtctggaggccagtttgaaggaacaaaaaatcgacagattccgctcaagactgggcaagttgatagggtccctgtcggttgaaataaaaggcttgccacagtcggagtgacagcttctctctgtcactgcggttttctgcgattcaactggacaggctgcctttcgctttcacggcaggctcaaaagaaagtcgcgacctttcgaatgagttggccaatccgagttcggcgcagaaccgctgaaaacgcgacccctggtggttttttcttcaa

SEQ ID NO: 3965 - DNA, 2401 bp, Toxoplasma gondii
gcaactgccattcgaagggaaaggcgtcctttcgttggccgataaagcagtcaggaagaccgtgacttttttcttaggagtttccccttcttttccgcgggaatgacacggcaagtctttttaaggcttcatctcaaattctgtctacgtagtcatgccgagctgtcttcggtggtcagtctagggttttagcctcttgcgaactgtgtcttcagcgaccctaaggccttgcgacatgctacggatcgagaccctgatcagctgggcaaattttctgttttataatttggagaagcgacaagaagcgttggcatcggcccgcgagacactccaggaagccattgctcaactcgaaacggtgcctgaagagcatttcgctgaagttgtcgaggcgttgcaaattctcatgaaaagcgtgtggcgatggaaccaagaaagtcggaaagacgccatgtacgactggtggtcaagtttgtgaaagcttgattttgaatcgaatcagctgaagcgacagtaacttgtcgcagattttcgggtatttccccagatttttgagcagggtttgcgaccccgtcggtgggttacacagggatgggggagcgactttataccgacctgtttgggggttccaaagtcgtcttaccaagaactaatgcgatctcttatttcctcgcatcactttaagaagggatgtctaaaaacaacagacctaggcagggttcagattttttggaatgacacctcatgaatctgttcatgacgacccgttgacgtgcatgacgcagagtgacagcatcgtccatttgagaaacgaacacttgcacacaaggtgtttctcaatgattttaacacacgccaacaacagagacgctttcatcaaggaaactctacttgtaaaaaaattcacaacaggacacgcttcgatctgtgccgtcactttaccggctactcccgcgtaagtcggctctgtgttacgcgccgctgccttctgttttgaagccactattcccctccctaggaatctcgatgcccagtttgattgagggcgccacacggagaaccctctttttcatttttgtcggggtcgattcgatcgaaggaaagctcactaagtgactccgcaaccgcgtgtcgtcgttcgtcgctctgcatgcaaagaatgccgctctagtcccgaagtcgattttctcgcttcctcccttgtgtcgatgaccacacgcgcactttcctcgcggatctgtcgaagttttctcttgactttgtgcgtgcggtttttctgccgttcaacgaacccacaagggaatcttgccgctagactttgaggctgaagtgcgattgctgccacggaacgccgtgtaataatagcgtgccgagggactgaggggcactctgaaacgtttctttgtggcctctgcgacgtcttccgcctcgatttctaactgtttctctacagttttgtagtttatcactccaacatccagacgccacaccgggaaagagtgtgggggtgcactacgtttgaggtaggttccgcgtttcaccgaagttccggtggctagcgccgtttctcggcgtcaccccgtcacgcatcgcacgatagagtcctcccttttttgcagcgggcatgtagcttgtggatttttctctcgttttcgcttctggtcacgagattcccggtttgctggttcgcgagatcctgacgtcgccgggatgcgccgcgttcgtacacttcgccggcgcatttctcgccgtcgacaagaaagcgcgttctggtcgcagagacagcgttgaaaaggagagatggcgaggttgagagattcgcatgcagcaccggaaacgcagtttactcatgaccgacctacaaccgtggtgtcttggtcgcatgaacgacaaagcttggcagctggcccgcagccgcctttctcgcagtcgccgcggatggcgcgaattccacatgtcgatcgcccgtgttccccgccataaaaaattgctacgattgtcaccatttgttttctgaacatttgaagcctcactgcaagcaaccacgcacgcatctttgttcccctgcgccgctgctgccgcgtcgacttcgttgagggactccgaaaaagtcccgtcgagtagctttagatcgtagcatttccgccgcatcctgagtcctttcggactcttgaggaccctatgggaacacagtctgctcgggggtttgcatgtttggacgggcgccgaatgattttaaagtgtcagtagagaaaactccaccacagcaaagcgttctcccgcccccgacttgttttcctttcgctcttcctcccacatgctatccgctgtctgtccgtgctgtctgtgctctctttgctgtcttttgcgtgtttcaggtggttttctcgctgtcagcgca

SEQ ID NO: 3966 - DNA, 1795 bp, Toxoplasma gondii
cttctcactaactacagactagtgttgcgtgaacgtttgagagtcagaaccgaaaacgcaaatctgtacgtacatggttttggaaacttgcacacttacgcatacgcagttcctttctttatactcgctagatctgcgtgaagggtgttctcgtgtttttgtgtctctgatcactcttgtttcctgtgtgcctcgagctcgctgaacagtttggtccatgaatcagatctccgagtacgaacaatatgatcatgctagacacatatgaactaggcgcgccggtccttcagcaacaatcgatacacaactgcagaagaataattatatcgctttcgatgcacgctttgttgtggctagatcacttcacagtgagacacgtgaatgtggtgctgtacggaagtgtccgtttcaaggaactcctatgtgttagggcagaatgctcttttcaagaagaccgagaaaatgagttcagagggccctgttacgcaaatctggaaaatcgtataatccgccatcacgaataactcgcttctacacgatttgaccagctactggatttcgatcaggctctccgatttcaggatcgaagtgtgcgttgttgccgtgtgtcggattacaactgccatccgacagtcatgtctgccactgactaaaggggctcttgggacgacattaccgtccacttcttttcttcgtgttgtgcagtgcaccagactaccgatacccgcatatggaaaagcgaagatgagcaacaacgaaatgctataattacaactgggaagcgagtgttccctaacaatccgagcgtgcaacgtgggatggacttcttgccccactactgaccgtctatacaagctctatgtcacggctcaaatctatattcacagtgcattcctgttttattcccaccgttgcttggcagtgtaattgaggctctagagcaaagacaccactggtgaagaaccctgtgtcagtcgaaggtgaccagtaaagagacaagaaatcaaaggcaacgcgcagagcggaactcagtgggctttaggataaatcagtgtcatcatgcagcgtagccgtagtggaacccagcaagacgccaggtcatgggataccacagccgttggggctactttccagaagtcttatgaggaaacagataagacaggtttcgactgttagtctcccctctcacgagggcatatcggtactcactgcagggatgtgattttgtgagggcaatgctgtttcacacttgacgagttttgttaatacaagctcacctagtatccaagttttcggcttgtagacggtccggggatcgcgcatgcagtttttcgctgattgtcggccaagtcgacgacaacgacatacgcccccgttgtttcccgtttccgtttcctttgtgtggctttaattatctccctgtggatctttcgcggacctcagaaagcacatacgctgtcgtcgaggctcgagacgctaccccgagttttctctcctggacggagaagcgtttctgttgcgcacggggacttcggttttccttccagtaggctccaagccttttttctgtcccatttcttgaacccttttctgagagacccgccattttccgtgagtttggaagtactagattttatttcgaccgttcgtctggacgccgcggtggaccaccgatccttgtagagtcgacaggagttttccctatagggactccaaggaaaagcgtgtacccttggggtgatcaaactgcaccacagtgtctcccttgctgccacgtctctcctaattggcaaaa

SEQ ID NO: 3967 - DNA, 2497 bp, Toxoplasma gondii
ggtgaagttgctcaaacaggtggaggagaagcttcaaatcgatcattcagcgtggcagggagacgccatgttatatggtactgtgtcattgtgcgtgccgggtctgtaggatgaatgttcggacaaattttctgccagacggtgcgtgatgcaccgcagctgcatcagaagcgtttcattttcgcaattgcacgcatcagtacagcgtttgtattctgtagcgataaaatgggattcttcacgttgctgtgtgcgagaactttgatggttacaagacggacaaatgacggtgtctgaccgtcgtgttagtcaaatctagaccgcagcgaaaaagcgggcacggactcttaagcgccccaaaagaagttctgccgcaacatgctgaggatgccagcggcaaaagcttattaatgatagctttctcgtcgtcgccttctgcgacactacactgagctcgagcccaggcgtcgatccggcagtgcagatttgccttctctttgttttcttgtcaatctcgcgtgaaaattgtgtttccaggagacgcaaaaaaagttgcgacaaaaatccatgttgtgtagccttcagctccccgctagtagcatgtgttacctgtctcgggctgacttaaatcggctgccacttcatcaagccaaagtgaaacaggcacaagccgccttcagcttcatagtctgtttcgtaaagcaccagggacaggtagattattagctcggttttagacaagtttcagactattcaatgtacgtatctttgagaatggaaggctaagtcttgcgcgacagttggtcacctactagactgttgaatgctctacagaagcaaggaaaagatgctgcttgctgatgaaaggagagttgcagaggagaatttttcgatagtgtaccagaaagatggaggataagtacagcagctcttccatgaatgcacgactgtggtcgtcggcgtagcacagaccagtttttctattctgttgcagccttcaataagctgctcggtaatgctgtgaagcaattcagcatattgccgatgcttttcctctgacttgtatgggtaatacgaactcgtctgaattccattatgggtaactgaaggtattccactcaaagtgcgtgaagctcggtagctacgcttcgtcggagcgtgcgaagaaattctcttcgacatagaagggggtgtgagagggcagccacgcattagcaatgcatttggcctccaaagccatggtttgaaggcagctgactcaaaaatctgtcggggtgctgttacaaaggctgcacatctgttgtcgccgaaaaacgactgtacatccggtgaactcggcgcgcagcgttggcccaccttagtttctctgtgatgaccacccagtcgacatacttagatgcaaatgttcgaaaaataaatggtattcttcgcgtgcattttactgattaccgtcatttcacaaggcactctgtaaaaacggccaaagcggacgtgccattacagcgactatcgaatttggtgcatgcacgatcaggggatgtacgtgcttccccgaacttgcgcgcctggcgtccgcccaatattctaggaaaaatgccgtacggagttcggttgtctgcacctccctaaaaaatctgcatgtacgggggggggctttgggccagctcatgagttcatgaagccaattcgcattttcctttttcacggagatagcagaattccacgaatttgtacgcttccttccccccgttatttacttgtaggagcttgcctgcagcgtcaagttctcacacagggcgttccggaaagcgcccatgtccacgttcctttctttctgccagcgttgctgccagtgctgtgccttcgcgttcggacgtggatccggtcttgtctccagaatatgttgtggtgttctatatgttctctgcgttcgtgaaccgccactctgtcggtgcgtacccgccctcactgatgtttctgtcctgcgtgaagcctctagcaacattgcgtcaagaaacgtaattccgtgtcggcatgttcggaaagagttcactgttttctttgcgttcctttcgacgtgctgcgacgcagcctgagagcgaggccggctaggtctgtccagaattatcatcagtcaagcgccctgatcaaaacaaacaagttctgtggcgcgctaaaaactggttgcgttcgctgcgcgtcacagggcctctggtgcaattccgtattttctgctgtggcatctacacaacaaagtgttcccctccgccctggtgtgccgctgtgtatatacaccgcgccttcgccatttgagacgtccgctttcaagggatgccggatcttccgaagttggccggttgaattcgccacttcttgccagcaaaaaaccggaaatttgcacgccacacagcttgttgtagtcgcgccaccagggctaacggtcgctcgctttttagagcgtctttttttgcacggaagcggctctaaatcaacaaga

SEQ ID NO: 3968 - DNA, 2063 bp, Toxoplasma gondii
cctaccggccatacttctggaattcccagtcggcgttgtccaggggacagacctgccgcgtcttgagccatcgcgagatgcagtggaagtggaaagcgtggttgcacacgccccaagcaactgtgcactcttccgaactcgagcctccctgggacgcaagaagaaataagaaacggatggcatacagtaggcacacgccttacatacagcccaagggtgatttgcttacgataccgtacttgctgtcgcgagggaagctattccacaactttgttcatctggtatacccatgctggagcaggggttcacacacggcgacaggaaagacaattgaaaagaggaaaactaagtttcctgctaccttttgtgtctgtcaatatgtgaaacacacactgagctgtaagccgcaagtgtctggtcctgagtggaggacaagcagaggcagtcgattcgcaaagcccacaaatatccctctgttctggtgtgtctcaaagtccgctgcataaactgaagctactgtgcgtggctaccgggtagcttggcgaccgtggatattactgtccacggtcataagaaaatgcagttgcaaatggccggggctatcacaagcgctacaccctttctttcttccaccagtatctccacagtttgataaacaccctgtgttgtcccaaagtatgcgcatattccagtccacatcaccgtttaagtgaaaaacgaggacaggatgcgctctacgacctcgagggtggatcctcgctctggacaagtatcaaagttttttcaagacggaaaaaaacgcaacaagacagcagccttcaacacgtaagagccaagtgagagtggcagacactaggcagttgcgttttttcgtttggcttctttcaagctcttttttacctgccatgccaacgcacctgactcgcctggcactcgatacacaagtccatgatgtgatttcggcaaatcgcacagttgtcgacgacgatgtcccaggaccaaagggcgacggcagaccactttttaacttcgaatctccgaacaggaacctcagaagagcttgcttctgcggcggcggcgccactaccactactagaggcagaggggggcggtgcactgacgtccattggagaagttgggtcttctgctcccgacatggtggcaacgcgttggtgtcaaagaaacaataccccgacgagggcgcactttacagacgggatagtgtgggaaaaagccgcgcttcccgacacaccagggagctgaatatctactcgacagacggttcagttcggcggcaggcctcgatatcccggagacgaaaaaagagatccggaacacgagtgtgtatgtgtgtgctgggcagccagacaaacatctccaaataggcaacccctgaagagcgcaggagaaatggaccgctggaaaagacgttcttctggtgacgacttgcccggcacaaaaagaatgccttccttgcgattcgcgactcgcgccgcatgcacgccagcgtgaatgccagccaatctgcgttttgctgggtaaggtcaaaactcgaaaagcagggagactcaaaagcccacgaggtgccctggcatctgcagtagtggaggacacggttttttctcatttgactagagtgagtttcacccacacaagtcgcctatcctacagagccgcctgtacgtacagccgaccagctcaccatcccgtttccctgtgaacgaagtgtaggcttggcagatgaactgcagacggcgactatccccacgaacaagcattaagacatttctgcacagtgttgtgaagactgttcaaaggtccattcgtcttgtcccgaagacgacggtgtgctcgtgcaccaagacataaaacgaggcacacacggactgatgctgcagcaaaatcgcggtccaaagagttgccaccgacgctgccaggtttctctcgccgacagctcctggaatgttttatccgtaaaacccgactgtcaagcctcggaaaactgctcttatgaacactgcccgcgcctttacagccgtcattttgccggacagtcctcaaaa

SEQ ID NO: 3969 - DNA, 2962 bp, Toxoplasma gondii
agagactgaagagggcggcttcggtattcttcctcgcgacgaaagagggccgcgcagccgacgaggtttggaccgagaaggccatgccgcggcgtacgaccgcgcggactccgaagtcggcgggggtctcgcgtccgcggcgggtgggcgccggagaccagacgagcgggggtcgtaccacagtggcgatcgaggacgagaaaacgaaagacgcgacgaagagtacacgagtccccagatgaccgcttgtgactacctgccgcggcgtcgaggcgaggaaggcgctgtgctcgcgggatctttcgggggatccgcagggccttacgccggggcaggccccgaggagagacaggggcgacgccggtctcggtcccccggtggcggaccgtactttgtggggtatggaggctactccacgcggacatcttcggcgcaaaacgcgccttctgcccacatctacgcagagcggagcggcgagagagacaggcgacgcagagagagagaggatgaggcgctcgggcgagaggcgggccgcgaggaaggtcgagaggagatggcgaggagaaaggacgaggacagatgccgcacaactgcagtcggccgcagagatcgaaccgactacgccggacgcggggaggaagagcggagagaagtggaagcgacggggtacgagcagaggcatcgcggctaccgaacggcgcgagatgaccgcgtctagaagagaaataggaagacggagagttctaggggggaaagcgaacggaaaggagagttccgccgagagacggcgtagggaagaacgaatgagggggagaacaacagggacgacagcgtccgggggaaggagtgtcttgggttttcgagacattgccgcgattaggtggacgaatcagttttttctcaaagcactcggggaagctctgtactgcctttcctgcgattttttcgataaaagaactgtgatcttccgttgcgtgtgtcttctctccgagagagctgcttgcacaggggaaggcgcggcttccatagagcgtcgtggatgcccttccgtgttgtagcctaaagagctcgcgattcccccatgcagttccccagagaatttttttgactttctccacgatagagtggaaagcaacgattgctgtgtctttcttttcttcgatacgtttttgcttggctagcagaaagactccctgtcgggtcgagagacagtctgcacggaaacgcagagaagaatggaagccgcggcactggtcccaaactgaagttgcagaggtgtaggggtacttctttctcagcggatgcgtaggtctgcctgcacaacacagggatttttcttttctcgagtcgcacgttctggcgaagtatcaacgcgcagcatgcggtttagagctgagaaagcgtcttgcggccgtctcggctggcgtccacgcggtttcgagcacctcacagtgccttcggggctgtccttttctgttcttgcaaaatgtctgtgcgggtgtacgagggcattgcgtagcttgcactctcgtcgcttggcattcttccgcttccatggcagcggcgcctcgcggaaatgtcaagaacggcgcagcgtatgatcaacttcagcgtcccgtttgctagacggcaagtcagggggtcctccaaaagctggaggggagtacgaacgagcggcttgtctcgcgcaaaagatccacggattgtcctgcctgtgcgtctacgaacgctggttgtcgaaaacacccgtcacgagcgacggtcgagaaagtgcagggataactgtcagaccacgttgaggtggaaaagaaacgtttcacgtgttgacaacttcctagcgatgtctcgatgcggcggtgggacagccttcgtgaatttgacgtccggcgtaactcaatttgccttggttgcaaagtgtcgttaagactgcctccatttcttttgcctctacttcgcattcaaactttacggtctcgcttacttagattcgttgtaggaggaaagcagggaatcgagcctttgatgtaaaatcgaatcatgcagcaaactcgcagattggtacttcattcgtcccagaacgcgcagggggatgcgttgccgtttgaaactcgaagagtgggtgtccactgtgattccgacaagacacaagagatcgtggggtcgtcgatgacctcttcgtcgcgttccgcttcttcaaaagatactttttataagcgacgacgagactcttcactgccggtagcgggcagaccggttcgaccgtcgtgccagatgccagtcgcaggggacaaagttcgtgcttgattcgagctgcgtgattgccggagccgcgtttttatggaccctttttagcgtttgttcgagtgctagactcctgaaacagagcattttacgcaaagtctgtgaccgtcgcttattactgtgagagtagagcaaagttacgagggatgtcctgcctgagccacgaaacctctgcgtccacgtctgaagcgcgtaatcccacgtacataagtgaggcttttaccctttcacagacgccgtcgtccggcttgcctgatttttacgctaccgtcttgaaggctctggcacagaagggcacacacgcccttgttcctggacttgtgcactttccaccgtgaaccaaagaccacgaggctcagttcaaagctccaacgaaccttctcgctcttaatgaagagtctctttgtggccttcaccggatcaaatgctgtttcttcgacgtgtaacgtcaaacctgtccgcggcgaacttcactaggtgacaggggggatagacaggagataagcagccccacaagaatccgtcagtatcagaatgtgcgtcgtcgcttgcaacttcccctctaacccgagattcgtgtggaataatcaacttgaaaggccctgcaataaagaaccgcaatcgagcaaaattaaccatcaaactccccacacagccccca

SEQ ID NO: 3970 - DNA, 2745 bp, Toxoplasma gondii
gacggcaggactgctactcgactccacaggtgtaacctgacggctacagacgccttgcaggcgcttctcgtgaggcgtctgaacgtagaggtcgtgtgtcttgtccatgcgtctctcctgcaagccaaacgagaagttgggtcgtcgccagctggtctgctgcgcgccggcagaagcgagcgaacgcgtaggcaacgagcaggaagtgagtgggggagaagacgacgaacggttcccgagagagagcgttcgcgtccgcactcgggaagcgtggaaggcgccggggggttgacgaagacatgcgaaaagttccggaaaaacgaacggtgcagaggacagggccgaagaagaagaagtgacagagagagaccgagggaagcgataggcgagggaactggaagagccgtcgagacgtcgtggaccgccgacgcggcctagaaaagccattttcgcagctcagcgttccgagagcgggcaagagccgaaggataacagtcgtctgtagctcctcgtgacagtctcacgcacctggcggccgcgcttgagcgacgctgagaaatcgagacgcagacacgctcactcccgcatccccagcgactttggaaaacggagtcagacctcaacggggacgcggtcgatgcctccgtcgaacgttccagtttgtgcgttccaaatccaagaggcgtcgtgtttttgacgaccgcgtcgggtcgcggtgagccagcgaactcacccggtctgccagagacgcagtcaggagaatccttcttggttcaccaagtggagttcgaggacgcagcagaggatcaggccgatccctgaggtctcagcttccagtgtcggttcttcgggtgtacaggcacacatccacggacgaggagtccgaagcgtctggcatggcgcttcagcttccaccttttttctattcattccccgcgttgctttttttttcgtccgtctctgccgacctgcttggagagtgtctgaccagagtggcaaatacggacggggcggtcggtgggtcggtcgtcggatcctgaaaaaatccagcagggtggcggcgagctgtcgcagtccggtgccgtctcggtttcgatcaatcatggagacattttggaagtccgttcctcacgactcacgcgaagcatttggtggcgttggaactgaggttggaactgagaaaagctgcgcagactgggggataaagcctttcacaagacgaagacagaactgtcgaaagagcaggaaaactcctagacaaggacgccgcgacactccacgcggcgagttccgtttgggagcacttcacctgggacttctgttgaagagttgtccagcacagcaacttagagccgcaagacgagaacggccctgacatgcgcgcaggaaacggagaagttaggggagcctttctttttgcggactccaggtagggaaacgcagcaaacgacagccagggaacacggagacgggaagacagagaggggtcacccaggcgagagacgcgcggctgaggaactcgatttgtctgctgaacgtcaatccctcaactggaattttcaaacaaaggacgtcaaagttgaagccgtagagaagctgtagcgaaatgacgaactccactggaagacgctgcttccaagcgcaacttgccagacccaccaaaagcctgccgcgggtgtagtagacacgcgtcgggtcagctgggcgcttctacgtaaccgattccaaactgagaaaaaaggaacttcccgtagaaaaaaggatacatatgtctccagaaccgccgctctccctgctcgacctttcacggtcttttgcccgacgttgcgcgggtcgtttgtctcgttctcagcgtttccgcttctggccgctggtggcgcacggtcctccgttccacggttcttgaaggtcctccttgaaagggaacgctgaaaagatcctttcttcgtcgtctggagaggcagatctccgcatgcctccgctttcgcttccttcccagcctgtccgcgatctccatccgtgtgtctgcagggacggcctcaacacactgtctccgggatttttccgcgactcccgcctctcgaccgtaagagctggcgtctcgcccggaaattcgcatgcaaagagtccggtgtgctgcgacctttctttttttcagaagtcaatttctcgattgcttctgccccttcttgctccgggtaggcaggtttaacgtttttctctccacgcaggtcatttctttgcctggagctggcaggcggcgggtgcgggatgtccgtccttggtcgttgtgccctcgtgcgtcgcgcgatgcgcgagggccagtcccttcttcccctgaacaaacaagactgtggaatctgttcgtttttcttgcagatgcttctcacgcagagttcggagtgtgtgtgtgaggtgccgacgagtcgtttcgcgctcttccactctctctgacgccgtgtctccccgtcctttcgactcgacgttttgtctccatgccctggtgtctctgccacagcttttctgaaaacctttcttcttcgcgtttcttctcttttcctcccgacgcttctgcgtctttcgtgtgagtcctcatccgctccatcttccgccgttctccccttcaacctcctgcctccgtttccagccttccacgcgaccgttctctccgcgtctttctcttcccctctcgcgccgctccatcaccttctccggatcaaaaagcttgtcttgttttctgaagaa

SEQ ID NO: 3971 - DNA, 3007 bp, Toxoplasma gondii
tgctaccatctcgcgaaagcgtttatagtgtttttccggtgttgcttggttaaatggaaagagagatgatttcgagttccgttcggtggcgacgtgcgggcgtgtgggcactgggattcctgttcaattgtggcgctaatcagaacgtgaagaaatcgagacagttgtttcttgtcttttttggactgtttcatcccgggagatttcttttctcgctccttgttacgaaacaacaatatcttgtgtggacccctcggcagtttttgctggcgggtcgctgctccacttcttgacacacgcagaacggtggaagtcaaatcgaatgcagacagttccgaacgtaggggcattttcacattcaaggtagatattgcctccgctatccaggactggataacaaatctagtgaacacgatgaaggacctaggagactgaaaatgactgcagtcgcgagttgcagaccccaatcctgcagtcgtctgttttcaagacagatgaaagtgttgtttttttacatcctacgacgttaaggttattccaaatcaattctgttctcgagacaatctgtatgaattcctgtaacaggttttaacatcgagaggaagcgactactcagatgctaggttgatcagtaccatcttacacagctgtgcacatttctcaggacgtttggaggatcaaacagggtaggcgttcagtttacagttgtatctctgattgggtctggaaagccactcacgtttttttgccctacttagctgtgcagaggggagagaaaaagtgtgagagacggagattcgtggtggtagcgtggcgtcaatcgcaggtggagtcacttgcacgttgtgggaccgtttttgctgacgtaaaagtgtatttctcgcaaaattcgtgggtgatgtatttttaagatgtcattttcagtgattcgaaggtaaaccgctacttaaaagcagcagataccgtagccgaatgcgaattctagggtttatttcttcgacactgcatactatatgaatggtcctcttgcacctccagagattaactgtgacagtggagaggcatttcgttgttttctttttttcatctttcactgtacggggctatcggtggcattttctctagagcaactgaggaggctggcgcgcatgttttcgcgtctagattggaaggcttcgtgtaaatcgaggaacgcgacgcaggctggcgtcagaaaaaagcgaggtgaaagcgtttcttcctcgtggaaattcccattgtttgcctttacgtgtttctcggctgagcgtgagcgcgcaaaggaaatgcaaacacgcttctccgtttctctttcaagtccagatctacgaaggggagagaacgacaggttcctgtcgtgtctctgtagggagaacgcaaatttccagtagcactgtagtaaaggcgagttttccacgaacgatttcgagtcagaaaaaaaggggctttttccagtttcggtgacttgcagtcgtcacactatagcgttggaaacctcatatcattgccgaaaatgtaccattcttcgcatatgcctattttggtgaatatttcactagccggccacacacactgtgatgaaagaatcgcaacatggcgcaaacgtcctgcttctcatgggtctgttagaggacttgccgctcctcttatcatgagtatccgtagttcttttacctggttaggtgtgcctttacaccttgtgcaagaggtgaagagtatatcttacatatacgttcgattctcttcacagcgttggtctaaaagcgctcggtggatatatttattctctcccaaactgttcacttgacagccaccacagctgggcaagatgcctacgcccgacggttatcctccttttgttggtaagagcccagaggaagcggttgaataaacctgtggtcaacctcgtagcatagacgccccagataaagcttttcagtcatcctatctcagaaaggatcgctcccaggacgatagtgctgttttgaattgtcgttttctctagctgtttctatacgaatgaccacagacaggaaggtattacgcgtgcaccccccgcgttttttgctcgtgtttctaccacaaaacacaaaatcgatttccttgtcatagaaagttcagaaatgtaagacggcctccacaccatgactgtcggtctttttcccatgttttctttgtgtgacatgtagaacaaatattagctttagtcagcgagttcgcatatgcaggtcgtggattctgtgaaacatagcactagttcgatgtgccgcttcgccgcagcgggagccactggcacacgaatcgtcgatggctcggttgtcctttcaagctttttcccccttccagttggctgtgtcttgcgctttcttcttttcgtttctgtttcttatggcggttcccttttcatttcggtggaggtgccgtgaaagccgcgtgtgcgctgtcttcgtaaagatccagttttttctctggtcacttgagtagcagatgttgaaatgtaccacactcactttttcttttgaacgtttttggtaccgcttttttgtcttctggaaacgaaagccgatcaagttcgactgcagtgtgtcgctatctgttttctcgatacttttccaccaaccgtgcactctgcgttgaaggctggtgtgcggcattttcacaggtacacaggagacagcgtctcttaagaaatttcccctttctaaaaccgcagataaaggtgtcccatttcttcccaagcagcagagaagagttttttcagcgagagaatctgcggaattgccgatatactctcggagttcgtgggtccccgaaacgaatcagtgttctcagctacagcagctgctatgcttaggggggtgtaccgtgtgcaaatcggagcccgtttcctttatccattcgccaccttgaagcccgatctgaagcgaaggatttgttcggcttttcttcactcgcatttcacgctccgaaaaagactggagaccaaaga

SEQ ID NO: 3972 - DNA, 4415 bp, Toxoplasma gondii
gcacacgagagggcaagagtaaacgaagatctaggaagaggtaatacagcgaaaaagaaataggaaggcgaactgttttctgctccaaataagtttcgtcgatcagagaacagggcaaaatggcaggcgcaactcgctgatcactccttgttccacgggcgcgagcagtgagaggcgaaagaaccaacgaggaatttgacaagacagcgagaagaggagacgggaatctgggacagtcgccacagaaggctgctcttgtggtgcaaatgcggaaacgctgagtgtcgaagagaagaaggagtacgaagaggtgtagaggaagcggaagcgacgctgagcgggcaggtggcgggcaatggagacgaagaacagtggaagtagaaaacagggaacgacgaaactgcaggggagactcaagtgacgtgggtgtcgcactcagacggggaaggcctgacaacagaggaataccgaatggttgagggtgttaatctttttagaaggcacctcgctgcgatggtggatccggaagttagaggaaggagaaacaaaaggcgtctgcagtggtaccggcgtttacgtgctcctcgacaaaagtgaggcgaagggccaatgttaatcacatccctctcctggcttattcaccgtctgtcctacagatggagtcctcttcttctctcgtgccttctctctcttcacgctcgacttgccccctttcctttccgtgagctctttctttgtcccccatgtcttcagctccctagcgccctagtaacaccgactttcgggtattgtctcacttgaggaacggaggctggaatgtcgtgacgacgagtcacgcaaagaaaatgtgtgaagaatgggtttgttcagcgtcaaacaaggtgaaagaaatgatgatgcccgaagagatgaaaacggaagcggagaaaaacgagcgcttgcggcgccacgagacaagctagcggaagacaggccttttcaatacgaaaaaattggacggttgaggaaggaaagaaagcaagaaagcagagagagcggaaaagactcaagtttagactgtgtgccgaaaaattaaagttcatgctctagctcctcattcctacgccgtctgtgagtaagacgagaatggacggaaggccgcttacagcttttggagaaacaaaggacggagaaaaaaagaaaagggaagaattatgcagtcgcttttgccgaagcaaaacaaagcaggagcaagacaaaacaaacgagatcaaaattgcgctctactgccgggataatcctggagggtcaagtgtgtctggagagaccttgagacttccaagagtcgcgggagagaccgtgggtgaataagagaaatggcacagagacaagagcaattgctcggtaaaagctcacttctagctttctcccttctctgtttaatgcccaggtcttatctctgtgactagcgagagaaacgcacgtaaccatgtccgctgtctacccacggcagccccgcgggacggtcctcgactcacaacctaacacatcgacaaaaaagatggaacatctctgccctcagccagtcacatctttcattcggaaaggaacgttttatatggcaattctttctggttgccatggctgtctaagacgaaagtgaccgtttgttttctcttgccaaccgcgtgtcgctcttgtcgcgaacttgggctccagcatgtcgagctgttctctgctggacctcttcgtcgcctccttcccccccctccccacctccaaagaaaagagagtgacaaaggcaagcaagaaaatacatctgacaccgttccatagccaagcgtttccaactgcttcttgtaagctgacacggatgcgtttccggcgtcgagcgctttcggctctgtcggggggttgtcgctggcacaggtgaacgcggtgcacctcaaaacagagcttcgcgttccccttttctgcacgcttttgaaaagaacagaacaaaagattaacgaaaacgatgatgaggagccctccacatatatcagcggaactcttctcaaacgttgtcgctacctcgcccgcgactttccgcagatcgctcatgcacaatctaccagcaaacgtgcgagaggcgccagcagttgacacaaaaatcggaaggaacgcaaaggtaactctggtaagataacttttctttccagactcaaagcaagattcaatgaaaaaatgatcaccctggcagaaggacacaagcggggcgaggtcagacagcacgtggttctcgtgtctcggttacccgcgcttttcccgttgacagaaccgtcgtattccgctagctgtggtccttgggctttaaagcctggctcacgagacttgtcacgaaaacgataggtagatctagccaaccaaggaatggaaaaatgtagctcttgaagtgacttgttcaagtttccctttttccaaaccagagagagagagtctgcaaagagcgaagaaggctaacactggcggcttctctcttagaggaacgatcgtaggagtgaaaaaaacgattcgagcaggttcaatcctgtcctgctgtcgtgcggaaagatgaaggacaacagatcttctcgatgaagtgttaagtgtatcgcattgctggaagtactctgtaagctatggcatagaatacgtcatttaggaacagagacatgtcaggagcgggtgtaattgagttctcttagcaagggggcaactcagttttcatcctattcgtcaggtaccaacagcttggtcacctggtaggcactgtgccccggtagtatgcgcgaatcggaatttggctagaaagaactgctcagaatttgtttgaaaggggagcgactatacctgagatcagctctccagttccaggcaaaaccaagaggctctagatccgagtgggaaacgtcagcggcgtgtgtagtgaggaggctcgcaaatggaagcaaatcagtttactctttaccggttggaaataccatgtactgaagacgcagcgtcacagatctttcacacaagtgaggctcttttgacgcagtggtctgtgtgagccatcgagtccgccgacagtaaagtggggtattaagtcgtagctgaaggtagcaagcagatgaaggctgagatgtgttcttgctacctggaaacgtgggcagaaaacaagcatgattgagacgttttctgtgtatgcccgtcgcaggggcgccacacgagttgcagcctctttccgcggtgaagcgagaactgcgaatcgacccccagtacaagagagcatcctagatcgctactccagttcgacgcagaaacaaagtggttcagcgtcgcttttttgtcgaccgcggatggagagatctgccttcaagggttgtcttcaggtgaccacacccaggcggatacgcacgcgaagaaaagcgcagcaacgcgtgcatgcagggagaccccgtggcgggttcgcggtgaagaacgagggaaaaagtcgacaggactcacttttgacacacagctgcacgtttttaacacggtctcccgtgtcgagttttctccctctcaaaagaccaaaaccagatcgtgaaaatcaatcctttggtagggcgaatctccttccaagggctcacagttgatatatctaacgcgatgtgttccagttgctggcactgaaatatccaatcttgttcttaagaaccccagaattattttattctctccatttccatcgactgcgcgtgttcaccgaagaagtgcgttgcgcgggccttctcggctgccgtgcatccctagccaggcgaaagcaaccctttcgttcattcacaaaattcggtagaagaagttttacctcgaatttcctaaaaggagagaagcgtgcatcgagcatatcttcctcaattttttctcggtccccctgtgcatgtctcttgtctgtctcctcctccaacgcgctctcccctgcgtcgggactcagccgagggcggccgcctcgaattgtagtcactgggggggcgattattcgggtctataatttgatctacttgatcaatataggtcgcgctactccatcagcacgtccatcatacaaccacttcgttttctcatcagagacaggaggcgtttgtgtgcctttccatgtttcctcgtcggaagcgttgatctctgttagctcttcgctctctctcgtgtctcagcgccaacagatttcatcctcctgtctccgccgtagtgccacatttcggctgcgccgtcgtctggtgaggacgtgagttgaaatccgtttgtcgtgatcacaaactcgcttccctgtctctcttctcgtttctccacggcctctccctttctacgttcttccttctgtcgcgttcacttgccaccgcgcctccctgctctgccgtttctcctctttcctccatcgcgccgcaggagaa

SEQ ID NO: 3973 - DNA, 3897 bp, Toxoplasma gondii
gaaacagttcgcccatcccacagatttcgttgtgcatcaaactgcagacaccctagattcaccgccatttcctccctgcgtcgcttctttcacagggaattgggtttttctatccggactgcgttcatgctgtagacgcggcgccaggctccttgtgaatgagccgtgacggatgctccgattcttctttttagcaagccctattgtaccgactccatctgccactttttaaggaagcgtctcgccgcggtggggaggggtttgtggaattgctggactgcggtttacgagcgcttttgtctcacacagaggcgagaatgtagcttaggcgaggactgggagcgtttgctgcttggctagaattgaggaagacctaaatgctagcactgcggctgccccgtatccctcgtgcagtgccacttcgtggaacggcgcacatttgggcgcggtcgcttttacaaaatatgttggtggagcgtaaaaatacgcgaagaaatccacatggtactgttttaccatcgccgtaaacaaaacattttgacacgtgataagcgcgcgtcagtcttgactgtacctccgctgccctccacacgcacgtgcacggaaagcattttcgtcatcaaatcgtaggctgtgcgcatgtagaaaattctgtttttacagctggcgtgactaaacaagtttgttgcaccctcgtgtgtcttccagggccaccacaagagggggagcttcggtcgcaatggtcagattcagtgttcgccgacgatcagttgtgcaccgctggcgcaaaggatagaacagcaaattgtttttatcgtgttgcttcgtctcttttgtgcgcacaccgcgcgaattgttcgattacgcgggatcgactcactgaaacacgttttccgccgttcctcggagtatttgcaaagatgtgtttttgccagcctaatgctttgctgtgaggaatcgacagaagccagaccaggttgatgacgcatcacccttagtcgcattgcgcgactcccaggttgtcctgcgatgggtgaagtggtgatatatctgtaagaacgacatacatccccgggatgaaagctggttcaactggccgtttttcttgcgtgcgaagcattccgtgcgcactgctgcgtgtcgcctggccagccagtcgaattctcgcagtgcccactcctcagattaccatttgtccaggatacatagatcatattctagacagctggggatgtacacgtctttactatgagccacgattggcgaatgcttgtctcaatcagcagctccaccaatgcggatattgggtccgctggtcactttttgtcttgtacgtgagtccacatttaccgacagcacatcgcattatctcttttccaccatgcacacgaggcagtttcttgcggcatagaagaaaggtttcgcaatgctggcgtggggctctcagcgagtcgatcgcagttgtcaagcggtgccgtgatcccttctgctacagccacttgctcactccctgcaacataaccaccttgctgtttcacttgttccatcagttctcgctacctacagcgttcaccagtaacagtagttttttgtagcccttgtattttgggcagggtgaatcactgtaattggattcctagagaagtaaggatcatgctggttatggttatatatattaagccggcgaaacagtgtgataacggcttttcgtgtgaccacagcagagaagtgcgctgtgtggtcgaacgtagggattcgcacttattgactgtgtaggagtgaagaatttacctgtccctcagctgctgtaactcaaccagcctacacctatgtgttcctccgttcgttgtctatgtaaagaggatggatgagtgtacacatggtcagaatctcttaatatgttgcctatcgccgtcaccttgagggcttctgcatctcttactctacccgccctgcaacgtagggcggtgtttgggctggtttcgttagcacggcgcgggactcctgctgtcacaggcaactccatagtcgctgttccgatcgttattttaggttggttaaatcctggatgacctacagatgaacagaaaattcaatgtgagagagaagcgacagatacacgctgaactgtgtggtctgtttcacagcggaggaatcctttgtttcttttcagaacaccgttacattcaggagcataccgtcacattcgatgatcttattgtttacactagaatagcttaattcgaagaatcagaaacattaaactaccgaagaaattgaatataactccagcgatgagagccagatgatcatggtttttttatgattgctgcacaccaccaccccactggaatgggtaggaaggagacaccaaaccaccgccgtaaaacacgggaacaacctctaacagctcacgcctcacgtgtatacaaataggcccaggaaatgcttttcgcatgcctgaccccacaggcaaatcattctctccttgcgaacgcttttcatgaagtcttcaagatacagagtcgtcaaccagttctcgaatggggttgagcgaacagaggccccgctttgaattcgtgaaaacaagcggcacaagttttgtcgcggctgccttgactgaaaaatctcgattgttgaaggaagtgggtcaacttccagcgtctgtgaaacaaccagtttgtcaaaacggtgcgtgcttaattcaggcgggtttcatcccgccgcttccccaaacgtatacagctgtcctcattgctttttcatctgcatacgctgttttgtgcatctttgtaccgttcatgaacagtccatccagacctctatctccacaattctgtagtgaatgcagagaaaggacagttcccaagtttagacctaactactcgaattggctatcgagtcgctcggtgctgtcgggccacagtgtacagattcgtctctcgtgccggccattaatagccgggaacttgcgagccgaacgacagtgcagggtaagggtagaatttttctgcatcaacggtcacgcctgaatctccaatctgtacccttttgagaaattgtttcttactcgtttcttcccgactttcaacctgaagcatcgaccgcaaatcgaaaagtgcgaaccacacgacaagcttgcatgcaaacagctaacggcagccgagccaacccccaggagacatctgacactccctagagacggtttctctgaaaaatgtgacgttttcttttgaagtgaccgccgatttcttttcatttgccgcgcatgcgtgagcataagcactgctttcggactcggtggacacatacgtgcctttgtttcgcttcagtgcggcctgttccaccgagcggacacacactcactacatttgcattcactgaaataacgtccaacttgctgtctcgcgcggaaagccagtttacttcgctggaatcgtaaaaaactcttcggattcagtgaggggcggtcttctagacatttaggtcatccttgggactcttcgaggcgccgtcgacggcacggcttctgtcgactgcaaccgaataaaacgcgcatcgacgaacagcaaaaacacacaaactggcaatgcatcaagaatgcagttcaccccttgactctgaactccatcgaggcgacggcgcggccagccgtaccttgtctgcctcgagggtcaagggtctaacgaatggaatgcacctttcattccccgaaacttccctgcatgttctagccgccttcaactgtgttccgccgcggctccgtcgcatgtgaagctttgttttaccgcagtttgactccagagcgtgcatccgaatgcgaatgacgtgcctcaatcaactttcacgtctacacacggacgcctacatgaagagttccagcgcggcaaacctgga

SEQ ID NO: 3974 - DNA, 4315 bp, Toxoplasma gondii
acatgcaggtaaaacagagcacgacagagagacacacatccacatatacacgtataaatgcatacaacatgtacatttaaaggtacatgcgcagagaggcaaagtgatatatatatatatatatatatatatatgtgtgtgtgtatgtatgcatagagacataacgccgttgacagaagcgtgtgaagcatttatttgtatgtgaagggagagctcggcaagaggtgtctgcgtctcaataatctccgccgccagcaataagatttcttcgctgctcccagaatccagaatgacatctgcgtagagaaatgtgaggaggtgcaagcacgggtacgcgcgtgtgtatcttgtcacgaccagatgaaaatggagacccgttcaagccagatggtatgtgaaggaagtactcgacaatttacgtaaggcaggatggcaggcaattcaaagaaccgctgtagtgctacgtgtctatccagtgtgtctgcggggctcgtgtgggcaaagagcagctgcagaaaggagctgtgtctgaccagtcggcatagaactcgacgatgaagaggtcgttggagccgacgacttgttccttgaactgttgaccagagagaacctttacaggtccgttgggcgcgtagagtccagcctgagcgccagtgaggaccgagaggacagcgaggagaagcgcgaggtgctgcgtctgtgcaagtgccattttgaagactttgaggaagcgagatccgcagggaggtttaaattcgagagccgaaaagagacaaggggaacagccgaggaaaacatgcgtttttgtctcggcgtcgacagtgtgcacaagacaagagagacaagccagggagggaagaaagaaccgcgcagagagggcgtcgttgcctctggggagagcaaaggccgcgtcgtcaacctgcttccgaaaatccaccaaaagtgcccaacaaacgtccacagtccacctgcacgcgctgttctttccggtgtacgtacacccaggggctaggcagagaagagacgagagaggtgcaccgcgccgcatgcgcgcgcctgtgaacgccatgcagccgcgtttgtcttttgcttttgcgttttcgtggctttctcgcttcagcgtgcggagagagaggcacaagttcgggtgtatcgacgccagaatttttcgaggcgcgggagaagggggaacgcggtgtgctcgtcagcagcgaagaaagagtcgacagccggcaggattgtttgcacagttttctcctggtttggaaggataaagaaggaaagtgtctgccgagaaagtttcgggtaggagaaccagtgggaaatgcagaaggtaggaagggtgaggacgagattggagagagggtgctacgagacgcaggctgtttttgatctgcggacagggtctctatgaggaaacagggaagagcgagagaaatccagtgagtagccatctatctgttaacagagggttttgaaaaaacaaagagaaaacagcagtttttctcgcattctgtcgcaagacaagagcgacagcagagatctcctcagatacactcgtttgtttcctccgtatttgtctccagctcttctgttgcctcagccttatgaagcgtcttttctttgttgtctcgatcttccgcctcggtggtttccccttccttctgcatcttcccccagttctaggtttccccttccctctgtgcttcgtcgtgcttcttgcatctctgtcgttcctcctccctcgcttgtccctcgctcggtcgcttcacagaggatgtcccttctctctctcgtgtctccaggaaaacacagagagtgtggaagcccccttatctatcgcaggttcggtcgaatgcaagagcacactctgtaaacttcatgccttctgatacgtttctgcgactatgctaacggcgcgaaggaaagtttaagaaaacacggatgcgacccgggcaagtcagcgtctcacaaacataaacggtcacacgcaacgtacatgcacagaaaaacagagcatatatacatatatatacatatatgtatgtattcgtcgtcaaaactgtttgtatggacttggctcctcagtgatgggcaaggagtcctgtgtgtagtgctgcgtcgaacatacacaggtgttagtatcaactttcaacaaagaaaataaggacatgaagatagagactacgagaggagttcgtcctcgttttctctgttattttgtgaggagagaagttccatgaagacgacagagaggaggcgtttgaaaagcagactttcttcctgtctgaaggtgttagactgcgcgccttttttctttaaaaaagacgcgtagctaagagaaatggaaatatttgcatcttctgtttgttttatggagggacaaaaaggtgaacacgcgttctttctcgaggactttcttgctcgaactcgccgattctcaggcttcctagttcggaaatccagtcgtttctccctacgacttcttttctgtggctttcctcgacactgctttgtatagtggaacgcggcacaagacgttctgcctaagttctcctgtgtatctccctccgctggtctgctttctggtgtttctccttcagatctctctagaaagaaaaagagccttaaattgggagaggtttcgactacaagatcgtcagtgtatttcctatgaagaaagaaaagtattctgtctgaacctctgctagaggcagaaggctttcgagttcccttttcaagtgaggggagacactctccgcctctattctgatttgaatatagtctttgaaacaaggggaaattgcttatttgacgtcaacgaaaacccccataccatcttctcgcacgcaatctgtatctctctgtcaaaatgcatttttttcttgaaagaggatgctgagaattccgttgttccttcaaagtgcagcctgcggagagacaacaggggtgacgaagtctcagaagcgacagagggaaagagagccgaggagacgtggagacggagatcaagagggagaaaccgagtcagagatcgatagagaggaagagatacactgagatggacagacacaaagagaggactggatcgacaaagagaaaaaagatgccagtgagaggaaagagagctctctatgcagaaacgtggacgcaagcgtcgaataacagagataaacccagatcctttgaacaacgatcgtttttccttccgatacacatctttctgactgattcagcagtatgtctcgcctctgtctactctggacacccgagtcgagacgcttggaaattccgagttcctcagtgtttccgaaaactgcaagaacgagaaaaagagaaaaagtcacagacttgtccaaactccgtttttctctcacatgcaaggcgtacatgctgggtctcgcgtgcagcgcgtgtagacggcgcgaggcgcttgcatgcagcggaaaaagtttctcggtggttgtctgcgtttgaagagagatctggagacagaagactctcagcattctcgatttttcaaggaagtagagcgagtcgttgtctcgtatctgttggagtctgtctgcaacgcgtgtttagcatgcacacaggaaggcggcggtggttcactttttgagaagagcggacgtctctgcctctccccccttcctctctcttttcgctgggagttcgagcgagagacgaagagagagacgctgatccgtgggtgctggaacggtcgacgggagactccgcatttgtcagactctgttctctccccactgtcgcaggagtcggaagagtcctctctctgctgtctcttcgaggcagggaaaaagcaggcttgatcccctcgtttctcgcttcctctgtctggcatgttccagagtagtttcgagatttttctgtccttcgtctgtcggccttggccctctcagggtcaccgctggtcgactcggagacgctctctctctgtcgttttggcggtctttctcccctttcgtctgagtcaatgacggtgctacacaaaacacagcagccgttcttcgccctcgtctcttcttctttgggggagaaacgggggtttcgtctccaactttactttcgcttcatcgcctttttcttctccgtctatcccgcgtctttcttttcgccagtcgccttgggtctctcctgcctcgcaccgctcctcttcactctcctcactcaagaagcacccgctgctgcggcgaaggttcgtcgtgtgtctggggcgttgtcgtgctccgatttgtccccgactccttgatctttctccactgttccgtctgtctcctttcctcctctctttcca

SEQ ID NO: 3975 - DNA, 1911 bp, Toxoplasma gondii
ttttctctcggctgctcgttcttcttcagtcttgggagctccgtagccgcgctctcgccgactgttgtcgccgactgcaactgcgcgtctctctccgtctcgccctccgttctttctgtagaagctcgagctgctgcctcgaggcctcgacgcctcggtctctgcggaggaaccggggattgtcttccccctggggtccgtcctccgaaagcggcgtttctcccctcctcgctctctctgcacagaggagcgacctgcggcagaggcgcgcgacgccgcagaaaccttagcaccttcgctccttgagagcgcgtgactgtcgctctgctttcctccttcgcgactccgcagtccagaacgcggccggccgctcttgcctccagacctctttggcgtctgcttcgcggcctcgccgacggtctccgaagagcgcgcagcgacgcctttggacgtcaggctcttcattttcgccgagatcttcacgaggtgtgcaacgcagaggaggcctcttcctcgtgctcagacgacctgactctctggagaagaggaaacgcctttttcgctcgctgcttcttttccatcacatagcgacaggcgtttccatccactggggcaaacacagtttggaccgacacagagagaaaaacgagagatagaagaagcagagaagaggatagaggtggagaagtagggaaagacggcgaagacgcgacaggaatccactggagagaggaaaggagaggccggctttgcccgtcaagaagtcaagagcggagagaaggaggagaaggagaagaaggaggagaaagagaagaaggagaagaaggaacgagaggagaaggaaagaacttaaagcaccggaattcaacgccctgaaagcgagacctgcgacgaagagaaggccttgccgagaagcgagtgtctcctcgttttgaggacaggggagacgagggtgagaagcgaggaacgccgcagagagcgaagaacaaacggaacctgactaggggaagagaaaaagaggtcggccaagggagaaagaagtttgtttcaaggacggctgccggttttgcgaggggagaaaagaggccgctcgccttgagtgcgggggaagcgaggtgtgtcacgacccgggcggtccaagtcgggaagcagaaaaacgcagaagcgataacgagaaagttgagtcttcaaaaggcaacgaaagagagagccgcgtttcctgcgtttggagaggtcgcgagacactgtcgcttgcttgtcgaaaccgagaagatcaacggaaaaagctgcgaaaaaaacagctcgagaatcgatgcatgcttctctccgcgccgcgcgtgtgtctctgcccctcaaacgcgcaaagctgtgctgaggctcactgagaaaaagtctcgactttttttttctgcagagaaggaccaaagcagggaagctcgacttctgccacgaagacgaaagcgcgcgcgctcgagatctctctgtctccttcatttccctcgcttcggcgctctgccccccccgttctgcttctttcatccgagtctcggtcgatttcctcctcttctcgctatcgttttttctctatcttctctcccaagcgagaaacaaacggtatcaaggagttctcgccgcctgggcgcgcgctctgcctttttcaatctgcgtttctctcgtcagtctccttcccgagagactcggaggggaagaggctcgagcggctgcttcttcgctcctctttctccttcttcccgtctgtctcctgtctcctccccagaactctccctttcctcttcttcttttcctttcttcttttcttcttcttcctcttcttttcttcttcttttcctctttttcttcgtttgtcgccttttcgagttgagtgaagagttctcctctgcgtctgcaaga

SEQ ID NO: 3976 - DNA, 2173 bp, Toxoplasma gondii
agtgttcgtgtctcttgcagtgctttaaaagcacctgcccatcccttcccccacagatgatacttcttcctcattactgagtcattttttccgcgaagccagaacatgattcacaggggataggtgtgttttatgatgagttaagatggttatgtgttgtgtttagtcctgtgattctcgcttgacgtgccatagccctcgagattagttcctaaagcattcgtctaaccgataagactcgttgtgcctccctcagtgagttatggtgcgtgtgtcagtattttggctgcacgatatgttgtgtggtaattgacagattcccgtaacaaaatcactggtgaggtagtttgattgatgcagtgttatagttcctgctatagcccagagatgttctgtggtttggcgcctccctattcctgctatgcaagcgggtatgtttccttccagatcgcgctgcaccaagacccatttcactccagatgagtcatattgcgagacataacgtgttccctcaagaccacaaaaaatggtggctgtttagtctagtggtatgattctcgctttgggtgcgagaggtcccgggttcaattcccggaacagcccgtttagggtgtcattggtccatttctgaagcagacaagactgaaggttacagttttcgcaggatgaggtttatcttctgctagaatactaggatagcgacgcgaacagcgcagtcgggatgttctctgtgccagcgtgtttctggctttttacggcttccccagctgttatccaagcgccgcaccttagcctggcgaaagctatgcaaactgcggcgggtctgaagtattcggggcattttcatctttgtggtaaacacattgcccttactagtaaaaatggtggaatgacgtatctagcagtcggttcttaatgtgacagtaatcgcatttccgcacagctacagtcgatagtgaggtgaagtgcttactgttactacgcgtgagccagtaatgtcgacctgacccgatcaggtttcttctcactagtgttcacacgttcctgagagcggatgtgatactatggtgtgactcgcagtgactcactagaatgatgcacagaagaatgcttaaaacattgatttaatgtacagtctgtgtgccctgaatattatctcgtgcaagtgttcgggtagtcctcgtggttccacgaacgaccttctctgccagtgaacacagatacgctattcggtttcacggtcgtgcagctaaacctattccggtcaacaataaaactgctctccatacataattccggagatcaacatgccgggtagaagacacgtgaatcgccagtgaaaagaaatcgaaatcaacgaatgaagggcgcatgcttttgcagaatctaagccccgcgtatttgttcacgtcgatggagccctgccggtcatcgaaactttgtcatgaggcagttctgcgtcattattgtttctttgcaaatggcacagctcatcaagaggcatttgataccactaaatccaagcaggtcaaacgtttatgataaagtacacgaaaagacgaccacttgataacgttgatcgcatcacatgctgagcggaaagagtagcaaggttgctttgaataatcgaaagaccaggcaataaaagctggtacaagcgttgaaaactttttatcggcgtctcttgattgctgaaaaagagcatgcgttatagcagcactaccttcgacacctgccccggggacaccatcttgcggattaacgggcacggttatgattatggagatcgctagcaggtactctggtccattactagaaaagagatcgaaacgagcccttttaaaggcaggttctgagtgattgaaagagacagaggaacagggccagcagctgcaacaccggtacgcgaacacgcagccagacttccaacgcgagtattcccgtaaacaccacacagcgttcggtagagaccatcccccactaccccattggaacgagcacacgaaattcgctaccgtctactacaagtcatattcattgttatcggttccaaaatatggtacatgatgcctttgtgtggtatttggagtctcaatcctgcttcgcctcctggaagatgcccaccacggtaggtgtgtcgaaggctcggaatctcactggttcaaggggacag

SEQ ID NO: 3977 - DNA, 2546 bp, Toxoplasma gondii
tgcagcttccctctgtctctctgatctctgagccagaaagtctgcccatctttcgactcgcgtcgccgggagagtggcatcgaagaattcggcgagaccgtcgtccaacgcaaaaggatcgttcacgcgttctccgccttcactccgatttctctgctctccttctctgtcgaagcactgtgttaaagttgccccagttcgccgagtctcccactgacctctctctgcggctccgcgaaaaagcgtttctcctcgcctctccgcgaggtctcctcctcctctggcgttggggtgtgcagacgccgtcgcgtcgttccacagagtcctgtcagagagggccgaagcgggtgtctctcccgcgcctgattgcggtctttctcgctcttcaagaggaccagacggaagcatcgcaggcgcatgccctgtaggcagtcgagacgttacgagctccgccctcgaggtggaacgcgaagccgagcttcgctctgcacctgtctctcggtgttctcgacctccttcttctctctgttccctgtgttctcgctcttccccgtctgctcccgacgcttcacccctgtctcctgcgcaccgttcctcatgactggtgtctcctcgttcagtggcttgcgaggccgaagaacttcgctgtccatcgcgttctgcgtctgagttctcgggcagagaatcgaacgcagctaagaggtcgagcaggtcttcttctggggcttccatggtgagagaagaaaggctacgcacccccctctcctactcggtagcatcttcgccgaggtcggaagtttttcctctgttcctctccattttcacacccgcggcatgcccttttccttccggtcctctctgctcctcaggacatggctaacctctctcgtttctcgcgtttcttcttgctctggtctcttccaccactccaaccgcccttgttattctcccctcgagggaatgggggcggcaagagaaaggaaaaaagacgagaatccacgagcgcgcaccgcctcaacaatgaaaaagggaggtcctgggagaaagcgcgttctgcaggagctaagcttttttgtctaaaccctttcttctcttgcccgcttttcagtcgggaacagactagcggggacgaagtcgtcaggcacccagaagaaagcgaagaagcgatggacgaacgctgcgcacaagtcctttgcgatgagagaatgagtctcaagcgcctcaatctgtgtgtttcgtctggaagactgaatgacacaattaaactcttcaagggcactaacgaatgagctttgttcctcacttctttgacaggcttctcgctcctctctccgtctctggaagcacagctttcaagaaggcgagaactcaccctcttcctttttctacgcaaatacagaaacgcactctgacagacacatacatgcgtgtgaataaggagctgcgaatctagttgaggtaaatcctgaaaaaatatggaaagacgacgagaaaggtgaaaacttcagagagcgcccttgcccagctcgcggcgtatcgcgacctcctgcgcctttcaggcgaatccggggaacttgcgttttctgcatttctctccctctttctcggctgctcctcgctctcgagaaggcctcccatgttctctaacttgttactttttttcagagatcgtgagtctcaagatttcgctttaaaaggcggctggtcgcatgcgctattctcgtcaactgcgtgtgtctctggagcgaggtacgccgtcgcttgcttcccggcgactttgaactttttctcgctctcggtccctcagagattcttatcttcgtttttcgtcctttgttccttttgcccgatctttcttggatgttctcctccttttctgcgcctttttccgtttctgctctccgtttctgccctccgtttccgcgccgagagacagacgctcagaacgccgagctggcagcggagtcgctgctcgcgtgctctgtgcgaaaagctgctcgtcgaaccagtaggacgttgcaaactctgtcgaaaacggattgaacatgtcgcttcttctcgttttcttgcatgaaagtcttcctccgtctcagtttccccgatgactggtttacgcttcgtgattctttgaggtcggactgccgttccgtgtgatttcctgtcaccccagactctccctccatcgcctcgtcgtttctctcctttcctgtcattttcctcgcttcttcttcttctcgcttctcctcgtcttctcgctgtcttttcctctccatcttcctttcttccggttttcctccgcgcttttctctggtccctgttgtctcgttgtgtcgtccttcctcgtcttttgattgaccgcatcgcgaagagaggtagcttttttcgcatgcacgagagaatctagaacctgggcaaagtgcctccactttctaccctccgcatttcgccttcttgcgaaaacggaactttctctttttttctctcgcgcgcctgccgcttgccctctctcccctccactaccactggttccttcgagtcgtctctga

SEQ ID NO: 3978 - DNA, 4702 bp, Toxoplasma gondii
agaagcggcgacttctgccaaggaacaaaccggtccttcatggccctggaaaaaagtttcgaatccacaaaaatcgcagaggatgtccaacatgtcgcttgtgcggtctacgaaacctttctgccacaaaccgacagaaaaacgagcgcataaacaggccttcagatacacaaagatatcgacacacacacacacacatgcgataccatccacatgcatctgtctatgcaaatatatatttatatatatatttatatatatacaaatatatatatatatatatgtgtatacaaagtaaaatatatcaatatatatgtagcgagagcgagccagggtcctgctccgttgcgcttagtaggctggcggaagttttcctggacttttttaaaagagttgtgttcctacagtgtattccatgaggacgcggccgtcgtccaaagcgattcgcagcgcgcgtttgtcctttcctccggagaagaaggaacggatgttcgcatcggctgtgcatggcgcgacgcagtagacaaaatcgcggtggtgttggagacagaggcgaggagagaaaactaggcccgtcggggcgcggctggcaggcgtctcctcgagggaccaaaccaccacggaactgtccagactcccggaaacgagctcgaaggaaggtttaagagaagaagcagaagcggaagaagaagaagaagagagcgcattcttggagacgacgcagacgcaccggacggctttggagtggacggcgccctcgaaggcgagtagaaagggagaagacgccatggcgaagaaggccgaacgggaggagacaaaggagaggaaacgagaagagcgaggagacaaaggagagggagaagaatgggaaggcagcacagagagccgaagggtcgctggcaagaaacaccggatgtttgcctctgggaccttctctgtgtgtatctcttgtcttttctttacttgcttctgcttcgttcttggtgtctctgcttctctcagtttctctagcgattcaccgcggaagggcatgggtggaaatctgtctcttgcctagtccttggtggttgcatgcatacacacgaaagaactctggcgcgtctgcctttcttcggcgctctctcgagcttcccttctcttttccgacttcttgtttcgctcccaaagacaaggcaacggctcctcttcgccagaaaccaggacgctttgcgttcttgagtgcaccgctagacgcagatagcgcggcacgcgcccggtgcatgcagcgcgagcttcacaaggaggagagcgctcctgctgcggctgcccgcgggaaaaagaagactacaaaagttcctttgctcgccttttttgtcgacaaaacaagaaagctcgaggacaaagcgcgcctcatctcagaaaggtcaacgtcgtggagcggtatgccaacgaacactgggcaaagccatcacccttggagggagagaacggccgcgagtgcagtgtcttgccgggggggcggggggccgcgcgcaaatgcggagtagcagagaagaaaaacgcgcagttccgagaagaatgcatttgtgaggggactcgactcagcctcaaccgtgaacgaggaggcaacagatcctcgggagaacacacagcctttcttctctcggagacaggccgtgagagacaccgcggctgcatgcacctgaagcagcggaagggattttttcgattttcgctccctttgttcctcaaacggaaagtgaaacgacctcgcgaacgctcttgagtgcgagcagaaacgaaaaatcgagagagatgcagagggacagagatgtgacggcaagcagtggtgggcgcgacggtgtcactctagtcaactggacggaaatgtagacaaacgcaggagcctggaaaccaacaacctgccctgcgagaactcagaatcaggcaaacgcgtaaaaagcgaagcatgcgaatctcggtactgtggcgtccagatgtgagaaggaccgagatgaacagaagtcaaggtggactctcattgtatccacgctgaggaagaaagaagagagtcccctgacggcaaccagatgagcttcgacgaaagtcaacttctttcatgaagtggacaacgatatgtccgcgaataaattagtcccacaaaaaacaagaacatgcacgcatatattagtaaggagagaatataatgcgggaagccacccttatcaacagaacagttgtgtacaaacagatctgtatatacatacatatatatgcatatatatatatatatatatatatattcggatgccgattcctgtttttcagggaccccgacaaatcacatccactaacagctgtttatggatacatatgttggcagatttgtatgaataaataaatatatatatatatatatatatatatatatatacgcgtttgcctaattgcatgtctattcgtgttcacaactgcacttccgtgtatttatatatatatatgtaaatatatatgtgtgattatgtttgtggatttgtaacgaggagagtaggccgaacggttgtcaggggtgtatggcaatttcatgtaaaaactgcgaatcttgcggctgcgttttctgctctggaggctgtgaaaagtttgcaggaaagtgtatctgactcggcatcttcttggcttttttgggagaaaggcggctcgcgccccgtctcggcagatcccccgagaaggacggcgcataaacggaggaaatcacaaggagagcaaaagagggagagaaacggagagaaagagacaacaagagacaggcagaaaggaaacagtcgagagagaaaaggataaggaaacaagacgaaagaggggagcgaagagagaaagaagaaaagagagatgacacgagagggggagaagagtagaaagggagagaacaagctagagggaggaaagaagcatatgagataggaggtaggtgagcaagagagaagggtggaccaaagcgttgagagacagcgagagggaaaacttggggagagagcgagtccaacacagacagacagaaggaacgacagagagaacgagggagagggagaagaagagagagaagcgatcgagggatcaccggggagcaggctagaagaggggagaaaagagcaggcgagagggaacgctgcaacgagaagggaggagagagacgaaagacactaaagctggagagcaggagggaggtcggaggcgagaggttggcaaaacaatcgacagatggaaaataaagacgataaaaacaccggcgaggtgaccctgagaaaagagaacaagacatcgagggtgggcgggcgggggtggggggcagagacagcctggatgattttctccagaggaatttgtgagacagatttctgtttcggattgaggaccgttagaagaaatcaaagaaactccccgttatttcatccttcaagagtttttcctgccctgctgccagggagcgaactgcatgccttttggatgttttctctcagcgcggatcgctggcttttttttctgccggcttgttctcctgttgtcggagaactcttctagaaacgacgctttgctgcaggtgtctctgtttctctttttaaaggaattcgaccgcattttctcttcgtttctgtcccctacaacgcaaacttttgcggcctctccctccatgtcttttctgctccggggctgtctcgacagctcttctcgttcctcctcagcaggatcgtgtcaggattttactacgcaaggaagttctcgttttcctggaccaactttcttttcgaggggaaggacctcttcctgacaggcggctcttcacttgctgagaggtccacgagacggcgcgtcttcgcatgcagtgccgcggcgtttctctctcttctggatttctcatacacagcgacaagcactgtctccgtttccaggaagcacagcagaggaccagctgtccagagacggcgagggagagagaactggagagaaggagagaggagcagagagaagggaggtagacgaagacagatgaggcagagagatgtctagagagagaagagaagggaggaagagcagggaggaaagccgagtgaggagattgacaagaatggtcgtttctctgtacgactttccagggacgttctgcgtagtttttcctgtcttttatacctgaggagcgctcgcgtcgtattcattgtctctcaccttttgagaggcttttctctgtttttgaagaaaagttcgctttcttaccaggtgccgatcctcgacagtcactcagaaacgtaaggcatttgagagcgcgtctctctcctctctttcttcatccctcgttttctttctttcctctcctccgttctccctctgctccctcatctcgcttctgcggggtgttcgtctcctgggcgtatccaagtctctctcctgcgctcgttctgccgtctctggagacgccgcatgcacctcgacgttcggcgcgtccaatgagtctgaccggctaacgctgcggatccgccatgggaggcggctcctgttcctggacttctcgttcgcgtctcgccgcttgaccgcctgcctcgcatttcctccctcgcgccctgcagactgcgaggagtctgctgtcgggagagaacacagcatgcggacctcgagacgcctgcgcagaacgaccgcagacagttgagtgagcgtctgtcgttcgtgacga

SEQ ID NO: 3979 - DNA, 2023 bp, Toxoplasma gondii
cgtgcttctcgtattcaaagtcgctattccattccatgtcatcggaggaagagcaggcgaagcgagcttccctcggcctcgtgagtggcccgcaaacaagtttgcttccagtgaggggcgttcccgcgtgatgcatgaggtttttttccgcttcgttgacgcgctcgtcttcacaagtctgaaaggaagtttgatcttttgtccgcggtatgttgagggatccagaaccgggcccctgacgctcagtcacggtgatttgcagaagcaaagcggaatctccgagaaaccgacttcgactgcgcggaaactgaaacgttttgaagattcgagagaaattcgtttacagcaaaaacagtgttccggggcgaacgaggtagtcacaacaagtttggcagcttcgtccctcggtctctccaagagtacggcccttgcggttctgtcgtgctacataatacatcgcttggttgctagcgaacacaccagttttctgctgggtatcactttagcatccgcctctgcagcaggtagtccgtttctgttcaacaggagccaccgtgtggttcggcacatagctacttggagcgagaaaccaagcgcagaatgtgcgttttcatcaagacagtagaagaacgcacagcaagtgtaactctccgataaaccctcgaattttaggaagagatgacgactcccccctcttccgtttttctcttataccccgcaaaaatgccgaggcagtctggattttacccttttagtcgttaatggacctctgcaaggctgtcaggacactgaaacaggttatttgtgactgtctgctattggtcgagggaaggcgcaaactgatcgtggcaccttcggattccgcagatcgcaatggagactcaactggagactctcagatgtgaacacacacactgtgggggacctgccatcacataagcgcacagaggggaagtgcacattccgcgtgcacgcacttcgagggatatccattgttttgacgggaagctgacgagaaataaatgaagcggaggttttctttaggggaggactacagtcacttatcgtcggcgtgtgagttcgaggcatgcttccccgttctgagattttttggttgacgatgccgtttctctctccgctagttttcgggggcaacagctggtgtgtgaaagcaccgaaacttacatatagaacccttttctagtcgtatcattgcagcggctgttcacatatgcatctgttgtggtagccgaccatcttcacgttcaatttcttgcccaacttgcgtgcgcgagattccatatgcatagaataggtgttacgtttgagaaattctttcacgtgttgtcacacgcttctttcgttttcagactctatcaagaagtaagtcgacacactttggctatctgggctggcttggtctttctagtaggcaatgtcaacacacaaaagattttgaccagctctcacgctcatcacgcattcatccacacatggaatcactttggagtccacctccatttcagtgtgcgctgatcttgttgtcgtccgcaaatacgaggtgaaccctcgacccgtgtaatggcttagagacagttgaggaaggcggtcctatccgagatcgaactagccaccttttagatgctcgttcctgtcattcccgagttagcacagccctgttagcgcctccggtaagataacctttccacctgatggaccgctatacaagtcctctcgttttctttccctcagagcacatgtctcagccaaaagttgctccgtgtgcagatacgggctacattcccgaagggaagactgatctacgacgcctaacctgtttgtattgtatcgaactagcacatctcgcgatcatcgagcgtatcaacaagatttagtcaatcccgaagatatctgagacgatcacgctattccaaatcacagccagagcctgtgtgtgccacctctccaaggctttgtcatcggaactcattagcatcaagcttgacggcaatttcgcaagaaa

SEQ ID NO: 3980 - DNA, 3982 bp, Toxoplasma gondii
caagcacaggaccgcagcaggacgtcaccagacaatttttaagagcgacagttgcaacttgcggacctgaatcatttttgtactattctctcgatagtggcaaacgagcacgactaagaaacgttcgaatcgcatgcaacgtaacagtcgaattcgaactcgcttcctagcacggtcactctttgcgcattctttccaaatccttcaataactcggcgtagggtgagggtcgcgggttgaatgggggcgggcgatatccgtcgtccaactccgtttttccagcctcagcaggcgccgtggaagtgcgggtgccgccaaatcccttgacagcctttgcggcggccgctgctgctgccagcgttgctgctacccctaaccccgtcaggactcccttcttgaccttagatttcctgcttgtcttgtctccctcttcggactccgaagcagcttcgtctgccggcgtgaccgtggattcagaggatgacgagtctctgacgactgtaagcccactatcttcagttgaaaccgaaactgagtcagaaaacgcgggcagccgtggaaatgccggaaacgctgggtagccgtacgacgctggtcgtggaggcgtgggagtagaagtagtacctggatagctgtaatcgtattgagactgttgtctcaactgcagaccagaataaccgggagtcacctccgcacccggttgaacagaggatggggtgaagacaaaaactgaaggaccgggaggaggagctgctgccgggtgataataggtggccgttgcttgtgtgcgaagaggctgctgcggaatcgcctgtacggggtgaccaggtgttcctggaacgacttgtgcagtgtagacacctgcaggcatatagtaaccgccattcatgggagaacccgggcctcccgccgcctggggcgcctgcgggacgccttgttggtctacgatcatgaaagatccatcagggttttggataataagtagctgtccctgaggaggtggagagccctgctgtccgtctgcgtagggatacggagttttgtttccgtacatcgagtggtagtatctctttttcgccgcatggtgttctttgtcttcccgccccgtgaggcccgccatatctgcgaggtaagaaccaaagctgcactcacctccaaacgcaagatgcgacaccatgacgacgacaaataaagaaaaccaagtgccctgcattgtagaaaacggagttcaggatcttcttgtctgatgtctgtctaaaaacagtggacgctacacgttccacggcgtgagtacatttttcaacggcaacaaaaaaatagactggggtttgctctgacgaaactccgggtatgcgttggttgtgaaaaacagggaactttgcgtgtcactaaatgcagacacggattcgcgtctctgtccccgtggaagagacgcgacacaaaccgcccaacttccggttggcacaataaaacatctgtacctgcttgcgtggagaaaggtttgcctacgtaaaatttagtcgcgctcttgggagtcccggccgcgatgattagagaatgctagctacgaaaaaacctgagtgcttggcagcttcgagggaaagtacacgtttcgcgaagtggacaacggtgcagcacccttttgggggggaatcgattcgcagagaccctggaggccacaagaaagagtttcccacggttgataatcctcatgcagaaacgccaactgaaacatacaagtaccgtagcctttcgctcgaaatacctcttcatgaggctcctgttttcccgtgcgcgtatacgcccgtttccagacggcggggtgggtgattcaaaagcaacgatatacacgggaaatccgaaatggtaagaacagctcgaatccgtggcagttgccattgccatttagacgtttgctcatggaacatgtgtgaaccagccgtagtgtcgagatctatgcagttgacggtgggtaaacatcgcatcgacaaggtagagcagtgtatgtggctgacttctggccgtcagacaattcttcacaatctggaaccgcgtctagaaccctgaggcaccttacatctgttctgacaagagctcttcgctgttgacaatgtgtacgcggcaggtggttgccagtgtgtggacgcagaatcgcttagacgagcgtggagcgtcttcggcgtgtgcacagccgttgtagttgtctgtaacagctaatactgtgaacagtcgtctttagcaatgagtagttgagaaaggaacggtagaaaagggacaagaacacaggtatagcagccgccgtcagattcttttgctctagcagtcagcgtcgcttccacgagtcctgtattcctgacgtcctgtgcctttggcatttgtttccacagcccaacgaaattggcgttggcgagggaagaatctgcagaatcatggtagtccctaacactgacagtagtgtaggatgttgtgtcttccatgaatctggcaccttttatgatttgatgctttaagcaaacaaaactttgggatgaagaccatcctcccgccgatgactgccattacaaggaatatgttggacgttaggataaccgctgaggtcgactaaaaagcgagggtacggtacaataaacggtactagacggttcgatccgtcgcgtcactggtatgccctatcccagcagccatgatgcggggatctcagctttcctgtacggtagatcgcagaatcagtgcacctgcttgacctgtcagggtttattctcttctttcatggctacttccctattcctcgcgagccaccccctcatatcacctgttggttttgacgctgttgctctcaagcattggctatcccacctgcttactatcgatattactcagtgtagtgaatagaagccataacgacgtcacgctgcctagcacttgctcaaacgtaccactggaaaaattacctgatttgcagaacgtacagcatcgtacacgactgcctttgcaggggtcgattgaccactctacttgcacgcctttctgacgcaatgtggaaagacggaatcgcgttagttcttgggtaaacgacttctgaaccaacccgtattcataacacagccatcacagcttgcccgtgctgcgacctttcacattctgacaacaccttccctctgtccagatagtcagcgatagcctttgatgacgcattaaacgaggcatcgaagcgagcgcagaaattgccacagcatagaggcttttgcaacgcactgtcgttaagtgactaggctttctccgatcaagctgcacattcagagaattgattctccacgtaacccgagccaggcctgcgcacctcccgctgcacatttggccgcattgactatgcctctcctcgacaaggatgtcagcagaaaccctttagttcatggatccttaacgcatgacgttcgaacttccagagttgacaagataacgttctgcacttgttcgtatttccgtatttcaagcgcccgaccgcgaaaaagccgtaacaccgtcgatgacccacgggtcggatcactctgacgtcactagaaaggacatcgcaactcctctctacgagcgaaacggccttagaagcagccagttgcttgaaaaagaagctacgcgggcagccgtttgtcgcgttggctatcccttcgaaaggctgcagtggacgaggggctgaagccacggaaacaaacatgcccttccactttattcactcgttgtgcgcgtcgcgtgttgcgcgtcgatgcgcttgtcccctgacttcttcgtgagggcgcggcgctaacagaactgcgcgtttgccgttgatttaaggatctcccagattttcccagatacatcggtccgccttttttattcttctgttactgtaagtggatacgctgcaagaggcaccgcttcttctgtggaaccccgcacgcgcagctgccctctgtcgccttttccgcgtcatcaactggcaaga

SEQ ID NO: 3981 - DNA, 3482 bp, Toxoplasma gondii
ttgattaaatgtcgagttcggaaaccattgtacatgcgctcgccctttgcagacctctggggtagtgccttccgcaagtttttcgtggttcgggatcttcacggtggcagcgctgcgcaaaagagaaccgtgcaagcaatggctatctttggcgcctctggtgtgtaggcccgcatcgttcctgatagatgcttaacattcattgacgccactgcactcatcctaaagagctctggggacgcgtcaaccgtgttgtcagtgtcgctatgttctcttcttattgtgattacatgccacaatcgtaacgtacgacaccactcgactaaatctaacactgccactgtaggtgacgctcggcactgacgagtcctgtgcagccagtatccggccgacatcggcgaaatttattgatttgtcttcacacattcgaaacaccacagagagtaacactgccgcagaacagggaagccgaagagttgtaggacggcagccaagagggaacttctgctctgtatgattttgcagcggctcacaattacgacattgtctggaagcctcccccagttgccactttgcttagctactatggaagaacaatgggtgccagagaaggcatgtgacatacagaggaaagaaaaaataacgtcaggcacgtgttcattgagcagcgacaagacaggtcgacgtcgatttcaatgcctcttaagaagataaggcaccgcgtagagcatgcgttgtgaaaagggccacaagaatatgtctccaaccctgaaaaggcacggcttctttggtagcaaacgaaaccccagctccgttgaagaccgtgtagaaaattaccatcttaactagacgaatcactctcatacagcgaagaatgctgcttctgagtaggcggattgtggctgcgaatgtaatcaagactacagattttgatcctacttccaagcgggaagccactccataatgtgtgctgcatatagttgcttcggcatgtgttcaacctgcatttcactggtgccaaggttctttagtccctcaacaagagccactagcgagatgcgaacggtgcagaggggagctgccgatcaagaaacgcagtatctgggttgcgtgttttgctcattgtatttgcatcggcttcgcaggtagaccgcagcatcgcatggtcctgcaagctgttcaacgccccgtgtgcatccattcatcgcccctcagtttctttcgtgtcgcagtagaaagtctttaaagagtgtgctcagaatgaacgtgagctcgtaccagtccccactgaaaactctacagctcggacacgatcagagcgacgctctgacggtcggcagtaacgagcctacgtacggagtcaatgtttcagtaaacaagatttgtatgatgggaagcattaatgacttagtcgaactgcatggaaggactaaacgcgaaaccctgatgcactggtagactttggtaaacagtgtagcaggctaagtgttcacagcgtctccgacagctgtttcacttgtgacaaggcggtgcaaattcggtaaagatgacgttcgaaaaggagagcacccataacaatgccctgacacgctggataactgaaaaaactctatgtttttgtaccagagaccctgcgcaaggcagaaggcctttttgccaagcctgagttagcacgagttaacaccgttaggcccttgacctctcgcttctcgttgatggaaaagcatcgcggcctctgatctgccgcacattggtttctttccttcccggttatgattgacggctctattcctcgagcggcacatccttttgtcgtgtgtcggggcatttccggtatctctgtgtgtccccctcggaacgtttgcagtgtctcccccaaaccgcctagaaaccccctgcttctacccccgctggtggcgttttagcgaaattcccgtcgttcgtcggcacatcctgagagactattccacgcgtccgcaggacgagagcacatgaaaacggagcagaaacgtcaggtgttcccgaaatttccgtccagctaacaagggacccgaaactgcaggcggcttttctccggggactcagcctccgggtcaacccacgaggtgtccggcatcgccgtgcaaagaagccaccctctgcgtagcgagaatgcgggacgctggaattcgttttccagattcgactgacgaaagaaaacgactgaacaaggcggaactcgctgccataatggatttatagatgcaaagaaagatcgatcggaagcgagagaacggagccattctctcgttcccagaagaaaacgaaactgccgacctacagagagtcgcccgactgctactctctgcagctcgtgtgttcgtgtttctcggttctggcgtgcttccgtctcgaagagagactctcacctcttccttgcggcacctggttctccagagtcttggaggcactgaaccgaactcttcgcttcttctgaagggaacggcgctatctccagtgccgcgacagtttccccgtgcttccgtcccaggagagcggcgcagcccggctccccctgttccaatcgtccaaagaaaagacaaaacgtcttcagtgtgccacagctctggaatttccttctctgcggttgtcgtggtgccaagcacaatcagcagagtgcggaagccgaactcgttggggggaattctgccaaccgatgcgagacctctggtgtaacgctctaccgtttctgcacgaacgtgttcagttccggacgcccctggcattcgtgaggtagtcagtgtgtctgcaaagaaactaatccctctgagagtcgcgtgcaagttgcggacgccgttggagaatggaccggttggggctgcccctgaaatcggactcttactgtcgccaatggaggcggccagcgtctttttaatgcattgtggcactcggttgtcgctttttcttctttctcgttagtaatcggggcgttgaacagtggaccgtgtatgcgtgcgactccacgtatgtgtcttgtttcacgcaacaaaggctccttcgtcatatgttttcttccaccccagcccgtgcctcttcacgcacacgaaggacgccctcaactgtgtttgtttccaaggggactcggtttcaagtgtggaaaccgggcaaggaccgctgtaaatgcggtggtgcagggtcacacacaattcatgacccagtttatggcacatttctgggcaggtgtgtcagcacatttgaaagtgaaagctcactaacgtttttgccccgtgagtcctgtctgtggtaacgccttgtagattgcttttgcttccactaccgtcgctgttcagacaccaggttgaatcagtttcgtattgtgtgcccgccctgagttttttacgtctattttgacgatcaggttgtcgctgcccgcccgtcctgtcactgagtgggtgtttcactcttttctcggaaccgatcgaactcctttcccttcacgaaaa

SEQ ID NO: 3982 - DNA, 2130 bp, Toxoplasma gondii
agaagggctgttataaagtctttctggtgaaacctgatgggatgaccctgggtaatatggtgttatctttcatggctgcactaaattcaacaaaatgacgctgctgtgggtcgtctgctcgaaagggcagtgaagctagccaggttgatattatgcggggttctgattgggattggatcctttaggcgaccagtaatggcttccttgggggcaaggggaaaatagtccgagttacaagcgatcagatggaggattattcatctgtcccaccttttgacagtgagcaggtaggccgagccggccactgagcgttttaccgaggaggcaaatttacgatgcttgcgcgccagccaaagctgctgtcgttgtggggggagtggtcaaatcatcacatgggaaggaataacaccaagatttttctacgtgcgtgcgactgtggatgaagccacgcatttcgtccaaatcggttttcccacgttgggcaggaaaaactatttgtacgaggattgtatctggggaccttctgcccgcaactacgaacgttgtcagacatggctctccgcatacggagggacagcaacaataagcagtcgatgtaacaaacagcataaacgagtggaaccatcttaccaccatatctgggcacaacaaaggcaataaaggcatgaaatgaccagaaagacagccaactcttccttcctggcactcgcaacatactttgtgttcctgggtggttcgaaagtcgtttttccaggaaccagcgcaatctcctatttcttaggaccatgcggttgtgtgtttgtagctcagagtagatgccaggggtagtggcgtcggttggacactgttctgtccattgagtataacttgatggttgtaactcgtgaggatagtagaagacaaggcctgaagcgtcgtctgccttggtttcatttaaatggtgctgcatgtatccagcacaaagagctcggctggtagtccttcttctgtggagaacttttctagttgtttttgtggaaccgcgagcacaccggtgcatgctgtactcacacaccggctcccgggggtcttcatggcggccgacgcacttgccgatgcagactgaagggaggaatatgtgtttctcgtcgtttgctgccatcgagattgactctttcagtcataaggtccaagtcaaatacaccgacgcggacagttaggagttttgacaaaggcaaagactcttcgggcgaagccccaacgagatgccaagtcggggttaccattgccggacggcgtcaactccctccagctggcacgctgttgacttttgctgagccgcaaacggacctttgagcagaacctctcccgagagccacttggtcttaccgaggagttggtacttttttcaacctccacgtaaaaaacatttgctacaacgatgcctgcattccagctgtgatttatcctgacagggctgcatgcagtgtcatgcacgggagcgccggtctcacgagtggcattttgagaccttgaattcgccaagggtgtcttttgtgtcacttcccaattacagacttgacagaatctcctcattgcatcgacagccgccgtcagggactcaaggccctggactttcgtctcttcggaccgacagcgaatgcgcgggccccgactccgtttgcgcaaaacaagggcgaacttgggattcggttaaacaaagacttccaagatctgaaccaatcgtcaagctcgtggcatctattcttcgcagggaaagcttatgaatcgaaccgtgtaattccattcgaagaagcagggacactgcagtaccgacaggctgcaatctttgcaggtctcgtaacttcatggcgtgctatttcgtggctgttgttgtgaggcagacccgagttacggagttgaataaagtctcgacagtcggcatctcttcgactgaacatgcactgccctcgttgacacgttgacgccgtatatcccgccaaaccatcggtgttgaatgaacagcgtttcctcgcgaccccctctgatactccgcgtgaaaatccctgctatctggcgcctcaaaaagctgggagaaatgcttcttgcatgtgtcgagggcctctccaacctggcggtgaccctttccga

SEQ ID NO: 3983 - DNA, 3089 bp, Toxoplasma gondii
ctcttccttctcgtttcgctcactcaagcttgctctcgcctctccgagctccggcaaggaagacgaggagggagaagaagaagaagaggcagaagaagcagaagaagagagagaagaagaagcagaagaagagggagaagaagaagaagagggagaagaagaagcagaagaagagagagaagaagaagcagaagaagagagagaagaagaagcagaagaagagagagaagaagaagcagaagaagagagagaagagttttttgtggggtttgccatgttgggaggggaagctggtgtcgcgcggtcctcggggaaatggtgttgtctctcgaggagcggtcaagaacaagggagaagaagcaaaagaaagaaaagaagcacagaggaagagagagggagaaagactggagaaatggcaaaactgggaagagagaaagaaaagttgcgcgcagatgagagatgggagctacggcgacaaggacggcggcgaaggaacgaccgaggagagaacagacaagacgagaaactagaaggagagacgtcctgaattcaacgaaagaacatttcgtttctcgtccaggaagaaggtgcggcgacgcccgagagcagcatccccctcacgacaaggaggatgaagacagaccgtaaagggagccaggaaagcgagaatccaggctctggatggtctgagtcaagaacgcatgcagtttctctcgcgaaaaagaaggctgaatggggagaaagcgaggaagacagagagtcgaatcgaacaggagaaccttgtttttaaggggagtttcctgtacagatccgcctcggtctgtgcgagacgtcggtggcgaagaagcactgtgtgtcttgtccgaaaactgagagaaatgcgagaaacttgcttctcacaagctgaaaaaccgaaagactcgggagtttccctcaggtgtatgtacaccccccgccaggcggttgtcttctggccgagcgagagtgggccgaagctcccccgctctctcccctttttcttccctgggtttcagacctcgggagtttttcttccggccagagacatcttatctacgatatctccttctctcttctccgtttttcttcttcttctcttttctcctcttcttctctctcctcgcctcgtgtcttgcgcgtagtagcgaggtgagagcgagagacggcagcgagcggtcgcttctccagggtgctgcttcgtagtcgccgaggagaatcgaacaacggagcgacgcaggagaagaggcgcggagtcgggcttcccggttttggcgctgcgtgagagagagccgcgtttctcgcagcctttcttgaggctttgacggaaacagaaagcgaagattcagaggtagagtcacttgccggcagctcgcggtgtgcagataaggcgcacactgcgctagagaactgggcgctcgccttcaaaaagcctcgagacagaggaaacaagaaacatttttctcgcctctcggtggattttccaggagcggtatcaccgtcgcacaccgctcctcccgtggtgcacttgggagagaggcgcggaaaaaaggcgcgctgcgcgtccccgcgtctcccgcgaaaaaaggtctttgtcctctcgctcgaagcagggaagaagcctcgcgtttgcagaaaagaagaaagcagccgccactgtcggtggggaaaccggaccttcggcgttgccgcagatcacagagtctcccctcgagctgcacactcgaagagtcgccggaaaaagtccaaaaaccggagagagcgcagcgttcgccttcgcggttccgccctcccaggaaacgcgcggaacaccggtcgccactgacaagacagccgaaactcgcgctgcgccgccagaggtgggcgtctttctactctaaccggaggtccgtgtgtcgcgtccccgctggctcgcggcttttcgcggagatcttcgcggaaccgcttgcgcgccggcgttttttctcagttccttcctccgctgcctgtcgtacactttcgccgaggaccgcagcggtcaccgactgcgcagaaaacgacccacagaagtgcgtgccccacagaagaggcagctgcaagcccagacgaggccttgtgaaagaggagagaaaacgagcggagacggcgagagagacggcgagaaaaagagcagagaaaacgagcagagacaaagagaaccgacgcgagcgcgcgaggcagaaacgtggaaagcctcgaggcgcccgtagtggaacagacacagaagagggagagaggaggcgcgtcgagagagcggcgggtgagcgcggggagaaaagcttcttaacaggcgtagagcggaaacgagagaacgagtcagctcggccaaggtcgttccgtctgctcctgctctcttgagaaaagaaaaagccggcgcgataaggatacacgtagcacactgccgcgaaccgcccacggggcgactggactgaggcgagattcgctccgtgcagacaaccgagaaaaaagccaggaagcgtttcagcagatgtgaggaagcgagagcgtaacgcagccagaagaaagagagaagaaaaagacttgcaggagacacagacagaagacagcgcgaggaggtgaaaggtagtagtgtgagaaggaaaagcgagagggaagcgaagagcggaatggcggaagacacatggagagaacgaactgctgagcatgaaacaagaatttctttctggaagctgttgaaaaacgagtcgcctcccccgtgagggtgtcgtgaggttgttgcggtgattctccacctgcacagagtctcgcccttggagtggatcgggcagagaaaatcgaggtcaagtggtgctctctctgtagcttgagttctcggatcagcttcaacgcgaactctgaacgagaacgcactcctctctgatattgcttcaaacagaatcgacgcagaaccgtttcttgcttctatagttcagagttcctctcgtccgtctgcgtccttcccccccccctctcctccatcacctcctcttctgtcactttcgcctctctcgcctctctcgagctctttctctttcttcttctcgtctctccctcaa

SEQ ID NO: 3984 - DNA, 4519 bp, Toxoplasma gondii
acaatagactgccggtcacaggctggccacacgcctacacctgttacatgcaggcggtaaagcacgtgcctatacacctgtggatacgaaggcgtatatagaaggaggtggctgtgcaaactgacctcccctgacaagagagaactgctgcatcgagggatgcacgcgtccaatgaaagtgttgctctccatgcgccgggacaagacaatagctgtgcttggtgtccgcccaggaacaaagccttgaccaggcactcctcgtagtgtatgtgccggcgagactccaggcaaggaataactttcttctggcttcaccaatcgacgccccgcctgcgccccagcagcctctaagtcaccctcctgggccttgtcatcgtgtccgtctttgggaactgagaaaaaagagcaaatataggaactttgtaccatgacgcagaacggattcaggcaaccttgagttggagaaacaaaaacgtcgacacggtagcgacatgggggatatcaaatacaagacatgatcgatgggttttgcacttggacacgaggacgcagccgaacagagcgggacgcgggaaagcgggcgaaatggcgttggagtctaatgaaatacggcctctttctacacccagcaatcgacaaacacaaaacagttttctgtacgtgtcccagtgacaggtactttcccctgatgtacccgcagataggatatatagtgtgtctgctggtgtagtgtctgctggtgcctacgcaggtaaaaacttatttcaggttttacagacctgcttatgtaacagactatgcacaagatatctggaggccactggggtggcacgtggagactactttgtttccggtgtaaaacgcacattcggtcgtgtgagtagacatgcaacaagaccagttgcccttactgggggtttgtcgctcgtccgcggtggtcgccatgctagttcctttcccgtcgaccgctttttatatgcgcacagtttcaggaaatgctactagccacagcgacacgaaatgcaaagggatttcgctcgctggtcgtgttgcctggcgaggtccgaaaagcgcaccgattcttgagggctaaatcgcgggaatacagaagtgcacgctaaagtgtaacgtcgcttgcgtttcacatttaactcaaagcatcatatgacttcacctcaaagaaaacgaacaagcctcatcgcaccgattcgcctgcgcgattgtcttgttatggggaacagaaaccctctgtttcgcaaaccctatcccacgcagcgaaaagtcaagattcacgccaaaaacctaatcaacacggcgaagaagactcattccacagcccattcgaacagacacaagaaaaaacactccaatgaaaagctactctagagctctgctgcttcgagagacaaacggttcgcgggaggtaccttgattttcttcccaccgctaactaggtgggcctttcggtgaatccgcgcggcgaaggagattgacgacacacagaggaaacttctggttacaacaaagctggctgtgtagtggaaaagtgcagtgggcacgcgtgttccgaaaaggacgacgaactctcaacattcaaaacatgaccgcagaaggagtatccgcgtgtgcgaatatcgcgcagcgcattagtgtgctcgtttcccattataggaacaaataatttacagagaaacacaatccactctgcctttatttgaaaaaattccacaaatggacacagtgaaaggaacggcgggcgaccccattgcgataatgacacgatcacgtgccagccccagaaagcatgcccaccaagtttcttccagataagcaagttcgtgcggatgaggtagcttcgtagatagtatggcttccaccttcatgggctctttctcgcgagcccacgcaccttctccaccactgaaaactcaaggtgtagaaaacgagagttgagttagagattcgtcacaaatcccaattacgtcatcgccgtatacgttctactactgcggcatctttcaatcggcactcgagcagcggtgctggtcgcgctggctcgttagacgctggcactggcagcatagtacagagcggagaagtatgaaagaaggtatttcgattggaagattgcgaccgtttgagtcttcaacgcaaaatttgctggtagacgatccttgtccgtctggaagaacggccacaagcgctatacatagacacctagtcgcgacacgtttacacaccggtcttcgtcactcgttgcggcgcggctgcacacgtgcaacagggcgagacacgctatgttttgttgccaaacaacattcttgaaaacaggcgttcatgcgtattcaatatcgtgaggtgtgtagagaggcgtctgtcaaggttcaaacacagggagaagcggcacagacgaggagctccggcgttggtcgcatggctagacgagtcgtagtagctccgaaccaccactcaattgagaagaggaacgaaccgacgtaagtgggagaagacttacattgggggggtgtgagttgggctggtgtcggccacaatgaaacgacaacctgttttatttgagccgatgtcggggccggcagtagtggttcatcaaagctgctagtctatggaagtcgtccaggcagtgtccagttgtccaaaagtagacgaaaaacctatccagtgacacatgggtacgaaaacagatcagagaatgcgaaaaaaaccgtgcctatctgtcctgaaggagccgtaaaggaatgcggcacccagtatgatgtggcgagcataacgttccccaccttggcgtcacatctgtgcaagaatgtttctgggcttactagtttttcatctctctctttcccctgcacagcgttagcttaccaccctggcaaaacgaagaaggcttcctcaatcgtaaacaactgttctcggcagggatcgtgtttcgcatcgtgcacactgcgcgaccaagaaacgtggaatacgtgtgtcggggtaaaagggaaacgcagtagttgctttacaccctatagagaagtactcagagaacgcaaagctccatatcgcgtacgagagtcccgcttgagtggcttacaggaggcatcatcgtattttgtcttgccaacacgtgctgccgacgtgggtcgccatttcccattgtcgcaacaccaccgaaacagacatttctgttcccgctgaggggaggaaactgagcaaattatcgcctacctacgcatgcaaaagttaaagatagagagtaatgcagagctcagtgatggttgccacgaccgacgtttcagcttggtgcgtcatgggttttcctagacggagccgcggtacggaaggtacggatcgtgtcacgttaccgtgggtgatacagtgacatggttggacttttttttctgagatagcgtccaaccacgaaggtattccatctctgcgacgattttttagaagaggtagagccaacgttggacccagcttaacccgccaactagctcaaggtgggcgtggtactgcaagtgtcgcagatgacctctgcaatcgaggaccgcagctgcaggctgggaggaagctactgggccttctgttactaccactctgataaatttcgtcgcttctcactttttcgggcaaaaacgatggcccgtcactagatgtcttatgtgcaaaaggcaagtaggggattacggcctccgctcgtttggaatttcttttcaagagacactgcaactcaggcggtttgctgagtgaagagatccaagcggacggcgtggcaaattgccgcactgtccggtgtttgcgggggccttggggtctcgattagtgaacctgtgaattctgaaagctctacagctcgtctcccttatgcattttactccctttcgcgtctcttaccgcttatagtatgcgtgtctgtagccagtatactccataggatgctgcttttctcatctgttgaggttgtcgtggtaaagcagctgggcaacgtggtcaggtgccaaggactcagtgacgcacacgtcgattccggcagagtgtttagccgttcacctgtgccgttttcgcagagagcgtttctatggggaccggctcgccgtttcactacgctccctagataggaacgtcagtcctcccactcacgaggcgcgtcaactcaccagctctccagacggtttctgtcaatcttcctcagcaggtgtcgctccttcagctcagcaggggcttttgaagcatgctcaagaaagcggagtagaatgtctgagttttgctgttgaacagacgaatctaccgctttcggcgacaggcgacgtggatacggtggggctgtaggaagcacttgaagaggggggttgcgagtttcctcttgaatttgtcaaatgggaagtacacccagcgacagacttcaagacaaacgccccttctttcagcggtacggatctgcctctcagcgacggaattgggcacaaagacaagggaattttctttttttggcgaagctgggcgcctacgagagaga

SEQ ID NO: 3985 - DNA, 2013 bp, Toxoplasma gondii
ccagtacatgccctgcccgctgttggctctccgtaaattaaaggggactatcgcgtaagtgtttcaagacgaatcggagagcttgttttcatagcatttgttcacttatattcgatcctcaggggcatatgtgagctctctgcttcttgaagtactcagcccacgagctaaaatgtagtgttcgtcttttttggctgtcggtccctcaggtgcggcattccagcagaaaaggaaaaatatgcccaggaaacagacaaatgttggatggttaatgggaagtgagtccagaaacagtgtgataatagaacacaccggccgtgacgtagctcatagagagcgttcttatataaccacttagacacacacgatggtctttcttggtaggaagagctattctagttagggaatttcgctcccaccctttgcgagccctctgtgaagtgcaacagcaagcgcgaatgatatagatgagcctgtgtgctacgtgcttcgttcgtttacagatggggcgtaatccactactacactcctcatcaacaaacaggaacggcgacatcaaagcatgataagtcaaattgtactgctgcgataaaaagcgcagctcccgtttgagcgacgtaaaacgtcgactgtcatacactgcggacagcttgtgctaggtgatgtgatgctctttatttttctcggccgttctctttccaggggaaatgcgccgttatacctgcttccgcgtaaggtgcaagctcggaattgctttcataatgcttcaagttgacgtggaaactttcgtcacacgctgggtgccgcgagcagcactcctcttttccttgctccggagccagttggagacagacgcagcgaaaatcacgaacagtgacacggcgacacgggacaagagacgtagacttgcaggtgttgctggccttttagcgatacattgttttcacaaacggccagtaccgcacgcttttattttaaatgaagcaaagcaaatacacacaagcgcgtaaattgaagaaacacgattttttctggaaacgttgaagtatccgagattgcactgctacagcgaagtaacgaagaaagaacccccagaggggactaaaaagtcatcaaacaaactatatgtagcaactgatcccgcttagtgagcggcaattaggcaacacaggcaacaggcagatgcttccctcgatatcactttaccgtcaatgccttttagcatttagctggaatttcacgtttccattttgaagcgtattctcatttaccaggacctgcgtgaaacacgttccaagcaagaaagagatcccgactagagcatctacaacgctatgccaaagaaccccgttgacggcgctgccgagacgactctgatatccctcagtgtgccactttcaagaatcatacgcgcagattcaaatatcgcagggggaccgtcatggtcaaggacagatcccccttctctcaacagggtaaagtggaccttctgctgccaactaccaaagaacagaatacgtgggatctgcagcactcagcaggttcgaggtttcatctgcatgcgccatgacgcagttcggtggctcggtaaaccaccacacaagtctattgagtgctcagagactgatttctctgattctaaaacgtgcaacatcaaaatgtccactctgccttgtaacacactgaaacacgagtgctgggtagttagcactccaaccgtgtacagagatcgaacaccaaaagcctttgacgacgaggttgaccgttgtggaagaaggcgttttcccaagaacaggaagacgcttgtgggaattcgcttgtcgagcttagacaagcacgcctcgctacccttttacctgtctgttctggagttccgtctaataggcgtttcattctcctgttgccgctcctcgaactttgagaggcggcgctgcttctacgtataggcacgcgccagcggagtgtgcgtgtgcgtgtgtcgctgtgcatgtgcgctaccgtcaaggcgggaaa

SEQ ID NO: 3986 - DNA, 1386 bp, Toxoplasma gondii
agagatgcaccgctgagctggattgagagctcaggtctccttctcgcttcgtcgcactcgcctgcgaggaccgtcgtgaagcgtcgcttcgcgatgaagagcttcgagacgagtccgaaggacttcttcggtcgcgatgtctccttttccggtcgcgccggtgctttctccggcggtgggatttgtctctcttatgggacgcagaagacgaacgcgaggcagacctgtcactcgaagaccctctttttctcttcttcttccctcgctccttgtcgtctcgccggtggtgcctgtggcgatggtggcggctgcggcctcggcgctcgcagtcctccttcttccggctgtctcttcgctgtttgtcggctctctcgggagattcagtccggcttctctcgaccttctccccttctctggagggagacgcgctgtcgcgactgccactgcgaactgacccagatcttccgcgcttctctctcttctccgctctttccacagtctgggaggcaaggcgcccggagtctcgcctagccgtctccggtccctccgtttcacgactggagcttcgactgggtgccgaggagggccgagaaagcgtccgagagtgggatcggcgagactcggagcggttgttgtctcctcgtttcttgtcctttctttcgtgatgccttcctcgcgagctctttctctccttcgatctgtcccgagacctgcatcgctttcgcttctccgtgcgactatgtctgtcgctcctctcttttgtgtgacgtttgattccctctcctcgagtgtctttctgcgccttcttcccgcgttcttcctcgtccttctctccgcgacgttcctcaatgtgtacgtcctcgccctcgccacccacgagtctcgcactggcaccgtgtctgtgtctcttgtcctcctttctcttgccgcgattcttgtctgtgtctctttctctctgcgtctctgaaggcttttctgagcttccactctcgcaaggtttcttccctttctcatccttcaccttcttggccttctccttcttctccccctccccgccgtccttcccccgcgtcgcctccttggcgtcccgcgactccttgcggtctttctcgcgcttctcctggagatgtttgttctttctgctcccgttcttccgcttttcttctcccttgtccccgccgcccccacctgttgtccgtcgcttgtcgcgcttcgtcgcctcctcctcgtcggcctccgccttcagcaggctggacggcgccatgggggaatgaactcagcggcaaacggcaatttccgaacgggaaaacagacgcgtccctgcctgcggccgagggacgcacaacacacagaaagcagccgtcgggctctggaggctacactgca

SEQ ID NO: 3987 - DNA, 3444 bp, Toxoplasma gondii
attgttttgtagaagggaaccgctgtgtctcacggttcgttacgaaggaacggacacgagacaaactcggaggggagattcaggatggcaaaactgttttcttcttcctctcgactgcgtcattcggtgcgcatggaaggtggcacaacaactgcatgcgctgctgaattttccgtgggcaagcaagcgtcgtctctagaaaccacggcagtttcctaaagtgataggcaccatgtgcgaatcttacggcgggccggaatactgggaagagaagctgggaatcggacaagcacggcatacacaaggacgtggtgcgcctttgttgcacaaaagacagacggagggaacgcgggaagctgctcgagaggatcactctgtgcagcttttacgatgtgttttgtatcccgaagagacaaaggctgtttctctgtcccggtgctggccacgtgagagagctgcgcaatgcctagtacgggggaagacgtgtggcacgcagggctttttccgataagtgagcgggtggtcttactttttgtgtacagtgggggagaggcagttttttatcgtccacttcttcgttgagttagccagcaaatgcacggcaaaagtggaaactgtcgtcggtgaggatttcgtgagcaaaatcaagtgtgaaggggtgagttgcgacctcgcatagacactagtcgacacacaggcggaccggtgcccgtaaaagaatctgtcacccaggtcgccgatacactccgttcccagtcacggtcacgtcaatgaaaacgtcagacgacgtgactaggagaaacacaacggcgcccttcctgtcttaccgcgaaacgaatccgaaattcaaaggctgaacattgaaagaaaggcagcataaagaccacggttcacaaaagaactctaaaagtagcgttcacgtagcactactttttgatggtgccggcccgagtcgcgtctgtcgtagtggctcagtccagacttgggtgtttctgctgtagaatagtcgaggaggaaaaacgcagttctcgtggacaggcacgccggctgcacgtgaaggccgtgtctgagcaattcgacctaagcaggagatttcaaacgggaagatggaactgacgggaggaaggctagcagatacacctcagaaatacggttgtggtggagcatcattgatcactgtaagtttcccagagtacagaaagtggcgtatcccgatcaagcttttcgagaccggctgctgttgtacaaggataggcgctgcgtttgtgcttcttgagatatatcgctggtcttcgtgtacctttgtgtccagaaactcgttacgcggaaacattgtcattcgcactggaagcgacgccgtgtcgtatcggttgtcgtttgtagagggaacaccatgtatcgcgacatatcggagctgtgttacgcatcacatcacctggacacctgttcagtcgcctagcacaaacgttgcctgctatacaattctttatgtacccgttgttcgattaaacattaatttggctctctgaacttcaaacgatacactgaaaccttgctgtgcacgcgtcggacacgcccctgtgtagtgggcgtctgcgttcagctcacgggggcgtgcatcttgtggcttcttcatcagggaatagggaaatacatattggctgtgaaaggctgaattttggctggaagtagaaaagagttgatgagtgagtttccgtcaagcggtggccacgcactcgcaagtcctcacgtgcacacaaacagtgacggtgtgtgtgttcgcggaaacaggttgcatcgagggacataagctggtcttcaacacatggcgtgttgcataataaatacaatgttagatcggttagttcagaatgtttcaccaccaagtgcggacgtcatccccgtcatacactcttcagctgttgatctgcgatatcgccgaaatctctagagctgcttcatcccgcccaacgcgtggtagctgcacagacacagaaactgcattgtttgtcatcacggagaagatgttgttgggaaccccccgaagtgtgcagcggaggtgtacggacaccgtgcgactaccgtcaccgcgacgaatggccgcccagttcgcccgtttaatgtggaagcgcagttcgtcaatttcacgaccctatctgcggtcacctgattacccatgggacgtctgtactagggactaactgaatttttgcgtgcacagtgcctacccggactgctttcacagcatctcagcggcagtgtaccatctactcttggcagaccagcattccgcaagtgatagagccaccagccgggacaaagagagtcgttctaaaggcctacgtaaaagcaaccacgggtccgcgtatgtagcgggacaagaatcttttctctactggaacgcccatcaacaaggcgacttacatggaggagaacgcatcacccgaacgactcatcgacccaaatcgacagacataacgaaaacacaacattgagaaaaaggaagatgaagacacgcagtagagcggacccgccctttcgacggcaaaatatgtgccataccggtctccctcacctcctgaagggtgctttgacgttgacattggggcatgcttggcggttgtgaacgagcaaccgaaccggccttgccagcgtgtgagagagcgcatggctgcttcaagagcaacgtcactatgcggctagcagcaggcgaattctgggaatgtggctgtcgtggaagcaaacagcgtgaacatgtcgttgtttattaacatttcgactgccagaaggaaacggatggcactttactgactttagacaggcactgttccatgggagggcatgtcaacgtaaaaagacaccccatgacatggccgtgaggcgagggcactcgggacctgtagtaccccaacccgatgtttaagagaagaatgcagcactaagttagaaggggtatgttctacagagaacgggtggtgcgggcaacgattgataagttcctgtcaattgaggccagcttcatcttgtcatggctcatctctgagagataccgcctcgcaatggaacgccacgttcgacattgaggcattctgtcccccccgcaatctggataatcagtgcaccgtggctggccaatgtaatgtgtatgaggcgacctgggaagcggaagcgtagcattaccgacctgtatttttacgcactcttgcgcaagcactgagggtggctcctgtgccgcgtctctggtgcctctgttcggccttctctccggtcctctctcgtgcgggcgttatttgcaggaataaacgcagttcgtgtagcggcacgacctttccaaagccccgctgttcgtgtactttgtctcagccactctattctattttacggccttctgacgtaaaactggattctggttcaaccgtgagtgtggtaaactacggtacgcga

SEQ ID NO: 3988 - DNA, 2172 bp, Toxoplasma gondii
tagaagccgtctcacattcaaaacggaaaaagtacggcgagtctctgagtcccagccaaaaaggagcatgggtcatggtctaggttttttgctatatggattacggatttcattcgaatcaacagagatggagagaagagaatggattgcgagtaaggcgaacttccttcgcttacgaggtgttgttgacgaagtgaatttcacacgacctattcgtagtgatcatcatcttgaagcggggtaaggaggggaaaaagcaacctcacaatgttttccccttccgccgcctccttcgcttcatcctcttcagtgtcccgagctgtaagtacacctcatccacgcgaccaggcgattcgaagcgtctcgggactttctcggagttctcggtttttcttcgcgtaccagaagctgttctctcgatgtggggaggaagaacgtcgcaggttgtggattcagcctcgaaagttaggggcgaaaaacgcagaaaataccaaaattctactctagaaaacgccgtttgaggtcaggtcgtgtcagaacgcggctcgagttcgggacaggcttcgctgataagtaggggaaaaagcacaccaccttggcgagcagagagcactgtttctctagaagaaaaaggacgaagggaaacaaaattccttgcgtgggagaatttgttctgtgtcgtcaaagcgaaaacgtggaaagaagacaatacggaaggttggcagcccgatcgatggcttcagcagaggcgccacggaagaggcgaaattggagcacgaaggttgtgtgtttcggtgcgataaaatcctcatatgtagagtgaaaagtagactcaaagtctaaaagggtcgtggaaagaagtagtcggaaaaacaggcagaagtgacctggccgcctgcacaagaaactggattaagacggtcgtcaacgacgagtctgacacaggaacacgagaaaccgaatgaggaccaggaagaagcaccggagacaatagtgaaagggaaaagttggtcggacttccggtagtgtcgaagatgtctatacactctcgattctgagaggtgacgagaggtcgtagccttcgtgctggagagagggtttgcggtaccacgatcgaagccgaaatttcttttaatgaacgcactcaacaaggattctctgtgcttcaaggaaaaggccttctttgcaggtctcctcgagtgttgtcttactgtcgagagacatgcaggagaaaggcgaaaacagccgacacctcttttctccgcaaaggggcatgatgttccccttggagagaggcaattatgcctttcggtgtgcgagacaacgatgagccaacaaagaacctatcagcaaatccgcgatgcagactctgtacagactccagatccactttttctacacgcctgccacgctttccaggacagaagaactcacattctcggttggcttgctgctaggtcacgtcggcttatattcgtgcaagggaccgaaaacactcttcgagacacacacacacacaacgcctttgttgccactcgcgaggcgggaagcgaccggaaaagcatgggaagatctaaaggtgttgctttctcttgcgtggttcacggaaaacgttttctcacttctaaaaattgcatgtttctcggagaacaggggtgcgttttacgcggcctatgaactcggatatgctgagtccgcttgtcttgagtgccacgcggaaacttgactggcatcgataaacgccattggcactttcaagatctataaaaagcttatcgtgtttatagtgtgcgaaggacttctattttccgggtctgaagggactttccaacatgtacacaacactccttcgacactcgtgaacgttccgactcaagtccgggtactccgtgctaccgggttcaagcctgccaaccgctgccgatatatccgacccattgttacggtctcattcctttgtccggtgacgaaacgctctttacttttctctacaaagcccgatttttctaactttccaacttacatgtgtctgcgtggtcacttgtttcgcgtttccctgcttccgcaactcgcaactcactctatccggacactaccagtggcacgacagcgagtcgaaccccccgacttgtttgacagaaaacgacccttttttctcccctctttttggaa

SEQ ID NO: 3989 - DNA, 2016 bp, Toxoplasma gondii
ctgcgcagagacgttctcaatgctcttgacttcagagacatacgaattttctgtctccccgtttggatgtatgcggccgttgtgctcgttttaaactactagatcaaccgtacctcaccgggttgtggttgaagggtgctttttaaggctttcaagggagttcgacagcggcggctctcatctgtatttgacgggcatcgtaatgaccatttttctgtttagattcatgctgctccgtggcaaacgtttctctttcaacctctgccacgcgctgaactgtagagatataccctccgcccacgcgtgtctagaggggtcttctctttatcagaacacagccggaaggacacctttgaagcgacccccgtaaagctgttctgcgcccagatcctctcttaacggccaaggtgcacgcacgggagtgattcctacagtcatatcacggacagcgaaccagaagtccgtgacaggcggtattcaaaaccgactgcaactccagccgacggttttgggtcggcgtcaagccacacacttacaggatccccttttggatgagaaacacggcagattttgacaaacggccaggaaacctgcctccccgtccgcaccacggggagaaagagacacgacgtggcggccggtctttgttttcttgtgagtagaatactcttggcggctctgctgcgtttcgcttcaagatatccgattgctatagttacaacgaacacttcctcgggggaagagagtcacattcttgatatttgaacatctgcctcgagatcacctgcagttcctctacgacaagcactgcccccgcgagtacattccaacagttcatttcttgtcaacgggaagaagccacacttgaatctgctgcctgtcaggccactgtcctgagacacgtttcgcacttcaacaacacacactcgaaacgtgaacatggtttatggagacccccgcggcattcaagttgcctgtgggtatcatgctacaggactcaggaagatgacgcctcctcgctgttcttttggaatctaagtgtcacagaactcatagaggaagcgagagttttcgtatcctgtgtgacgtagcccaaccggacagaatcacacacggcttctctctctttcacccttggccccgctcgcgtgtctgtctttccacaaacgtgtgttcttgactcctcatcgctaaaaggccttccgccctgtttattcgaaagcccgctgcttctcgaggatctttctacttgacagaaaaaacaaacagtcagctgtacatacacatacggacaacgtctttcttcgaaacctctgcagtaggagcagcagtatctcgagttaatatttctgcctgaccggggtggagtctgtggaacctttttcctcttgtcgcaatgcccacgtttcctctcgtctgtctcccagatcaccgtctcgactgtaaacggctgcgattctgtcgtgttttatcaggaaacacgtttttttttcgcaaggctgccagtcccacctctgtggtctcttgagcgaaaacgaagaaattcgccacacatcttgttttcgaagcgttgccccctaacgcaaaacttttgtaagagtgttcctccgctcgtgtgcttcgggagccgtgtaactgtggcgagtccggcactctgcgcccatgccgtcggttcgcgcgttctttttccttccaggacacgcactttcttcaccaaaaaatgaattttcctccgggaagatcggcttccctcgtcagggatcgctttactaagttgacgccagcaggtagaaaccggcggtgcacgtccgaagagacaccaggtttttgacagcgttttcgcacacccagcgtccagacaaacatcgtcgtccttttgctgcaggggaggaacgggaacggccctgctagggcgaacgaccgagcgagtaaagcgatcgacactgagaacgtgggctcgagtgtctaggaagaaaagcgcgacgtttctccctttccggaagaacaaccgaaaca

SEQ ID NO: 3990 - DNA, 2349 bp, Toxoplasma gondii
aaccgatcctctgcctgtctcctgttcttcgagaaagaagacacacgcagactacagaagactgtctcctttccttcttcgtctcaccaatatcggggttgtcgtaaggatttcctttcacagcaatgaggaccttgctcttcttcttcttctcctcctcctcctcttcgcctcccgaactcttctcgtctccctcctctcgcttctcgacgtgtacaaagagtgactcgatcgtccaccttcccgtcgctccatcttcttcttctttttcttcttcgtctccttcttcttctccttcgtttccttttccgtcttttttcctcgagctggacgtccctctggaccgtttcacatcttcgtaggcttcccccgaggcaacactcacgagggcgagatgcactgcgcgaatgcggtcgcgcagccagagtttgaggaggaaaggtcgctcgcgcagagcgcgccagtcgagctcatctcctgcaaagagactctgcgaagagagaagcagaacagaactgacgctcgagagtctactcggttgaaactgccggagtcgcgcgagcgaagcggggcgcgttctggactggcaaccacacgcgtcaaaggaaaaaaggaacagatggaaatgagagaaaacgaggcacttgcgtgagaggaagcgagagaacatccacacacaaacacagttcctcgaaagcggcaaacgaggtcgagaggtcgctcgggcatggcggcgagagcgaacccacgggggagaggcgctcgccaagggagaaggaaaggaaagagggaaagacagttgcgagactcgacagttaggaaaatccttctgcggagaagaaccgcgccctccaacagagcacagatggttgggggggacgacggggacatgcgagagagaacaagacaaggaaggcccccgtgtctcccatgccctagtggcgcaatggatagcgcgttggacttctaatccaaaggttgtgggttcgagtcccacctggggtggattcatttttcgaggaaaaatggataaaaaactattttttaacaaatccctttttaaaaaaatcaatttaagaaccattgtaattcgtcccctcgagaaatcagcggatttaaacttccagattccgcgtcaactcctcctctccctcctctttctcctcttctctcccgagccattcttcgcgtttcctgagatgcgtgtgaccttcctggaaggcgagagaaaaggggaggctcaggcacaagaagaagactggaagggaacggttctctctggcgcgcggtctcagagaaggacggcgagtctttcgcctttgacgcatcgcccaggggatgagacaccatcccttttcttctccccgactgctgtccatcatcgggactcggagacgcgcggaggaggcgtcgcgtccacacacccgcaaaaaagcagtttcacctgctttcttgttctgttgaaaaatgcacgcccgcagaacagaaggcaagagcgccacagactgcctctcttctctctcgactttcttcgtgaattgaaacgcacaaacctcacaccggcgactccccttttggtgtctctcgcgacgttgcggcgccacgacaggcactggggggggaattcgctttcgtctgtgcatgcgtttgaacagatgtttgttttcacatgaagaaaaaccgggcgaggaacaaaaaccctcgagaaagaggacatcttcactctcgtcaagctcccgcagcagcctgccgggagccaccgcgagcagagctgcttggaccctgcgcctactagccagggtatgtctcatcttgtctcgactcccgccacaggccggcgcgaggaaatccgagctcatgcgaagtgaacatttccggtcctttcgttcactcatggagcgacctcacagactgccgctcttggaccatcatttgaatggacggaaaccaaggaaacgccgcgtctgcaggggcgagtcgacattttcgacggttccttctccaggaagcgaaacgtccacacaagacaaagacgacatccactcttctcgactttttgagagagaaaggcaaagctctcctggcgtccccctctccctcgccttgtcttgcctcttcgcgcccgggggatgcgagaagcctgtgcagatggagaaaactcgcggtttttgtgcgacccaatatgctcacgaagatcagcggaacgagccgttcctccgcggcgaatgcggagtgaacttgttcttgctgaaggaaccgcggcatgcaagaaacgccgccgagaccgagcagtggcggagactcacgatgcaaaatttcagaaaagaaataaaaaaaattcaatcacca

SEQ ID NO: 3991 - DNA, 1347 bp, Toxoplasma gondii
acggtgtattttcttcctaccttctgtgggtttcaagtcaatcaagagaaactgttcaaagagtccccagttcagctgagagcctccgggacggcctccggggcctggcgactctgtgtggtctgagggattcatctcgcgtttcaattcgaagaggaggctcctgcgaagagcagcgagagctggatcgagaagaaagccacaggctggaagtcagtggctttcgccgcgtttctgagtcggtgcatgcgtggggcgcctcagcgacagaaactcagaaactcggagacacgcggaaagcagtcgagccgcctcgctgtctcggctgaagcgtcgatgtcggtgttcgaggagcagcagtgacagaggagataacgactgtcagaatccacgctttaccacgaagtgcgtttccgccaacagaaggcccccaaacacctccgagcgaagtatcgagttccctcgttctgccagacggacagagacctgattcagtgcttagggagtttctggaggctgaaaaacgtaaaaggaacgagccgtctttgctgcctcgagaaaagcgatgggctttgccttgcctccaggtccagaaaagtcagaagactgcggtcttcgtagagaaagagagaagggtgtcacaaatcctcgacccaaaaaagctgggcaaaaagcgcctggtcccgcgtgaactcgaaagagaaaaagccgtttaagtcacggacgccgcaacggctgagacggcaccatcggcctcaggggcacggaggcaaaagcattttcgtctgagagacgccgctgggagaaccaagtccgagaaccagacttgccgactcgagagtgggcgatctagaggcctctgaaaaatccacttcgctccgaaacacgaagtcactctctgctcgcggcgaagcctcggactttcctggcactcagatgcacaggtgagcatcactacaggttgtgcggtttacctcaagtccccacgtcgacgcgcgaagtgtttccactgtgcagcgtgcaacattcacgagcgttcggcagcgagccacctgcgttttcatggattgataagcgtgtcaagaagggagcgtggaaacagctgtttctgtccgcaggagcggaacgagcgacggaaacgacgaagaaatggaccaagttggcgaaaaggtggacgagaagcggattcgatacgcgaacaaatccagaaggaacttgcgcaccgagccagggaaaagagtcgcagtagagcgaccaaggcgggcgccgccgagtaacaaatgaaactgtacacctttcccgcgagagactctcgcagtgactttgcaacggaagcgggctagcaga

SEQ ID NO: 3992 - DNA, 1465 bp, Toxoplasma gondii
agctgagctggagtcaagccagaaacaaaacgagtcggagccaaatacctccttgaacaacgtgaagtagtcaatattgcgtttcacctgtggttcttgtcctccacatgcactcagacagagatcgacagaggctatgttgatgcaccactgtcgatcaacgtttgacgcactgggcccgttgcccgttcgtttcgcggaatagggcacctggttctggacaatgttcttgggtatcagacacgccaactccgaaccgcgctctgcccaccacgaaatggtcatgtctcggaagttctcgagaatcttgtagccagcaattgtccctattgattcggggtgaaactggacgccatgcagtggcagttctcggtggcgaacgcccatcagcacgttatcctcgtctgtggtccagcaagttggctcgaggcatttcggcaggctgcatccgcacaggatcacacgggataactttcaaaaccagaactgcatgcaccagtaattgaccgtggtgaacaaaagctgactgtgcttacctgtctttgtccacctgaagagaatggtagcgtacaaccggagtttcactctccacgccctcgaatagcttgtagcccctgatgaaactaatagggcttcgccttccgtgtaccggtcgcggtgtcctctgaatctgacgcgacaggaacacatgctcaaaagcaggttagcagagcatatttgtatcttcggaacgactgtcatttgtctacggctcgacaacagttgcaccgttacagttttcgcagagtcgggtattcttacctttcccccataaacatgaccaagaccctggtgaccaaggcagattccgaggattgggacggcagcttccctcagcgcttcactgcacaccccgaaatcatgttcgttttcgacagttccagggcctggagagatgacgatgttatgcacagggccgacgcttgcctttgcctctctccagctggagaattcatcgttccggatgacagttggagccacaccattgatcgttgcaaggtactgaaacacgttatacgtgtaggaatcatggttgtcaatcaacaacgtgcgcacagcagcggacgacgggcttggcagccctcctctctccttggggggcagtggccgtgggaggtccccgcctgcgacgacactgtggttcatgctgatttaattacaacggtgacacgaaactctattattgccaagatatgagtcgggaaacggcgtgctggagcaggcgttacggtcataattccagcctgcacggcagcgttgcatgtcaaagcctcgctgtatgccacgttcgagcccgttgcactgccgcatgtcgtttacatgcgcacgctgctgtacagacacgcaagacacgtagacgaactcaacagcttcatccggatttttacccagttctccgaacatttagtcgcaagctgccaaacaa

SEQ ID NO: 3993 - DNA, 4672 bp, Toxoplasma gondii
gcgtaccggagctatccacaattgtgtccaagttgaacaagaaaagaatcaaaagaatgctgagggaaaacgcgatgcaagcagcagacgaacgctcttcctgccctggaggaccagggagggcttcagctcctctgcgaagccagttgcgcgctcctcccccttccccggccgtcgaggttcgtcccgaatttcctccgccctgaccagaaggggagggtctctgcccatcccctccgccgccgttcgagaacggcaggtgcattgccctgacttcttgcccatccactatatctacaggcacctacggacagcagattcgtatctccaccggaaagcaagtgtcttcgaggcttcatcacgaagtctgagagaccatggaggcgcagacagcattcggagcggaggcacatcaaagaaaacatgcaagaaactgagcaagggcttccatgagaatgcctccacagcagagcgaccagcgaagccttgtagcagtagggttcgcagtttaagtggccccgcctatttgcatggaggacgtacgttgataaagtgagttgatttccgaaaaaaaaacagaaaacgatcctcagtcgcgtcgtagtgaaaggatcctgaccaggggggaaatatcatctagaacagcaataccattgatgacaagaaacagaaagggtagacttcttgaaaaattaattgaggatcagagggaacacagaaaagctgatgcggagaaatgatggactagggcgaaggacgataggaaagagagtgtttcagcggcaacgctgtattaagcattcgccggaaaaagaatgagttttcgagagaaataaatcctattcatggagacaggtcattccttagtagcactacgaattgagatcgagacggaggagctccttcgggtttcgttagtgaccgtaactggcctagacaggtccaactccagactctcgggggtgctccgttctccacgggatatgaacagcaaaggccggagcctgaacgaaaatcgcactaccagcaaacgcgagcgtctgagaagattatgagactttcaagcggtcagaatgcaactaacgttatgctttcacctgttggaaaacaacaccggcagaaacaatcacacaacaaaaaaacgtcgatccacgcattgctccaaacgtaattcgcaggtaggacgacagtaagctgcattctgacgacatgggatttaaaactttacgttagaaaattttcgtttttcaggtttggtgaaaagggcaccttcaagaagagaacacggggagggaaaacctagcagacacagtgacaccttcgctgtcaccggcgaaaaccagcacaagccacccacttccgacttgctgagcaagtattttccaacccgaatttatcgaaaggaattcatgcacatttttgattttccgaagaaaactccttccagaaaactggcaactcggatgagtcagctgacacctacctaagcctgtttaagcatgcatagctttttaaattgagtagggtggtatgtcgtagatccacactgccatcgacaggcagcgtaccactcgggcgagacagctccattctgtgtgagaagatcgtaatgctattttatagggattcgccaggggcatggaacagccactcaacggcagccaatacagaagcttgtccttcagtgtttcgtgcttcgtcggacctttcttgcgatcgacgaaaggggggtctggcgagcgcacggctgcagttgtatctttgcgcgaatcgctagttgggacacgggtcaagcaccacgcaaccgggagtagtttttctgtcaaatcactgaaacggccatgctttaaatgtatccattcgcagtctctcttgttgatcactaggataagcacggggcggaaaagctgagaaaaggagaatgctcccgtgtgtgttggttccaccagattctcgtgaatccgaacctttagatcgaatgcgtcatagaatttccagttacggatcacctgtaatgaacgctgaagcaaaatgaccgagcgcgagtagttgttgctgtctaggcacacaaaaatctactggggatggtgtgcgttgcgtttggtgtttgtcggtgttagaaattgacggacgcaactgaagggtcgtcaagtatactgacttgtttgcagaatttatcctcctactaatggtgggctaaattgattcctggggccatttaagatataagtgacaagagacacgctggttcaactcgtgtctgatcaatgggataaactggaagaaggttattgaatagctccagccattttgtcctcgaacaatgtggtacccaacagaccaccgtgccgggtaactcctgtttgcatcgataaatgggagcccaagtcactcctcgtcagcgaccactatgaagattctgaccacagagttgtataattaagttattttctcgttaactgcggcgttctgaagcctgctcacggttcgtcgcaaaccatgctctggccctgtcgatagcgtctgtgccattgagttgagatggaccagaaaaacaggaaaaagccaatgctgaagtggcatgcaatatcactttgtgtgctatacactgtagtgtccgcacgcatgaaattctacagaagtatacccagtgggcactatggcatcagcaaataatttgatggtgtgctgccttgcctgatcccactgcagtcaagaaatacatgaaaacaggttgttttttgtaagagtcactttggggagacaaactcctaacgcgtaacaacgcagtgtcagtgtcttagtcgtgcactgtcgcgctatcgctacactaccaatccagcgggggtaaaaaaacgtcatgagcgggaactgggtagtgagagatgctccaggagcaagccccatcgatatgcagttacatgtggagcttacgatttcaggatcagaactatttttcgtaccggtaagcgcctgggcccttcagcatttgaacatcgattaagatcataggtgtacagccataactagacacgagaaaaactaattcacggtccgatgtgccgatactcattggtctctgaaggaaggttttatttggctgagctgcatccaatatttgaagaaggatttaggcttctgcctcatcgttaggttcgaggcaagcgtcctgatcccacgacgcaacaatgaatgcatccccacggtgttactgctagagttcccggataggtgttgacgcccctgcagttacggcgtgaacattacactgtgattgtacttccatattcgttgttggcttttagaactgagacgaacggggtttcagatgccgtggcgccgaagtgaaagagagcgcccgtaaaggtgacttccgtgctggcgcaagtggtgcctccgtgacgctctacagagagccagagtgacatgcctgtacgtcatcctgtgattcgtggtgccctaccactcagagatctttacaaaagagagcagctgtgacgtgtattctttttgtcactttcaccgacaggacgttgcgagtgcttcagatttgcagccgggtctgatagggaaagtggcgaatgtttcgacttccgttgcagtcctttggatctgctcttttttctcgacagcatctactctttagcggagatgtccacattgctacacttgctgccagagcaaggatctgcagacctaaagcgcaagacgagtgagaacccacacgcgcggaccagctaaccgaagaccacaagacagtaaaaagtccgagttctagttctccatcatttgaacagagtagaaaagcacattttggagttttctaaaattgaattccctgataaatagttgctccatcacctgagtatctaaaggcacagtgcacaatcggtacttctggtgcaacgactgcggcaaggtggtcacgatgagtcactcgagtgggtagacaatttcgatgattccggtgcgcccagccattttaaaccttgcttcaaaaacgtgacatttcgtggcaatatttgtggcatctttcactgtggtagtctcgaagaggacatgagctgccattttctgccattttccctagaagcaatccaagaagtcattcatggtgaacgttggcaggcaaaagaccgattgactgcttgtctgtttccaggagcatcgatgccagctgtcgccggcgaatacgaaatgaaggagcagttgctggacatggcaccacgttatccttcttctgatttctgtgtggtcttgaacagtgcggaattacatgacagtgcaacgttgtaggagacctacacattaaatcgccggtgggatttcttgtgtcttgacgcggcgtggcttgcaccacctcgctgcgcagctgatggcatggggtcttgtatatggttcatgcaacaacgcaccaatttttcctgtaaggtgttctatgtgtgtatttacatggcgcatatcatcaggattacataacctctgctaccacaagagactgtcgctcgtgtagacttcctagtgactcagcgttgaccgtctcagtaaagttgcccggctggtagttctagcctagaggacggcagttttccttcgtcgatttgctatcgtcatacagacaagtacttcgtctgcatctctatacggactattctgacgcagcacacctcaa

SEQ ID NO: 3994 - DNA, 1827 bp, Toxoplasma gondii
tcactttctccatgaacttttcctgacaaggatacggctggaaaggaaagtccacctccacagagtcttctcgcttctccccgaacctcacgctgccgacccagccatcggctttcccggaagtctcgatgcgccagacactctcagagtcccctccctgcgcagaaggtttatgcgaggaagaagacgaagagactgaaggaggacgaggacagtgcggagaggagagagaagagagacgagtctgcgtcgccatggttgcgaggagagttgcttcgaggtcgaagggtgtttgctgtctcgtttcggactcggatggctgggaacgcacaatacagatttcactttccggcggttgccgctctcggctacaggcaggcgacgcctcaaaggtcctgctgtctcctcgctgcatgcgtttgtagcgtcttcgcctccattcgcagcgcggctggaggcagaagagaaggatacatctgctattttcagtcttcgatcgcctgtccactgggcgggaaggtcgcggtaaatccactggtcgagtacaggtgcatggctggatgagaagactagccgccgctgcctgagaggagacacagcactgtttcacacgcttccaccgcaatgtttttctccgaagttgtccagagatgggcgaaacgcgaatgcaaacgcggccggtgggggcaagaccgccctgggagggtgaagagaacgaacggcgcggaggacttcaacggccggcagcattgaacggattcgacgtcgacgccgttctgctcgtccgcatcgactcctgtcatcagttgactttgccgcgggattggaaggcggctgcatgcaagcgctccaaagtaaaaaagacaaacgctcttccttggagtcgacgcacggtcgaggctccgcagaccggagaggaggcagaggtcgagagtcctcgaagaaaggaggaaaaggaaaggacgaacgggagagccacagacagcgagggcagaggaacgactcacaccgaggggaagggagaggggaagggatgcgcagacggagagaaaaagcgaagaaggaaggaaagagggagaaggagacaggaagagcgcagacagcgacggcagacgacgggtggaggcagccagaagccgcaaaatcgctaggaagcacaagtgagatggaaaagaggctctcgacagatttcgtggacctcgaaagactgaagaaaagaagaaacaggcgacaagacacccgggaagaagggagggagacggcggccggcgcagtgtcgcgcgcgcagacagtttcgcctttctgagaggagtcgtgagaaggtcggcttctgagaaaaaaagagacagtggcggccggcgcttttctgcttttcatctgacggacccagagagagagcctcgtcttgtcgccccccagaggcacacggaaaatgggtgaaaagagcgacagcagcgctgcatgcacgcggcgtgcattgcatgcatgcaagcatgactcgacttgcgaaagaaatcaaaagatgcacaagaagttcgtttcttctcagccgtccgtgacgattcttctcacagcaagattacgagggtctttctttgcctcgccggtggtctctcgctcgttgctcgccgctttccttgctcgacgtccgtcgcgtcttcttttccctgtccgtctctcactgtatcgctctcctctgtccattcgtttgcttcctttctgtctctctccttcctcgtctgtcgctctccactgccgcagtctcttctctgcctttttcggttttttccgacgcctccctctctgcagagacggctgctgtcacca

SEQ ID NO: 3995 - DNA, 3361 bp, Toxoplasma gondii
gttctcgacagatcactcgacttacctacgagctcgccgggagagctgcaccagccgcatgcctcgtcgacatgcggcgccggcgatttggcccactcgcgaagcacccgaaacgcaggaaggcgacaagagagctgggtgcgagatccgcttctctgaagcgactttgtggttttccctcgaagttctggagcctcgccagcgtcggctctcgtcccccgacgacgaggactccagagcttcgtaatagtgacactccttgaggacatgcactcgaccgtgcgtcgtctctgtcgaaagaaggtcccgcgatctcttctcccttctcgcgacgtcttctgcatgctctccgtcttcgcgccactcgcccgcttcgtctctgctgcagtcttcaggggagcgtgtgcctggactcctcgcttgtgctcgctgcgcgtcgcgtccgagttttccttggtcaggtctccggctttgacgtctgggagttcgcacggaggcggagcctctcctccgtccccatgcgtctccacgacctcgacgagccgccgacaggcgcggagagtcgtcgcctcctggtcctaggtccgtccaaggcctcacgccttccttcgcatttcccactccggcggtgatgcatgctgcctgcgccagcgaaaaccgctgaaatacggaggctgccgcacaggtacgcagcgatctcgctttctttctgcgctccccttgctctcctcgtgggacggtctcgtttcttcggagacagttgcggccccgcacacggctcctgcccgcctctgccagtctctcgtccgcgacgtctgaggcttcaccggcttcgccgtggcgcccagctgcgtttcggctgccggcggccgcgcgcggcgctgtctcctgagtcgtcagtcccctccccgacttcttccgcgtgagctgagaactcgaggcagacgagagagaacgcacctgacagcgctggggggacggagaagagcggcgccgcccagacagagacgcaagcgcatgtgaaggaatgagaccacaagagacagcaggatgagagacagcaggatgagagacagcaggatgagagggtggagaggcagagaaggtatgctgggaagcgagacgagaagaccggcggcgggtgagttcattcggcggcactccaaccgcgcaactgcatgcgacagatgtcgcgccgaatcgtgtgctctggcgcagtctgcctcttcgtgggttgtcgccgtcagaggctccagcgccgcgtccagcttcatagtcttcgaggaagagcgaatgaagtggacagactcggtttctgttgctgtacggattttgagtcttgcgtggagccccagcgccgagacgccgcgccggcgtggagggggaacgacgaggagacgacgaaggggaggtagaggaaaagacagaagaagaagagaaggatgacgacgcagaggaagatggagaggaggaaggagaggaagaaggatgccggcgtctctgacgggtcattgtggggagagaaggccatcgaggacgagggacgacacggcagctggagaggctcaggaagaagaggacgcagaaaaaaaaacaagacctcgttttgcctgcaaggcaagaagaagcgagaggcgaagaacacacagaaaaaagcggcgcgacggtaggtcgctcgcggggccttggagaggaaagcgcagaagccaggagcacagagtcgaagatttgaggacaaggaagagggtgaaggagagaccgcgcgagtgagagaacgcagtgtcacgaaagggaactgcgctagaagaaagggaagagcaaagaaaaaccgacgaggagttggcaggaacagcggataaagggggcgaaacgacgactggtcgacaacgcagctttcctcctctgagaggaagtctcggctctcgacttctttctttcgtacacatatgcgtatcgagagtcctcctttttccagcagcgaagcctgtgacgaaaccacccccgcgtggaggagccgtttcagcagaaaaagcgacttcgacttctcgacgacttccggttgtgtgtcgcttcttcgtctcccttttggattttctgtgtcgcggtttcccgagcatttctccttgtcgatttatccgtcgcagctcctctctcctctcgcgttcggctccacctgatgcctctccggttctccttcaaaccgtcccccgctttctcccctggctgggtggcttgtttgccttctcagtcgagttcgtctccatcgcacagaggcctcgagaggcgcctcgcgcgagtctctcagaactcggcgaggaaactggagaaaatgccggtttgggtgggtggaacgcagggagtgctccattcgcggagagcagagaaaacaggaggaaaacctccctttccttcctcaaaaaataaggcgcaagcgacaagcaaacgatccgcgcgggagttccacgcttctgcagactgcagggaccgcgtctagacgcttttcacacatttttagggagctgggaaacctcagcacattgacgcatttcctttggcggttttctctcctgtttctcgttgcgttgttgcgtagcttttcccccctttccatgagcgaagccgacgtccgatcggatctgcctctctctctctgacgagaaggcgttttctcgcgtttatctccttccccttcacgctagcttcctctgctcgcgctctttgctctctcggctgctcttttccgggcgtcttgtctcctggcgcccggggggtagtcgagacgcgaacgcgtccggcctgcaggccggggattctatcgcagagtccccttgaaacgtttcggaaaacgtcagggtacggttgccatatcctgaaaggaaaacctgtcgcagcgaggaacgcgaaaagcgcggaagagtctccgttcctccgcgacagagtgcccgaaaaattgtctcccgttctgtctcctgtctcgagaagactcgcgggccgcgcatgtgtgcgcagcctccccagcgcgtcagccagagacagagacacagtccttcgcctcccgacctcctttcctctttcctcacggcggtgtcttcagtttgttcatgcgaaaccaatccgactccccgttgttttttccgctttttcgaaacgcaagtctgctgtcgcgccccggagacaaagagccacccgtcgggccagatttctctgcacacagcaaaagtcgccgcgcctgcctctctgccgtgcggcgcagggctctccggtgtcttccccttcttcgtctgcgcgttgtttttcctgcacactctgcctcgcgagaccttctcgcttccctgaactcgtccaaactcccaagccgcaa

SEQ ID NO: 3996 - DNA, 2503 bp, Toxoplasma gondii
tacttggaggagcgaagctgacatacttttccactcaaaaagacatcgagatattcataaatacttggacaacaagcatatatacacatgcagagttacataatgcatgtatacatatgtatatatatatatatatataattgtatgtttgtgcacaagtggaggagtggggagacagcttcccgctacatggcttgactggctttctgtttgtcggaatcgctttctggagagaacgaagaaagttcgaaatcacatgttacggaaagcagagtttccacttgttcgaacgcgcatgtcgagccgcagacgcgagagcctcccatgtccacccgctgaggcgtatgtacaccccgtgcagagggacgttgagggacgaaagaggtcgcaggagattccggaaggcgagtctttctctctcctttggacgttcgtaccttttcagacttcttggatgcatccatggcggtcgcagggctagaagaagagacggtagaacttgtttggaagcctgcaacagcagagaggaaacagctctgcgagaagagtgaatgagcactggtcgacaagtgtggagacagcgtcctctctgtctccccctgaagaacgtttctctctctaacgaagcaagcaaagagacgagactgtgaagcggcggaagaaaaacgacggtgagaaatgcggctttcgcggcgcggacaccccacagcggcagggacagagagaccggctggcagttgtcagaagcgaggaaagagagacttgcttcgaccggaaaactgggcgaggagcagagggtctcgagtcatctcgcagtccagagaggaaaggaaggcgcgtccacagaaggctcagcgccgagtctccttccgaccgctcaaggaacagaagacgcgaggcaagaaagtccgcagacaagaacgaggcaagaacagggcaagaaggagacaaatacgtagcaagaacgagacaaatacggagcaagaacgagacaaaaacggagagaagagtcgcttttctctccgtgctgcttgattcctccaaaacgaagaacttcccctctctcagacaccacgggacgacgatgtcgagaggcgtcgccgcttgcagcagcctcttgcaggtccatgaataaagcgagaagagatctgccctcgcagttcctctcgcccagaccgccggaagtcttctggacaggaagacgcgtttgaaccagacactctcgctcctcgctcctcgctccacggcctggcttttcctaccacccacctaccttgcggcatcggcgtcgaacgtggaacgcgactgtcggcaagaagaagagagaaaatcggaaaggacagtgccggagaagcggacaggtcgacagagcgaagaagacgatgaagacactttgaggagagacacagcgagaagaaatacatgcaaaagcttcccctcaaagcgctgtctccatggccggaacggcctctttccagtcggcttaaagaggaggaccttcttcggagacacaacgacgcgaacaccgcaccggcggtgaagaagagaagaaggaagactcccgccagtccttgacacagagacacccgaaagagttagacgggaagtttccacagagaagaagagtgtgagatgaaggaacaaggtctcccagaacgcgttcgaccctctccctgagttaagaatacgcgcgctggggacagtttccaagcacagcaaaaaggagactcgagaaaggacaagtccgcagtttttctgcttagaaaaacgcctctcgtcttcgagccgctcttcgttcgtatctgatgcgcaaaacagtcgaaagagtgaatttccgtagggtctcgacgcgtctgtaccacggcaaagcaggcaggcaaaactggaaagaaacgcgcggccgcgcctctctctgcaactccgagaacgcgaaaaagaaacatcagcttggtctggggtctgtcgttgttgccgatgtacatactcctggcgatcgacaccctcacgcgcctccggctttctcataggaaattcgcttccacgcgattgtgccgctgaggccatcgcctctttcttctctcttcttggcctcccttgtttccttctcttgttctcctcttttgttgtccactcgtttttttcctgcggtgttctcttccctcgtttctctgtcttgtcctccagtcttgttttcgtttatctttttcccctcttctcttgttttctcttcttcttttccgtcgaattttcccttgcttctgcctttccgcgtgtgccggcttgcgacctgcttcttctcgttcgtttctgcgaatcttcagtcgccgccgctgactgctccgttgaggatttctccgttccttgtggcagttgtgctctcggggaaagccgtctttgtttgtctgccatcggcctcttgattcgctcttgaaaggcatcggttcgcgcctcagttgctcttctcctcggactgctttctcctctccttatcctgcctccaaaa

SEQ ID NO: 3997 - DNA, 2581 bp, Toxoplasma gondii
cgactctgcactaccgcggtctgaagagttcgaaattccgtctgtcgccccgtgcgaccgcctcccccccactcgggtgtctgtacacccggcgtgcacaccccgaggacccccaggccaggctgcgtcggcgccgttttgcggtcggagctggaccgtcggcctccacatcggcgagcagagtggcgggaagcagccgaaacatcttccgggagggatgggcgttgtggtggggaacccgacgccgggcctgcgcagcttgtctcctgccaacctgggcgcagcggaagggcacaccctggaagtcgggatgggggaagaacggagcaagcggaaggaggcagaaaccgttgaggtggcggagggcaagctgacgcgtctggaacctggaaaggaggccccgaggtccggaaggcgggatctgcttgtttttcaccggcgttgccaaatcggctgcttcgcttccaagctgtggcacagtggtgggtgcatggggaagcggatcggagtctaggaggacgaccattctcccgcgaagcgctcggtccttccgtgcatgcgcccttccgtgcaggccactggcgggcctggaagtcgggacgggcacgagtccacaatggtggcatggcggtgcgactcccagtggcaaacccagcaagaatcggtcgccaggcgcaaatcgcccggcaggcgcccccggtccgtaggcgttcgaccgcaaggttgccgtcgccggtaagacagaggatgagaagctgaaacaaatggtgtgtgctcgccgccttcgaatgcttgctttcagtcggcagtcggccataactgtccgcgaaaaaaatcggcaatgaagcggcttttgcatccgtcgcagtcaccaagtgcccagggtcctgtgctgcttgggccggcaaaccagtacggagaagagccagaggctctctcggggacgctagagaaatacctgaagcaaatgagtgagcgagctacaagtcggccggcaaacggcagccgccttcaagtttcacgtgacataaaattaccgacggacactgcggcctcggcctcgctggccagacacgtgccgcgggaaatcacagacaaaccaattcggccgagtcacttcggagcggaaccggtgacgcggacatgtgagagtggcgggaaaaagttcttttcctcaaagaaagagcggaaatctagctgctccgctcgccgtgaaaaagtcgcccagtgtggcggcctctgctgcggtgtacatacggcggatggtcaaatgtaggttacctgctgttcgtcaaatttcgcatttgcgcagaactgtcactgcgcggactttcaacagtcatcggatccgtgtctcgcgctgcgaaagggattcaccgggtgttctgtgagatcctaagccgcttctggtcaggaacaactcgtggaaaacgaaggacgccgcgcagctgtccattctgcacctaagaggcgccgctgctgcatcttggatcgatgttgcatcggaaatgcatgtcagttaagaaaaccgaacatgtatacctggctagtgtgcttgcgcgttggcgagcaagacagaaagatcacaagtcaggagagtgcatcgtcgaaataccgccattcaagaggagaagtccgagggaaaaaaatctttgagaaggtccaaactgcaacggttcagctgcgcagctggaattcgtcagccagtccagatgttccttgcagagaatctgtgcgaaaaaaaggtcgggaacgacctcatggcataaatggaatccaacacatattgcatcggccggagcagtttgcggcttcacgacaagagtaataaattttcgtacagcgtttctcatgtcatttataccgcctcctcgcggaaaatcagagtcgtttcttcgtcttcctgctgaaaaagcgcgaacattgtgtcgccggccagcagtcgatgctgcctgctgcatgtgcatgcagaagcaaaccagctgccatacagtccttgttccttgacttctttcactcgaatttccactctgaaaaatgcgtagggaattttcaggtcgctttccggccgttcacgtcgcctggctactcatttcgtgacggcgttcgcgaggaatcgccgtggacaacgctcgccgcatcgaccagccccgcgggtttgcgaatttttgaaatcctgttgccgtccagactcagagtcccaggaaaagcagtcgcagacactctcatctaacgcctgtttcttcacgcagctgagctgagcacctacgcgcatgctaaggatatccttagatctgcttctgtcatttcttacttacgcaggacatcctcagttcaaatacgcttgctccttcattacgctgctggaggcacatccacccagctggaaagccgtccttcgtctgtattctctttgtgactgcctaacgcatccgccgcttcacgtctgttgcttttcctcattccgatgccacctcgtccgcaggttttcctgcgtgtcgtcggtccatcggtcgcgccccccccccccttgtatcctgcctgcgttgcctagaacgcgaaggcgagcacaaatgaacaa

SEQ ID NO: 3998 - DNA, 1200 bp, Toxoplasma gondii
tttttcgggagtctgctgtgtgggaacgacctacttttgatagtcttctcgatcttgaatgaggtagcgtcgaagaactttcacctctcggacattctgttccttcttccagttgtagaagtcgacttttttcagcagtcgcttctcatggaacttcagttgcctcattgtggcgcgcggtgttctgaaatgcctcagggaaaagcgcctgcagccgcatgcagagtttcttctctctgtcagtacttgaaccccaatttcacccttcttaacccatgtcccttacacaggcatccgtcacttctcatatacaatatacatacatatatatatatatatatatatatatatacatatatatacatatatatatgtatatacaggggtgatatccttgatatatgtagatctgtggggaaggagaaaaggaagaagagacgtggaagacagaaagcgttttctcttttagttgagggacgagggcctagaaactctttccgacaagagtggtggcgaacggaactctgccgtctcatccggggctgtcgtcgctggagtcgaaaggtcgttttcagttggagaagtactcttgcgactggaaaggagaaggctccacagtgggaactcaatgagtcaagaaatcttaaaaaaagcctttttctcaaacttggaagcgcgcatcgaccatttcgtcgccctgcgtggttcctctctcctcgaatcgcggcggtgcttccgtcgttcttccgtcgcgctccgagaggcacaaacagaagaaagcggagaccccacaaagggcgcttgcgaggaagcggataggagacaggtgctctcgatccaggagagcgacttgagagaaaatgagtcttcgttgcatggagaatcgatctgttggcgatacttttctctccgcctccggggaacgcatgcatgtgccgacgctgagacgaaggcgacttttctcagaaaggaaagagattcggaggacgacggtgtaagcgggagagaaaagaatatcacactttcgtctttatgcgcagtttgtctcgtcttttcttcgctgtccacggccgttgttcctccatttctccagggagtctccccaaagtccgagagctcccctcgcactgagaatacacctcccggtttttctttctgcgaggagaaagcagacttttcaggttgaccgcgtcgcaaaaa

SEQ ID NO: 3999 - DNA, 2491 bp, Toxoplasma gondii
ctcttgccgctgctgtgcttgaacggaggctccggcgtccttgattttttttatatatctatatatatatatatatctatatatatatatatattgcgtgtggatgtgcatgtttatcaaaaaccacacgtgactggtttcgattcgtttctcagtcgtagccacttcgttccacgttctgatgtctgcaagaagtgtctgcattgctccgcacgaacgtcgctctgtcactggaacttcccggctaagtaccccttttctctgaaacacagttcccttctcgccgttagtatgacctcaaagttactaaaaaccatttaagcacagatgtggggcagggcacttctgagatggaaacagactgctcgctatattcgagtgtttggatcacttttagacattcatttcttgcttgccaacggagtttttctttgcatattcataggaagccgattttcgtcacaagaaacagtttctgcccgggaagaaacactatcgagcaccagtcagcactatgcctttgcttgtccaagaccctgcccatgggaagctagaaggccttgggaccaggaagtgaagtttcttcctacagggaaatttctcgtgcggaattctgttcgtttcactgggaaacgtactggcaaatagcactgaagttatacacgtatagcttgtcaagggtgcaacagaaaaacacactgacacgcaactgcttacttgcatggctcaggtgtctgttctctatgcggtacatcttgcggtggcttctgtctgtcttgtataaccgagtagcagatgcacagatgggcctaattaatccgtgtacggcttgtgcctagttgtctcttgagcttcagcagaaccgtagttcagcggcactggagttagtttaatttaagaaaataatagacaggttgctaaacatgtccgttcttcgaaacgcacttgccttctcgccgtgagtatggtcttactgtactggaagcaccgggtttttctgcaatttgctgttgttgcaaagaagcggcttcgcttgccctacggtttcaaccccttccgcaaaagttttcctttaacgtgtctctctgacgctgttgagaagcatatataatggaagacatttaactgagtctaccagacaaaacgcgctagagtatgtatggagagaaagccgcggacgtgacagacacaacaggactcgtctagttttttgtgaccgcgaatttgagggaatgcatgtcatgtacttgcggtcgtactatcgcgcttattccaaagacggtttgcggaagaaacgaaattagagcctgtggcatttagctgattttaacacacggctttatgactccgcattcgataccgttgcacaaaatgatgaattggcgcagttagtatccggaaactcatccctctgcacagacacgtgagacaccatttttcagtgcgttgcttgggccagaaattaggacccctcggcgtcaagatcggcaagaaagaaagggtttcagtgcttctttcgcacagaacttgtcgaggaaagaataaaccctgcaagggaaagaaggaaatacaggaacgcggctgttggcgcgtcgctagttgaccccgttgcgtactgtcggtgtggcggctggcggcacggtcgcctttttcgttttttccaatttcccgtcactcaagttttcagtcagcttcgttttccctgctgcgatttcgaggctctatcgcccagcttgcaaactgaacggagacggcagacgaggaaaagctgcgttcccgtttctaaagaagcgaccggaaaccgtgtgcctaggaagacgttgcacgtttgtatcgagatatctcgaatgcattttttccggctgctctgggctccatttttcgttggcgagcagcgctttttcgtgtcaaggtgtcattttttcaggctggcaatcccagatgtcactggtggtgtacttggtgtctttgtgagaactcgtttccttgacgtgagcctctggctgttgtgtcgtgccaggtttctgcgtgcttcttcttagctgccgacgcgtttttgcacggtgttcccttcaggtgtttcctgtccaatcgaacgcaaaaggcgtatttaatgcagttccgcatggcgttaagtgagagccgttttgctgtctggggtcacgaaccggttcttgtgcgctcccccagagttgttcgcttcagtgacccaaaggataagtttacccgctcgtttgtgtgttcacttcaccattaaagatgcactgactgctgacttccttcatcagatgcgtgcgggggacgactttttcggtaccgattttatggaaaccaaagctgcctcacgaaatttacggcaggcaggatgggacagcattctttggccgtggagttgtgctagacccagaactaggttccagaaaccactcacgtttatgccagccgagacggagatgcaagtgtgcgaagggaagtggagattcttcgggaa

SEQ ID NO: 4000 - DNA, 3135 bp, Toxoplasma gondii
ggtatgcatttgtcattaacagtgaggagggaaggcaactttaagtgcgatatcgatacttgcagggttgccctatccaccggagtgggtccatcagaaggaaatcaggttcatgacaacggttcaaccacatcaggaggttcttctgctactgcgctggaaggagttagagctggtgtggagcattttgactctgggccatttaaacgtagttggaagaaacttccgtagctcctgcagcaggtgtcaccagtcataaatttgaaacggtatttacgagcatagggcagacatatgagcccctctacaaatatgcaaagtgaatattcagcatttgggatagcggttgtcgaggcggagcaagaattgtgtttggacacagacgatgtgtcagctctggtgatcaccgcgagtacggaagctcgaggtttcggttacggtaaaggagaactgtccagcgctagatccgtacgtggctcgaatcgagcagttacaagcacaacatctgagcatgaacgttttgtctagtcaacacaagttttgctattgtgggcttaaatagactactgccgagtttgatgttcgactgaaacacgatggattagtggattcagcgcaagaggctagcaaacgctgcacagcagaacaaacaacgccaaaggacctgctgcaattaatataaagttctttccacagccattctctaatggccatgcaagacgccgggggtagcctcgactaccgcgcacttacatatattatgcataaaattgtatgtgtgtgtgaggccattcgcttagcaggtggcgtttgttttactggacagacatgggaactgccagaggtacggtttagtacttagtagttgtgagtctgaaaaaggattttcttagtttcgcggtgtggcacatgaagaccgtagtttgacgagttctggacacatcgttgctaacgccagtgccgctgttattgcctatgaagtttaggcgcttgcgttgccgacacagaggtgcatcccttctggttcatttgcgtaatcgccgatcgatcgatacgcaggcacacatgcctatgattcctcccagtacaactgattccgtgaggtagaactgtactgtactcgggaattaagttcgcctgatcaagtagaaggtttgttcagccactggttcaccatcaactgccttgtttcgacttcgtaccgactgtgttattggagcgcatatattacccttctaagagggagttgttcccaaactgtggacaccgttttccgctccggttatacaaatatgacattcacaaatgccacatatagaacgggcgatgtacaggctcattcgtagcagcgaagccgaattatttatggcgtcatattcaggggttccgtgtgacgcacgtgctcaccactaccaagtctttgttgtctggcgtcacgaagtgacataccgacagtgccgcacagaacgcatttgttaaattgctcaatctgtaggaatagtatcgcttgtcgtcttctctagagcatatgtcgctaccgtacacggaatggctagcgacgaatagctgtgcttcctcagtgactttcaactgtgtcttcaactcgacgtgaacattattttgacaaccttaatgcgagggccgttgtcctgtcctgtggtcagagtcaccatcccttcagaagatcgtcccctacggttccagttttgcttagcaccccatccatgatccacgctactttcactcaacacatgagaagtatttttcttcctttctcgaagcaacttcaagaaccgccggagcagctagctcgaaacgtggttatcctgtgctgggcgtgcgatcggagccggctgaagtccacattgcgacgagaaacgtcggtggaggcaagtctgtggcacgaaggctaatgaccgggaggacgaggaaaattaacaccgataagcttttcacgatgtgtgtttctggacgaagacaatgaacggttttctccttactttgaacggttgcaatatcgagtatgcgatgccgcgctcgagtagcttcgttcagtacacagcttgctggtgggccagcctacactgagatgtttgactggattctgccgatgtttgttgaggcgttgttgctcacccaaaaatttcgtacgtagtcctcactgtccatggttatgactagtcatgtgacaagaagatagcattacgaagataacagatgtttcttcaatgttggcatgtatcggctgcttggttaccagttacatagcgcgccttttgtcagctttttcatctcttttcctcatgtgtgagaacacgaatccgaagcgaaactagggcgtgccgttgatttttctcgctgtcggaacactctccccacacatttcctatcgtccttccagatgcttacttcctcaccgtcgatagtggttgcggttgcctttgacttcactcccctttgctgttcacattgcgtctttctccgtcgcgttccgtttggtctgcttcattgtcaagaagtaagtctgaaagcacctccattgttgcctgtctgcagtagagcccagattgacacgcaggaggtccgcgatacaaactgcaggcatgccggcaggaaagtgacttcgatagaagttgttcagttactattgtcaacaaacactgctttttgtggctgcgtttctcaaggaaagggggttgcgctcgtaactcacctttcaggcaccattttcaagcaaagctaattctgcaatcatgaacagctgccagttataaagtcattgtaatgagcgtcgaaaaattctcgaggcgctccaagacgtggccacaccgacttggttcgcggtatctagttgaaaaggaactcacgaacgtagggaagttgtttttcggggcgcgttactgttcttcgtgcgaaccttaaccacttcacgaagacatttggagcacattgccaaacacatcaggggatttgttggtgaaaccagtgcgaaggtatttcgggactcgaaaaattgtcctgcgcgttcgtatctgaagagtatctaccagcatcccggtgtggaagcaagaagagtgtgaaactctgtgagagctctattggagttattttcgtgtgccgcagcgaacccccaaa

SEQ ID NO: 4001 - DNA, 2058 bp, Toxoplasma gondii
gtaaagtacacaatcatagttgcagtttcttgtggtgaacgcctgtgcaccgtatctctcatttctctcgcatacgtatagaggcccattgtagcggttagttttcgatcgacactgcttcaccgaaagatctcttcaagtgcattgtaacgcacccctcagcgtgtacatctggtagcgatgctaggtgaaaacagagaaatagtgacaatgtgcagcgcagaaccttgcgtcttatacaagaacctcattcatggggtttagcgaaggtgtcaacgtgtttgaaggctagacaaatagttaacgttacttttgtctgtagaggggagtcgactaccagtggattcgtacttccacgccgtccacacgaaccttaaaacgcagttcgagagaaccagcaacactgccgtggatttttcaaatcgcgagagcgattcttttgtatgtgtaccggtggccgtagacggaagctgtctggccctagaatcttgcacccctcccgccaagcaaacgtaaccccgacaaggtgcgcctcgccaccattttcaacttgagacaattatgcaatcaatcaaaggggcagtacgtttgtaaaactcaatcacttagccagtgtccgtcctccacaggactatgcccttcactacagcttcggctgtcctacactttattcaccgaagaaatacccaggaagtaggtagacacgattttacgctagtccttcctacacggagagattctaccttctggacacaccattcgtccgacgaatttatgtatgcgggtggcaatcttgattcattatgtatcgtccaaggaatggaaccgaaacctcgtgtgtttgcactgagaatacccgcctctggttgcagcattttggcttcgtgactttaatatggagcagactgtaatacttcgaaagctcaaacggttcctgtgaaagaatgaacatgcgttctgcctcatgttgtgctgccctaaactggaactggaatcttacggggtaccttgacaatgtacaggatggcccgcgatccactcagtgcgctggaaatgatacgaaacagagtggaaaatgatgatgtgcagagtcttagcttcaggcgacgtgctttcagccacttggctaaacgaaaagatgtccggagtgcgagcatgcacccgaaaaatgacacacgcagtcaacgcgggacaaacgtgaaactattgcgagacgccggactacagcgacgctaatcgtcttcgtttactatgtgcctcgggaaaccagctcccttcgctgaggttgtcctgggaaaaatcgaaagtagctagcctacactcattaagtgaatcatttccttcgttcctaaccgccaaaggattgtctcgcaagtctttttttttgcggacagtaccccctgccttcccattttctcccgtccttttgttagctggcttcctccgcgcgctgcctcgaaacgaaagagacgagaatgggtctttctccagtgaagtgatgccttcacacattcgtctgtgtgcagcacgaatatatattcgacaaattgctccgaaacaccacctgatacacgtcgaatatttctgccattttttcctctgtcagttcctgaagttcatgatatggaaacacttgggcgctcgtacgaattcacgctacatggcgagcagagcagtatacgtactttagaaaacatgtatgctaaaatacagccaattattagcatgtatgaaaattgtattacacgtgtctgagcctccctgtgttcgcatgccacacgaccgtatgtaccgagtggctaccaatttttcttccacccgctggcgaatcgcagttttctagggctcgattttttccgtttgtctttgcagtcgtcgtcggcggcactgaaaaaataacttgttctcggattctcgggacagaagactcgatttgttttttgcgcgtctagagccgaatcggactcgggagtcgtgacccagtgtttgaattatttttccctttctttgtgatatttctactcctcggcgttccgtcggttgtgtgaagaacgacta

SEQ ID NO: 4002 - DNA, 3768 bp, Toxoplasma gondii
acctgttgccgatcctctcaagtaaggctcaaatctatggctgaatctgaagcgctttgttgtcggctgaagttggagacttccgctgggcttctgtctttgccaaagctgacgcctcggtttcgctgcccaatttctgctttgtgcgatccacgcaggtgcacggaccgtggcgttccactggaagttcctctatggtgctttgtcggcaaatgtttccagcgtaggtttaccttttacacaggagcactcgtagagaatatctcgcgtcgtttggcgcttgctctctcccgtgaaaaatccgtgctctcttcgggtcgcacggacaggctttcggtctctgtcgcttgcttccgtgtagaggcgagaagcagttctaacgttttctggcgtgtgtgtaatgactgcagccacgggggtaaaacgacggactgtcgcctcccatctggtggtttgaaaggggctagagacccgctgaacagggggttgtgtcttcacttccagcgtctattcactcccggtgtctgataaactcatacagttggtgtccgtcagggaactgtgagagccggtcacgctcttcgccgcggaaatgaagttgggctatacagtccatctcctaaaacaaaggttttaacactctgtactggaccagctggtttgagcatgaagccaggcgacgcgtacggtcctacgccaccgtcacgcgcaaagaccatgcttttccacacattgcatttctcatcccttttccattccacaggtttctctgctgaccttgacagcgctcgttttcctcgcgacgcggcgtaagcagccgcgcgcagcagccaccacaccaggtattctggcagcagtcctcctgctcctcccgtttgtcaccaggtacgtacagctcgagaatctcgaactgcagaggtggacagtcatttgtagcaaaagtcgctgttgtttcgtgctcagggaagcagtgatgtgggatacgtgaacaagcgtgtgcgttcgtacgtggacactgaaggctacagcatgtattccacggaggtgaaactgtatcccagttcggcaatgtgcggctgtttccctcttggccccgtgtgtaactggagggatttactgtgaaacctgattgttttcgttagcttttagagaaacgcctgcttgatgagaccgcttttcgacgggactgagtgatgcagcgtctcgcgtcgcttctcgtttccgtaagggccggcgttttcccgcggttgtttctgcgtttcttcagccggattattgtcggcggcaccccgtctaccggccctgctgaaagtccagcgtggtggatacaactcgtgcttcatgcagccgtcagtgcttctgttgcactctttacgtggcagctgtatcgctctcgtgcagctaaaggcacaagctcccagtctgcctccacttcgcaacagcaaggagggggaaatggttccacgtatcccaagcgggagtgatacgaatctgagtatcaagctgttgaagatgtcgaggtcaatgggccagtgtcaccatctcgtggacaggtagaagatgtcacgacacagtgtgcgcgggacgctgacaagggaaggcaacgcgcctcggcgacacaagcatcttctggcagtccactgagtcctgaagtacagattcgcgaatccttcgaagcgttcttatatggaatgcgccggagcaacttcacaaaccattgccatgttggcatccattttaattcgttcttccgtttgtcgcatgtgccgggcagcagccaatcgatgactgcgcaacttagtgaaagccagttcatccgtctcgtttaaagggagttgcctacatttcttgaacggtggtcttagtttccgttggttgctgctctttcacgagtatgcatgcacgctctagcaaagtagcgacaaaagtggaggccccatttcatccgggtcgcacgtaccgggcgtccagcgagtttgtgaggtggagtctgagtggcggaggcggacaagttcggggcgcgccgccaacggcactttacacaagatttcccgtccatctgcagggaagtatctgttgtatcgtaagtcgtaagtggcaatatgtacaaggttgccggctaccggccgtggtcgggcggcagtctcaccttcccgcatggtggtttgcacacaaaaacggtgtcgcctcgcgttgtcaaagttctgaaacgccccgcgcttggcattcttggtgcacatggaattttatcgccgcggccacgtatcgcactgcttccttcgcctgcaagtcgacatccctctgctcctttgcatatgtacaaggaagtggggatagactcggtaggagccagcgaagtccacttcagtgtgtgaatccagtaaatcagtctgtcaagaatcgagggactctgagcaggtgcgcttccgctgtttgcacagtacgggcacttcgggccaatttcgcgactgccaaacacgtggacggcgcgactttccgtaatcagacacgactcgtggaataatcatccgggctcgcgtgtactgagttgctgccgacagctgtcaaaggcagcatgcgaccaacggtcattcgctcggtgtgtcgtagctactttcggaaagggaagaagcaattcgtatttgatcggttggctaggaaacgcaacaccctcaacgatcattcgttagttcgtactgacaaagagcatcagaccggatctgaaggtctcccacacactcacagttgtcacttatctttcgtttcccaagagtaaacgttgtttccctgcgccgccccgtatgctgacgcgaaagtgttgtggtttgtaatgacatactgtgagacacgagacgcagatacgtgagatgcgctggcaggtgagctgcgcgcacttgggatccgatgcagtagctgtccgccccagtaattctatcaccctgatctgccgcggcctttgcggtccgtctctgatccaaggcgagcaaactcagcagtgcctggacggttcagaacaatttagtcaacgacgattccttcgtatttgtttggtatgtagcgccctccgtcccggtaatgtttgatcagtggctcatggctgcgatcgcggctcccccttctgtctctcagggctcctgaaatgctgttcttccgcacgtccagtactgttgtggtctggcggaattcacaagcgtctccgcgacggtgtttatttgatgtaagacacaacccaagtgttcaatgcgtttgaattacatatgtctggcatctctttttacgaaaagaattggcatgtttgcaaagctcaggcacgagagctccgagctcgagtcaaattcaccttgagcctttttcccccttgtgactgcttcgtagatacgcgagtgtgcggaaagcggtggtcgctcgtcaacaagcagattgtcaccgatgacagcagacacagtttcgttggcttgagtgtgctgacttgggaatttcagtgtccgtgggcgtgtttgtgtggtaaatactgggcggctgtccaatcataaagctggaggtaaaacgccttaaaacggtgggtttagccatcgcatacgcgtcgcggtgagacacacctacgtaggaaggaagaaaccgtcggcaagttgctaatcctgaaacctaaactcctgtaagtgacatgacggccacaaatcaatattctcaaattgacggcacacatggtctgggactggcttctcttcgttcaagtcaggtatgactagctgacagtgaaagtgccga

SEQ ID NO: 4003 - DNA, 3545 bp, Toxoplasma gondii
cacagcagagaggacttgcgagatgtaagaggaactgcggcgacaagggtgcagggaaaacgcaagaacacaaagtcctctcgcggtgctctctgcagagagaggtcagtggcgttttcgtaccctggcgtccttagtggaaggcggaagttcctgaatcggcagctggatttcttggtcgtcttcgcacggttcctcgtcgtcgctgtgccgtcttccttcctcgtcgaatcgggagaacgcctcttcctctctcgccagcgcctcctcgcctttcgccgctgcgtcgtctggctgggcgtccgccgtcggatctgtcggactgagggcgtctcgcgccttctgtcgagagacctcgagttcgtcgtcttcttcaccgaagaggtcttcgtctctgccctctccaaacaagtcgtcctccgcttcgacggcctccggctcgaggtcctgcgcttccggtctcctctgcgtctgcggagagtcgtcagaagtcgcttcctcctcgcctgtgtgttcagcgacagcaggccatgcaccgccgtcgagaacctctggagacgcatgcgccgcctcttccatcctgccgcaggttcccggagagcgacgcgggccttgccgggggtgtacgtacaccccagcctcagtgcggctggcggcgagcgtctggtttcgcgggtgacggcggctgaacttccgtcgcgcaagcagtggtgagtgccgcgatcccctcaggtttgctcttcttctatctctgcgcagagctgtgcggccgtcgacgcaaggtcgcttcacggcgatgggcagcgttgagtctccggatgccgttgacgcgtgtaataagtaaactccatggagaaacggcctcttcgcggcgaagcgtctgcggaacagaccacgaagcacagttggaaagaagagagccagtcgggagacgcgtctcctccgccgtcggcgccggtcgcggaacagagaagttcgcgtcgaccaggtgaggaagcagcggcgacgtaacaccagaaagagttcactgggtggatgcctgaacgctaggacgaagccggaaaacgccttaaagcgttcgtggcttcttccgaggaaaacgcgagaaagtcgcgcgttgctcagagacttttttctctctgtgcatgtgcgagaagccgacccgctcgccggggaagaattgctggaaaaagcatctctcgagagtccaagagtgtgcaagaagttgttgtgtacgcttcagcagaaaatcggtcaaaatggagtcttggagaacaaaggtgaaacccccgaaggtctgcaacaagcagtcgagcactgcatgcaaagactgtcgctctgctccttccagggcgctggtgtggcgcccggcgcttcgtcgtggagaaaagatgatttttgtcacttacaaagaccgtgtctagttctcactttctctcccttcgaaaaaatctagcttataggcagaaaatcgactcgcaaagaactccatcagcggtcgcggacgtccgcagaaattctccgagtttcgagtctccgcccgccgcggacatcgcctcccctccctggagtccggtcgccggccctcgcgaaagcgtcgcacagtcttcttgattgctggcgttcgtcgtccccagtttctctctgttgttcgactgttccctctctttcaagtttggcgaagacacgggtgacagagagttccctacggtgcggagagctgcacacagcagctccccaggcgccgagtctctgataaacgagagaaggcgagagagaagggagaggagcgcagagaaagaaaggacggggaagacaaagagagtttacctcggatacgtccggcatttcgcgccaaccaccgatcagaaatgcagtgtactaaaagcagttctgccgacctttgaaatttgattcgtaataacccccttcgacgagtacgcgggatgccgttttcgcggacagcccgtgaacaaacgccctcacacgcaccgggcgcttctcagcaattccagatatttcgttaattctctcgagactgcctccttttcatccttgcacaagcgtcgctatcgtcgcaaaaaacagagctagcgggcttttttttctagacggcctcgtctcgtcctgcggagttgctgctggggtatttgtggtcttcgtcggttacgtgaatccagaaatgcttgtcctgtctcttgtatctctatagctcgcgacgtacttttaggatcagagcgaaagagttcactcatggcactaggacgcagaagaccgcgttagtttggaaaggctttcaaggtcctttctcttcttccttaggagcatctaaaccacaattctccagatacatccaagacctttagcggactccttacctccgtttacctcgtaataaaagactttcaaatgataggttccgagaaagacttcctccagcggttcaaagactatataattacctttccctcttaattaaagactttcaagtgctaggttccgagaaaaacttcctccagcggttcaatgactatataattacctttccctcttaattaaagactttcaaatggtattgttcctggtggacaatcaaagatttcacgtttatggctcgtggtagcgacactggagagtgtgcgccgtgagacttttcacctaaaattcagatgcagatatgtctcgattcggaggggagaaaaggaggccttttccggggagagtcaaggcatggcaccttcgttggtggattcatgttcagagatttcagggtgctcccgatttcctcgcgaacgtagcctgcgaggggaagagacaaacgaagaaacgccttagccgcatgcagcaggactggagacgcgtgccgctagcgtgaaagaggagacagaaggagggagacgaaaaaggaacgaactgcacttttttgcaagcgtcaagagaataaggttgtgcgcggtttttttaaaatccttttcggtgtgtcaggggattacatgatttcaaaagagcaacgaagtcgaagagtccacgcgcttctgagctgcaaagaggcaatttctttgtctgcctgtacatctgagtctccgcgagtctgctgtctcctgtttcttgagaattcaacggcgaatagaaatacaaatgaaaaagcgtacgttttccctggagaaaaaccggacagagaagggcgtttgcctcgtcacagcatgcccggtcgcgtccgcgcgacaagctgtctccttttcgcgtatagagaagtcactgttcaaaagaaattttttcctccgtggaaggagctttttctctcttgggtaccgtctctcggactgctggtctcggcggaaaggcaccttccttgtcggtttgagggcgtcggacgtctgcactcgagaaaagaagtttggtctacagcagcgacgcctgctgttagtgtttcttttcttcggctcttttctgtgagagttctgcagcagagatgcaatgcgacctgcatgtttctgcagttttcctgcctcgcggatgttgaacagttttcgactcctcgtcga

SEQ ID NO: 4004 - DNA, 1932 bp, Toxoplasma gondii
ggcgagaggaagttctttgagagagctcaacagaggagaacttttccctctctgagtctttcttcgtgtcttcacaagagttttcacacgagggtaaacagggaaggccgatgacagagaagacaggatcttcgacgagagcagaagacattctggtctttgtgtcgaaagaacagacgctctcagaccactgcagttcttttaaagtgtgtttcgcaacttttcggagtggaagtcacgtctgttcttcttctgttgttttgattcgagaagccctgtgaagccttttttgacgagaaactcctccagcagtgtactttcacaggcttgggatcagagctgaatgtacacagactaggaaggcgggaggttttcaagttgaaagatgaattccgatccaggacttgttgaaatataaagtggaagggcaactgtcgggagtactcctttattccagccgaagcacagaagcgcgaccggagtggagagacgaggactcgcctacggcgaagctcacggaacagctctgcttttctccttttctggagtccgtacagatgcctgtgaaacgtcatcacaactttttcttgacagggtatctcgttgttcgccgctcttcccctcaagctctccacgcttgttcctcccagccaggtccttctgtgtttctctcgtactctcctattcagtcaccctgtgaaactgtttctcgacacggagaagcgtcgctgccaagtgacaaagaggattcgttgactttctcctcgtattgccgctgcacaggagaaaccgactgtgaggaccatttccagcgagaaaactggggaatttctgcgcgttctggacccgcagtctccagcgagcatagcgcaatttggttgcacacctcttcttgttcgtggtgaacttgttctttttctcgtttttctcgtcctcccgtctcaacagcgacgctgtaaattggaggtccacaggcttcctggctggcgcgacacagtggctcttgcctgggacttctgcgctttctgcggggaaattgcttccttcttcttcgagaaagggcgcggctcgtttcgttcattgcctcgaaaacagaaagcgtttaacgcgaaaaaaagaggaggagagagtcgttgaactgctgcatctgcggcctttctctcgagagggtcacacacgcacagcgagacgctgaatcgctgtcgtttgagacaagcgaggatgaactttcaattgcttctttcccccggactctgcgatttctttctttttgcggcacagtcacctgagaaagtcgagaagaaagccactgccaccttgaaaaacgtctctgttttccgttacagagaatcgatttctctctgctggctgtgtcgctcttttcgcatgctcaacctgctttccccgcggtttcccccttgccgtattgcgacagttttcttcttctttcttcgtctttcttcgtctttcttcttcttttcctcctcctttccgtcttgtgtctgctcttcgagaggaaataactcgaaagaaagcgctgggcctcttcttcgctgctttttttctctggtcgtctttcttttctccagatcctgtctccgctcgtttctcctgacacacatctctcctgctttttctctccctactctctctcccaatatatatatatgtaaacgcatatatctcctccggcttttcttcctcctctgtttcggctctctccttcctctcctttcttgcttcttcttctcctctgtctgtttccgaaactcgtactcaacttatcgctgttggcgtctgcttcctcttcttcctcttttcgtcccgcctctcccctcgccttctgtcttgtctcctgtctcgttttctgtctcgtcttcttcgttttcttgcccttttttctggccttcttggaggccacagcagacaaga

SEQ ID NO: 4005 - DNA, 3734 bp, Toxoplasma gondii
agcatctgcaacgaactgctgttgattcgacgctattcctttggttcgtcgtgtaataaactccactcctcgctagtagtcaagttaggttgtactgaaagcccgagagcaaatacatacatgacatcgctgctctgttcctgaatagcgacaaatttgtgacttcgtgaactgtacctgcgttgaccgaccatgaaatatgtgacagaatatgttcaggctcgtgaagcggctgcgtgttggataactctgacccggaatgacgcagcgactgccggctgacggacaggctaacagaagtttgagctgagccgggtcatacacctacaggtggctgttgtgtcgtttatggatgcatgtggtctgtattgatgaaataataattcagaatttgtaactcaactgcttggaaactcaacatcccacttgcggcagggagaccgtcacagtactatgtttaaccgcagtttctggttattgtcgtcacaacagattttttgtggtgattatgtgaaaacattgctcgaaatgattcggcatataaatgtccttcccggccatgcccgtagtctgaaaagggattagtgcgtcttccctggcacctctcttctaaggcaagtccatgctcttccagctcgaaagaggctttttgtgcatccagtcctcaaaacaggtagccatgtgtcgtaagcatggtcgcagttcattcagacaccttccatgctgttcctttttaagaatcaggtgtcactgcagcataaagctgtgcctttcgctggcattgcggatcctgctgcgactagagatgtcccgagagaaagctttcgagcaacctgatatcctccaatgtacaactccagtttgtctggaagaagcaaaagctacatgaaaacggaaaacggaaaacgcgaaagccctaccacaaagatggtaaccatccggacacgctgttgaggcttcgtctttgctgaaacccaaaaacggacagtcacagtcagcacaacaatactgacgagcttggcgcttacttgcaatcgaaacagccaatgtgaatgaatgacggttcaacccccgctagcgatattgaagctggtcttgcaggtaggtttgtctcgttctactacaacactgtcgtctcgttgcttaccctcagcctggatactatcccttcctagtgcctgcatgtggtcagagacatgcggaagcagttaagaaagaagcgctgaaggtgcttacgtaggaaaacactttcagttcatctataaggagcggtacatcgcaaacatcctcagcgtacggagctgatccgatgtacattggcaagtcatttgttcgcgcgagacctgttccagcagcatcgtattagagtattttctgcatgaaaaacatcgtcgcgagccttaccttgcgtcaccattgtacagtctaaaataccatcaacgtaaaggtagacacggttcatgcggcggaccactatgtccaacgcattcttatgccgatgaatggatagataagaagaaaaggcgatatcttaccagcgatgtgataccactgatgaggcttcagtctcgagttgctcatcatctcctctcccgctgcacaaacagcattaccgcgtcctcacgacaaacgaatctgtcaaaggtgcctacgagtgtccgggttttgtgatgtagcgacaacaaccttgattctgccttcctgttcacaacatagcgcacttcatcagctgcttctactgcgtgggagtgccagcacctgtcagcatacccttgggttgacgagaatcgcaggagccgcctcctggacattctccctcatgacaccctggaaacgtgacagtcatttcaaagcaagagaaacctggggcggcgtcattgacgacacggctgttaccttgtggagcaacgggcagaactggtcatggagaaggttgttggctctacagatgaaatgaactggctttttatttgtgtgatcatcggggaaaggataccacgcaccgcgactctgcgtcctcaagtaagtacgcgaagaatgtgtagctaaaatctgcagtctgtaggccgtctgcacttgagacgtagatatagttccgtcggaaaagacccgagctgcctgatcctcctattcctgttgccgccatcacctcccccgaggcatgatttcttttgccactttcgtcgagcggcctcacactatcaaatgtgatgtgcagttcaagtcctgaaagacacgcattctgaatggagataatatcaaggaggtttctttaaacttaccatacggctgcgcgctgggaagcagaactttctgctccccgtgcaggcaaagggcagactcaacggccacatcacaaactgggtatgatgtgaaagtttgctctgctctgccgcgtccaacaacagcgatgccgtaggaggcaacagcaacaaaaaagcacaccctcatcgtcgtatgctacagaccgcctcagtatacagtgtggttgagacgaagggaggtctagtgtcgaccagaggcatccaatttgttgtttaactggagctcttggccacaagcgtctgtccatacaccagaacgaacatgcggctgatagggagcattgcaccgaaaatggacagcgtcatttctctggctctcttaatataagactttatttccgtcgtgagccgaaatgcttcttcgcttagcggtttgactacgaggttctctcgaggcaaaacaataatgcccgctcctgatacactgctaaatacaccactgttccttatctgccatactatttgaaaacgaatctttcccaatactgtgccggatagctactaacaaccagctgcagcctcggttacagaaaccgtttttcaacgtggaggatgctgattaatgcgttattccgcttgctgctctgtcagtactacaccgtctcctgtgcaactcaaagcaaccaaattgaattatattcatggttgttcgtccggtatccgtcaagagaccactgtcattatctatgagcatcgatcatacattcaccgtatcatgccttttttcgcgctgcggaaaatcaagcaattcagctagttgaacgacatcacaggtaggctgtctaatccagcaccccccggtgaagacacctccgatgagagcgagcgcatgctggaacggacgacgtcgatgcatgcgactccgtttcacactgggtccacgtccattttttccgactcacgctaaatattaccactttgttcttgttgaacggtggcgatgctggtatgcacttaaaaattcgtccttaggagtcctctgagagtgggaagcggggtcagtgacagttgcgttgtcgttctagcttctttcagcccggctgttcgacagctgcccttggaatgcgagccagacagtgtcctttaccagtactgcgttgcagaactgccgaaggacaaaagcgtctactggacaagcagacggcgattaagtcgaagtttttttttcagcaactgagaaatgatgtctaaagggtggccgtgccgtcttccatttccttattggcccgtcgaatagtacgtctgatatggtggtaaaacggcaatcccggaaacggtcttgagtgactaggtcgtctggttgcgtacattcttttggcaccggtagccttgtgttacggcgacgggttacggttatagactcgaccgtggacaacatgctaatctgagatctcaactcggcgttcaaaa

SEQ ID NO: 4006 - DNA, 4000 bp, Toxoplasma gondii
cagaagagagagcagagatcccgagaagagcaagggacgttatccccctggaagggaggaggaggaagaggacgaatcagaaacggcgatgtttacaggaggttccagaagggcaacattgccgtcgagaaaggattgcccgcaaacgcccttgtttgtattctggaaaatgaactctctctgttctcgccgctcagcgcgagtcggcggagagctgcgatggcgaccgcttgatcgcggacagcagctgtggcctcccattcccccaaaatgtcgatctttgcatgcactgaaattcaacgttgtgtcaacaaggaccacagatgaatcgtgtgctcttccttctagcactacgtggactcccctggcttctgcctccacagtaatgttcactttgagttgccaactcagcagtcttcacctccgtcctgggtcatgttcactttgagttgccaactcagcagtcttcacctccgtcctgggtcctgcaaacacagtggctccgagtgctgccgcgcgacgcggatctgctggccctccaaaaacgacgcaggacaaaaaaaaagcatctccggtcaaagagaaggaagatgtacctgcgcggacagcccctctaagactgcatatatgcagatatatcttggatggttcttcctgcaaggcgcttgtaccaccaagatgagtcagcgaaaacacaaggaacgatatagacgtcgtacgcttcgtctacacacgcatacctaaatatggagatatccacagattaataggtagataagtaggtaggtgggtaggtagagtggcgatgcatgctcatctaccgattcatggtcacaaccagggacggcggtgaaagagagtagacgaaagaagctgggagaaggcgcgtgcgagtgaaaaaccttttttcgcgaggccatggccagcggaactggaagagctctcgcaaagagaagcagagaaacgcacactttgtggtggaaagagagtacaatagagagcattcatttgcatgaagtctggaagaaataaatgcaaccgaagaaattttaaacagattcgtccttgcgatttgaaacgcagtgtgcaactgctctccccctgcatatcccgttccttgactgacctagcggcgcgttttaggctttctcaagggaggaatgcatgaagcgaaaaggagtggcatgcgaaagaggagctgattaaatttaagtataaatattgctaaattcactcggtggtgccacaaacggggctgcagctcgtaggaggtcccgaacgcgctggacgctgaagaaaagcaggcgggcgggcaggtagctgacgtctccactgaaacaaaggttcgggggctgagtctttcaagagtatctttagaaacgcttaataacaatcaaaaacaagggatgaattcctcaaggagacaacggaagcgcacgaccgcaagagtccgtcaatgctaggggcggctcatctagccgctacaccagaaacggcacagtgacactggtaaggattggtgaggtcaaaggccactgcagaactgaaaacgcaaaatttcaaagtgaaatcggatttacagcatactgaatccgtccgaaactatgtagagagggaagactgcctcctcgtgaatgtctgcatggaggggtgtgtctgtgtggactcctcctctaagtctgtgtcatgtactgaggagaaactggaaaggaatcccagcccaagtcatcctaattcaagcggaaaacgtagaaagtcgacctgcgtggagttgagcagggttctagtttggtagatgatgaagcggcgttatatgtggatgcagatgctcggggccctggagataaaaacagatgaggaaatggaaacgcataccgcagggaggcagtgctgaagaaccgtaggtgttttgtctggcgaggctggaacaacgaggaccaggtgaacggatgttgaaagaactgctggaaatgcgtgcagttcacagcctccgaattgggtgtgtctgtcgtttaaactagccaagcgcccgggaggctcacacttcaagaagcaaggaggaagtcatatatacccggcagattttttcatgttcgtgcttgccctctaagagggcttcagagcaatgactgggctacagcttgagtgaatgtaagataagttgaatctgcgaacagaggctgccgtacagagtggtccgtcatttcttcggatggaatgactttttggtgtgtgtcataagcgcattgtggaacgaagcgactcggacgggctgtcagtctctatcaaggccgttcacgtatatgtgtgtagggcagaaaagccgaaatctcaatgttgtgtcgttttaaagttaggaatggagcatccccaggggagaccgaacagcccggtttcatcaaaagagggtcacggagttcctcaccaggggaatcatgatcctaaagatgacatgtctcaaccttttccggcgcaagtcttaatgttttctattcagtctgttgccagagaaccactccaacgccagctgcctcctccatggaggcagagagtgcggaacggggcttccctttactctttctaggcagcacgctccagcttaaggaatgcacattcggtgcgatgcctacttcgaagatacgacggactggatgtgatgttgaaacgattcttctcattttccactgtagcttgcatcagtgtccgttatatcaggacagctgtacaacacaacctcgacttaggtttttgcaaccctgcagttgcagatacggtccttgaaactaccttatactatcacaggctaatgacgaatgccgaatgtgtatgtgtgcggggtagaggaaaatgacggatcgtatcgttttcgcttttcacagactgccgcggcctctgcgagacgagcggagatctgcaacttgccacagtcctcaacaataaaaattgctgtcgattatctaaaaacatagtgtagcatgcagatgtaaaaagaatcggtagacgcacgtttcagcacaagacaaaattgaacttggaaaacacatcacttgcgggagaagtcgccactgtggcaaacgcgctacacaccatgtgacagcagtctattcaatggcaacgtggaacagcaaccctggagttcccacacacaaagaagagcaatccctcgtcgtgtggatttctagaaaaagacaaaaagtagtgaaggaatattcaaagagagaaaaccacgtggagagtcgcgcctcccctctcttctcgacgaacgatcggggttggcttccctcacctcaacaacgtaacagaatgatccgccttcctttccttctttcggctgcggaagagtttagggcagcatcggtttcacgctgaaaccccagaaatggcgttttatgcaagctcctgtggcttccctagcacagccgataggcggttcttgcatgcaacctgcacatgcatcgactctccacacgtgtcttcccgtttgtttcccgggaaagtccggagatgcttacctgtttcctgttattaagatgatttcaagacaagcatttcgtgttcattccacagtgtttgttggtttttctttccggagacggcttcctgtcccagcagtctttcgtttgaactcaattcttgtggagcacaatttcgtcgccgttgtgctgcgggttcccccgtggtttttgcccgtttttctctttgaacaaagagcaagatttcccctttgaactgcagcggagttcacgtcccccgtcggccgcattcagttcacttccagacgacgcccccgactccaagtccttgtctctcggctttcagtcggcatttcagtcggcatcgcccgccgcgcgtcgtcacctggtgtctctttcccgacccgtcgacaatttcgctaaatcctcccgctgtttgcaagggtatcggtaacctgcgcaaattcctgagcaacccccacgccggttcgagttggaagtcgatttcttccatagcctgtgcaaga

SEQ ID NO: 4007 - DNA, 2521 bp, Toxoplasma gondii
atcccgagacaaaagcgcagacgaacgatgtcctcttctgttgcagggccttcctttcgatcgcgaactgcacgatgaatcgcctccgaaattcgatgataagccgctgactttttgtcctccaggtgagaattgcacttgctccacgggctcgtgtagctctctgagtgaaaaaagggaacacgaggggggggggcgcttgactttccgcagactacaaacacctcttaataatgcatgtaacacagtggccacggcgggctttgtacggcaggcatggtgacttcgttgtaaacacccgtgattgggggttcggaagtcgtttttcgagagtaaatgcgatcttcgttccagaaacagtaggttcagtggtagtgactcaaggtatctgttctgcattcagcagcggtctcggtccaggagagcttcggttccgcgtggccacacgaagaaccgtcacacacgaaggaagaggcacgaaacacagcgtcgcaattgagaacgcgggcgcaaggacctcgaggagctgtctgtcgctagacgggcccaaacgttacgagatagaaacaagttagacgactctgaggaaacaacaacagaggagaaaggtcgcccaatgcagtcagacgtcagcgccgaggaataccagactacatttgatctccgcagctacggaaatatgtggagacaacaatgcaaagacgctgacgcattacgtgtcttttaatacatctgagcatgaacaattgcgcgcatgtgcctccctagatatttccacctatgtatggctacatacacatcctttttagaaagaggatgcttgcactacacggaatgcatcaacaccgcatttgcacatcttcgggcatctttttctgtgcttcagaaatttccagtgcgagatgcccatagctatggcactgacctcctgtgatcgcgctgagaagcaggatgcaaagaactacaaacagaaacatttttggttttcgagaattcccaatccttccttcaaggccacgcactgaaaccgatgccctgttacggagtgcacctcgcaacatcactttggaggacgggaggaggcgacgtcgatcatggcctctttgttttgcttgcttggacgctagcagaggattcagctactagcagatgtactatgttttacgaaatacacgaaaccactttatttacagacacgtgcatcttcctgcatggagaaatacggcgaactgacaacgtgcaagtcgcatcccaacagaactttctgcgcgtttggaacacgggaacacttgagttgtcacagtaacggtggtatttctcgagggacggagaggctgacaccagttaaagacagtgcataacgatgtcgtgaggacgccgagaaggagaagtctcgttttcggaaagaagtctgccgttttggtcatatgcgaacgacgcaaggggcgtttctgtgcgtgtgtcgtggcgcatgcatgggttcgtcaggaaagcgggcgcgtgtctcgtcaattgcggcaaatcttggcttgttggcgagtctcagcgatggtcctcaggtctctcttgccgatcatctatttaacacactttatgttttttaggaaatgtgtaaatgaaagcgaagcaaaaaaggtgacagactgggtctacatagtagagtcaaaagtttgggaacatagtgacgggatgcaactgctggactcgctgctgtcgtcctagccgtttgatgcgacgaagcctctaattcgtcggggaatttggaacccaaaaatctttccgacatgaagaaaaacgaagccgaagaattccgccaaagtcttcctaatatcggatcatgcaagtttctccctgcggtccgggccacgccaggctcaggactggtgtgttgatttgaggacaaactctaacaggacaagctctacattcagatttcctcatccttcgcttgcattcagaacggactccacgctcgctttttcgccagagttaccgctgttgctccctctttttcgccactttcgcttccactccttccgagattttctcccagaactgaccaaagaaagacggagagtgcgtgttgtgtttatgcatatacatatatatctatatacgtgacagtgtagtgcacgatgctatcaacaaaaaaccagctatacgttttgctgagtgcaacggagtatcttttcttgtcatgtctttagttgccttttccactttcaaaacgaaatgtccacgacatctgcgtttgcgagtgctacgttcccaattatctctatacacgtctcccgatgtattcactcaaaaatatctgtccacacgtgaggagagcatctgaagtgaagctcatgacggacctgccgttttttgcgagggaacgctttcgagacctccaaccgcatgttcctctgtgaatcatgttatgggtagcgcgcggcgtgtgctgtgtgttaatcgtaggagaggtttctcttcgcctgtctaggacggcagggcttctggtgagaccctgccacca

SEQ ID NO: 4008 - DNA, 2773 bp, Toxoplasma gondii
aaggcattgactgacgttgattcaacgcagaacaaggaattgtgagtgcttgtagtgggtcacttgcacagaagtaattggcgagcattgtcgtctgcaggcctgtggcgacagccgttcgacacacgtcagtgcactctagataagcaatatcccatcggaactttcagccttggacagttgggtatttgaagcatcgctggtgatcaaggagaacatgtgtcgtatctaggagagatagcatcgcgcaggcgtgtggccctctgttgccgattctgaaacatacttcagttacgccataagaagagatggtaaccaacaccggtcgtacctcctgcaaaggaactctgtcagattctcctcggctggcttggcatgtcttccgtctacttcgatccacgggacatactcatatccaacagtcttggagtaagcagcgacagccttcctgatcgtttcagcagatgtgtgttatcacttcagccgcatgacctgtgcgctgcttacataagttttgaacctttcacggaggtgacacagtctgcatacggcagctgatgctgtatatcattaaggcggaataaggagccactttctaccttgtatggttgcctttttaccaccggcttcagtcaggcattgtcgccattgggtgtcgggacttcctgcgatgctctcgaggctaaaaaaatacggcacatgaatgagaaagcagcaaattactttagcctaccatgtgagaacgttcgtgatctgatgagagtcagtgtgcaactccctgattgcacaagcggacaccttattcctataaacaccacagtctcttcctggctttaaagcggcttggagtttcgtcgtacagcaagcattccgcaggaccatgctggcatgcgatctcgccgccgcgttcgagtgcgttgcctaagacatttggcgaatgccgcgcagcagagtatccggatttattcgagcatctacgcttaccatacggatacaggcgtaggtcgatgtagtcagcaatatcactcttcataatgtgcgacagttgttgtgtgataagctgtggccgtatagtttgcaactcaaaaatgtcggttgctgctcacaaagcttactctctgacagaaggggcacatggactcatacctaattgcacaaatgccgaattcgaatataggcggtttgtaatgaaaataacaccttacatgatgtcaacctttactctgtcgtttttccgattgttatgttgtgagtggttgtgtcgaggctcgactctaattgaagctgcgcagactccagtacaagagccggtggccgtagcccaaataggaagccaagaaagtttcatgatattcgctatatcaaaacagagttttcgtgccaacgtgactatcaacacaaatcacaggtgatgggagcggttcatatctcaatcacatgtgaaggaagcactgtcattacagtcacggtgtgcgtccgatgagcatcgtaccgccagcggtgctctcacttcatctgtagtaccaggatgactgcgcccacgctgctccgtaaagtatcttctgaacggatattgtttaataaacacaggtctccggtaagaaattaaaactgtttgatcgttcaagcagcgggcagtgaggaagacgccagcgttcccacggcacaaaccgaacgtgttcttctgtggtttgagccatgagtagagccagatcggccaaagtgtacagctacttcatcggtaactcggttctacgagggaacggccgagttcaggaagccatatacttgcttgtttcgagcgtgtgagaagagtgcacaggcggttaccttgtactatacgctgaaccgcggttgctcgacttctggttgggaagcccttttatgattgctttgatttattgacgtatacggaagaactgacccgtggcgcactcatccttgaacatgacaaatgacctggatgctgcacgtcacggggaagacagacacacatcacgatgttctctcaaatgattgcatccgagtcactggcagtgctcagaagcggcggcgcggcgggcgtctcattgttctcaaaaatcaccacctgcaagtgacagcttatgcagcctacgtcgaggagattgttgagatacttcgaaaattttgggtgtgacgctatctcttcctgcgaccaaggaaaaatatcggatttgctaacactgtcgcgcgaatgtgttcgcttgtacttcctggcattttcaattgcactctcctaacctagcggacccacactgcatgcgtacgaaatctagtcgtaagctgttgccgaatcgaagggtctgcttcaggttaggatttaaaatcgatgtaatcagtccttcatcacgttccacattcgactgtgatttactgtcacttggggttctgcaagtaacgcgcactgcacagctgttctaaactatgttcccacacgaacagccacacatgctctggcgggctatggcttccgattgccagcatatgctacaggtcactcatcacttcctcaaggcgagggttcgtcattgttttgactgttttacgctcgtactgcgtggcctattgccccgaccatgtatgggaagacgccccacgaactgaagcagctaggcgtctactggatctacactgttcattatctaaagctgagtgacgtttctggaagctgacggaagtcgcatggagggcttcgttggtcgcattactgctgggcaagcgtaaagaactgcaactgatccttgtgttacca

SEQ ID NO: 4009 - DNA, 3061 bp, Toxoplasma gondii
acctgagacgcgcttgggcactacttgagacctcaagacgattcgggcaccggtgtggctctctgcacggcaggaaacagcccaaagggacactcatgtgaagacgagggtcagatataatgtacgcacgggtgccctagagcaagactgcggttttctcctgatacacctctagaggtacagggtccctgggagacacgaaagaaagaacagcgtcccacgatatccatggcgacatccacgtacctaagcggagagagcaactccagcgacggatcgatgcgaaagaaggcaccactccaacgcttgctgcgccacaccacttaaacatttgaagaagagtttgttcatgaggtgaaactttcatcgagattggtttcatcattgtaagccccaactgccttcttgcaccgcctcgcgaggatggacttgtggcatgggtcaaagggaaaaaaggattttagggatagtcttcctcaaaccgcactcaacgtgatcggcaagatctgcttctgcaagggagctcagacctcatacagatacttagacagcaaagggtcagatagcctgtggtattgacagggacacgtgcgttcctgcagtcctgcagcgtcaaagaagagctccaaagtttaggggcgtcgaatgacccggttcgttgtttttacgtgtagggacggtgtagcgtccttctggttcctgaagtttaaaaaagttggccccaaactgatattactcatagctatggaacagtgaatttaaacatgtgtgataacggcatccttggagtgaagcagccgtctccgcttgtttaccaagtaggagcggaagctggagtttcccacatccacaaacactgtttggaaaccggtccctgttcgtgggattctatcgacgaaattggtttgaatgtgcaacttaaattaagataataggtacggaggtttgaacgaaaacttccaagacacactgacgaccactttgttgtgcttcaattactgctgtcccggcacgcatacgtcaccaacatgatttatgctcagcttcatggggacatgcgagagcacatccaataacttagtcggatacgtggctgttcggatgtgtataccctgctatacacgtagacactgaaagagaaatgggtggtttgtctctgcctaccactttgggagtttagctattgcatgcgtcgcgatgctcctcgagcccgagctcagaaatatcgttccccagttctgcggcatcgacactttgtataacaacacgtcactcctgcacgatcgcgcatactctgtttcgtgatggggaatcccctgaatagcagaaaaacaaaagtgcttcgttacatgttcctcctggatataccagaagcggacattgggacttggtgtcttcatagcatatgctcactcgcatacggtgatgcttcacgccatagacaatgtctactatattgtttgtctgcgtgctagccccttgtctcgcgtcgaatgtccacattgtttgtctgcttgctatcgccttgtctcgcgtcgaatgtccacacagtttacctcatgtagtagattagtgctacctggtcaggcaagtagagtgtgacggacacgcactagaagtgccgtcttcttgccgacgagaacgtaaaactgaagtgcgatccgatatcgttgtcggcagaatcgacactgcaccaaaagagacagtgaacccgatttggttgtgggttgttgcgaacatccgtgacacacctgtctagtgtttatgctgatgctccagctgatcatttgtattcaacacgaagcctatatgagcaaatacaagaagcaagtagcagttttggtattgcgggcagtgttgtctaaaggtgtggaacacttctgcaacaacggtgcccctgtcacggcccgcgcctcgcaaacccagaggcggcatcgctcaccctgggccacccgtggccagtaagtgcagtttgctttagtgctgcatccacggccgatttcatgaccatgatgggagtgagtgagaaactgctggtctgcagcggtgtgaaacctcgcccaccagggctacccactttcggcacatcggagaaggaaccatagccgttggagactgtccagtatttcgacatggttcaaggcaaatggaacaagcacgaacacacctgcctcacagctggacatctgagtgtccagtcaccgtgcgtagctgccgtgatggttgggttgacactggccccgtttcgataaatgagagatcgacgtctttttgagtctgccatgccttcaaatcaccatgtcacatttcgtgccagaagtatatgtgtcgagatgtatcagaccctttcgcgctatgccgtccattatgttctgcgatgtgtttgaaaagacagtactgactgcattcggcggcttatcgggtggccgtggcagaagggcaggcggtggagggcttacggggcatcctctctcgcatgtgccagtagagctaacttattgaagatttgtcttcttgctttcctgtagacaacgtacccgaacgtcatgttggtactgaaagccgagaggtgattgcgcagagagtcttcacgctttgcgttgtgacgcttctgttcggatgcaggaaaaccacacgctttgtagatatcaaacatttggacttggaggctgatctatcgagtgaaattcacgcttcatgcccttttcgttgtttccacgtcgctgtggatccgatgcctgcaagtgagacgctgtctggcggtcccgtgttcctactagccgcggaagtggggggaggggtacgggccacaatatcgacttcccgtttgctgttgacatttcattgggtgttctcccccctctgcttccaccaccggagcagttccacttttgagacaagtagcgtaaagaaaaccgaactctcttcaagaccacgtttgttttttgtggtagtacagacactgtgagccgtcctggggctcgcgtgttccatgcacggtgtgcgcgcaaatcggcgctgtcgcgtgccccttcgtgacgtcatcaagcaataacggtga

SEQ ID NO: 4010 - DNA, 2003 bp, Toxoplasma gondii
cgcggttctggtgctactttcaaaagaagtgtttgttcccggttcttccgtctctcgccagggagaggccgaaggtgccgctgcaagaactaggttgtaacaggacacggctctgcataggcgcaatgccgtcacaagtctatctggcgcgagaaaggagttgtgggcttcgtcgttgccgaagaaaaggaaacacaagtgatccatatagctggagatattggtgcgcatacactaaatatagttttgataagtcatgctttgcgcccttgtcaccgggaatcgctggcgacaaaacaactgggactaacaatgataggcttatacgagaatgccgagtatgtgtctcacgccttagctgcgttagcggagaagctctctgtagctgcgcgaatctactttcttttcgagcacgtcgggacagggaaatctcgcagtcatgctgatgagttcacagttgcctcagtgcccctgcacgcctatctggctttgtgatgaacccaccaaatagttttatttactgttaacatacggatcggggtcgtcttgactttttggtttgtgggacaccatgattccaagtctaagatatcatccgagttttcgtggcgccgcggttacgattaggcgtctgacgtgtcgaaatccacactcgacgggccacgctttaattgcgcgctctccatgagatgagggtggcactacaccagttgaaagtgacttcattcttcgatgcaccctatgtagaaaaccacaccgtcactacaaccaccaacaccgaaccaagcacacatggaggcaccatgacaattcagaagcaagggggatgcttttctgaaaccggcttgtggtacagggtgaatggtatagagtggttcctgaggatctcaaaagactgactaacgaagaatgagtttgcgtgccccgaaatatgctacgggagtgccgaaagagggcacaatagccttttttcgccacggaacaaaaagagcttctcctttaagaagcccttatccacaaccgtactgtgcgggatagtgatagcacttgggcgtgatcggaataacctatccccttcacagaaatgtgcccacccatttcacgtgaccgctgtagacaatcacactgtgaaacaacctttcgaaagatatgccgttttcatacataatattggcaggcactgccagttctcatggtcgagtcgttcggcgtatacagttacacggaaatagtccggttcaccgctgccccagcataaaacttgtgacacacatgactgattgaaataagaagctctcacacgtaaagtgttcgtttctccggaaaaagtcgcggcgacgtacgtgactcacacgtcggggaagcgagacggaggcgaactgtttcaaattggcgtggaagagacgaaaaggaatgctatatcgtcgcttgttgctatatgtgtgacttcaaactgaagagaacatcaatgctgtagctggcttcggatatttcataaagcttctttctcggatcctcccctcgtggcagaacgttgctcttctgacatcctcccgagaagccggtttctcattttcggcgcgcatacagagggaggcccacatcccgcccccctgacataatcactccagtctaaattgacaatttgatgagtacaaccttaagctgttttgtttgattttttctccacaaaggaatactaccatccttgaatggaaagtcgtgctgcttcgttttgacataaaatgtagttacctacgagcgaagtgctccgtggtcgtgtgcaagtacagttttccatattcaactagtagacatgagagatcgggtattcaggttatcctgaaatgcgtttctttcacttccagagcttcaagtcgaggtggttgtgaagagacgacagaggtcttcggtgcagcagcatcgcaggcttgtcacatgcagctgttttgactcgcactgactttttatcaggcgtcagtttttttctttcctcgagacta

SEQ ID NO: 4011 - DNA, 1130 bp, Toxoplasma gondii
tgttgtctggtaacatatacgtatagggaactccatattttctacaaaactacctgcatatgcataggcacacatatgcatatatatatatatatacagggtttacggtgtattcatatgcacatgcatatatatatatatatatatatatatatatgcatgtaggtgtgtggagtagctctgtttgatgtgtgcattggggtggatcgctggctgtccgcagaacgtcgtttcgcgcagagacgtttgcctcggaaaaggttcgtttttttccgttttacccttcctgcgaaccgccatgagaagcggcaggagcagcaggtttcgccagccatggcgccgagagcggcgctgacgacttcctgcacactgttgacgtcgtagaacgcgaaggcgtatcgatggtcttcgaaaacatagtgtctcaacgcatatttgtacttgaagggagacttcagatacgtcactcgccactgccgccgcccaacgcgccgcggcacaggccagggcggagaccatgaagaagacggagcagaagaaggagcagaagaaggagcagaagaaggagaggaagactcggaaggagacgtccaacggagagcgttcttcaggttctcgatggtagcgttcattgaagatctgttacgggagttgtacgtgactatgagcgaacggagcgaatacgccgagagcgccatggtgagttcttgaagcgtagacctcacgagcagaggaagaacaagcagaggaagagcgagcagaggaagaacaagcagaggaagaagacagagacgacgaaggtgcgtcagcgaaggcgcgacaggacaggagacgaagaggagagaggaacgtgagatgggggcagagacagaatcgaagagacactgacgaggaagagcgagaaggtatgtgcgaccaagtgattgtcatctttcccccggcagtggacccaacttcaaggcatttgagatagtgagaaatgcaagaccatttgacacacttttgccttccgcgtttcaactctttccttcgtctccggcgctccgggcgactttgtcctgctttcttccccgcctctctcttctcgcgttttctcgtcactcagaggtagtctctgagaggcgcgtcga

SEQ ID NO: 4012 - DNA, 853 bp, Toxoplasma gondii
cgcatcgtatgcaggtcggtcgatgaagttctacacattctcgaacaagtccgtggatggcctcggtcttgttatttccaaactacggcagagttacgcgaccgtcgggaatctctacaaagccatacagaacgctctgagcaggagatcgggacgtttaggctggtcgttgtggaaagagctcctctacggtgcatgagctgatgttgtgtgtcttgatttgaacaacgtgtgaatgtcatctttagttggccgaatatcggcgcgtcccgtcagcacctgatggccaacaacagctgctgctgtacagtggtactttcccgtagtgtaatacaagtggaagctgtaatgttgcttgtgtgatgtaataaaatcgatttatcagagcaacgtgggtagtgaccgatcacagagattgatcttgtgatggtcaacgcaatcacagctgggaatggccatgacggagccgaaccattggaacgcttaattgcattgttgcatgtgtctgacaattgttgcagaggatacttcagattgataacatgaaacttccctgctcatcaatctgacaacttagaggatgtcagttgtcactcttgtgtttggtaattacagatccaactaagtcattccatcattaccgcgggtttacgtttataacagatctgagactgtttccacacggcgactcagaggtcgtcgtgctctctcagtggggatggtatgctgagcacgctggcttatttttttcgctagaggtggcacagcaactcatatgtatgatcgaaccagcgtagtaagttgtctcggtgcacactgaagtacttccttcttgaagaaacttcccggctaa

SEQ ID NO: 4013 - DNA, 3957 bp, Toxoplasma gondii
aaacccatatctaacggctaaaacgcaagagacgcgagcttaccagagatctctctgaagagcggacgaagccttcccctcccgagtcagagcccgcgcaatgaagcgaagtcggagcgacgctgccgggctgtttgtacacggtcccgactgcgaataggaacggggaaaccgtttcttcttgaccctcatgtgcgaagagcgagctggaaagcgaagcaaggccgagaataaagaacacaaacagaatctgagtcagtcttccgattctccgactcggctgcaccccaccctccagtgcaggagcggtgtacgtacacccgagaggaacgcctcgagacgcaggcgtcatttcgtttttcgtgatttcgacgtcggagagagagggtcgtttggggacttgtgagggatccttcggccgagggacgtgtcccgtccacggacaaatcgcccgtcgtttcagcaggagagaaacccgtcaaaagaaaagcgaaaggactttgcacgagacaccggtgaagcagcgtgggaaagcgcgcctttcaaacgcgttcaccgcctcgtagaggatgctggccagttaggaaacccacccaacttctcggaacaaagatagggatgcgcagacgtccatgggaagctgaggccagcggtgggaatggatagtttccagcagaaaactgtgtagagtgttcagacaggccgtgaagactctcagaggatcggagaatgatttctcccgttgcgagcgaatcgcgtgcggaacggggacgccttctctccctgttgcaaggtcacacggtggctgcggtccgacagagtcggcacaactcggcgcgaaaaaattggtcaaagagaagagtaatggcttctagcagctggcctgtcacgcgaatgaacttgccggccgaacaccctgcgatgaggaacgggaaatcagcagcaagctggaagctgttcaagagaaaaaatcaatcgggaaagcgtagacaaggaatgaaacttcgacggctgtgcacacggcagggagaaaaggggaaaaagccggacgctgcgcgcacaaaaccatcaagacttccttcaacagccttctgagacacaaaaaaaccgatcactcgactccgtctctccctgcagcgtttcacttccacgatgctgaattccttcaaaatgttggcacccctttaaggcgaacattttcttcagcgtttcggcagagcggcgtctcgcaatgcagttgacacactgcatgtgcggggtaccctgtctctctgaccggagacgggcgagcgcctagacttcgttcaagtctcgctccgaatataagcgagaaaaagatagcgaacgatttgccgtaagttgcttcgaaactgtgtccagtctgcttacaacaaccgaagatttctgtgggtccgtctggatcttcacacgactgggagccggagcgcacggaaggaagggaaagattcgatgggggattcaagctgaagcagtctgcggtggttttcttccaacgtctttgtccaaactccctcgcctgtttagttgtctaaagttccagtttcaaggctcttagtgccttttcatagttttgcttgttcatagttttgctttcgtccctgcttcaaggctggtttcatcttaatgacaaaaatgaccccacgagttcagatcgtaggtcctgtcgagttgctcaaggaagatttgctttcagaactggtgacggcagcgctaaacatgcgtgaggatgaaacagagctgagacttccgttaggtgtgaaaaaaaaaaccattcccttgcgcggaatgccccccagttctgtagcagtacgtcgtaatttgcggtgaggctgacgagctacgaaattcgaagccattctcggtgttggtatttcttacagatcctcgagatcgaacgcgactcatctgtttgttactatcagcagcgtcggttcttgacccagagaaataccgtctttctagtaggaagggaaacttgctgtagcgtacagctggagttctcaccgcttgcacgagatcccatgtaaacacatcaccagcacgttaatagagcacgcgacgactgcgtgagccggtccggagcaaatcttttcgtgaacagagctagacaaatctctcgacttctgtggagcggccctacagaggtaggcatgacttcgacacccggcataccacacgactgccaagaaagcagaggaaagtacgtctacagccactgccgcattcaggaccgtgaaggcacacacctcgccaatccctaactcgagtaaactgtctgtttaaagcgttctgtgagggcccggctcccaaaattcctgctgtcgcgaagaaaccggcgcagagcctcctggatagcaagtgctcaacatcgctcgaggaaccccaacagcgtgcatctgaggaagacagtttctcggattagacaacaaaaattcaaaagaccgtcttccacgaccctcctccacttctgagtggctggagttgtcgttccttactgcatccgaaaacggtcgacaatgtaagaaagaatctgcacgcctacagatgccttcagactttactttaccgcccaaaccgaacttttttgtaaagaacgctgttgagcacgtgttttgaatcccccggcagcggcacgtgaatcctaactgtgtaggcatccatcttcacggcacacgagggaaaattctttggaatgagtgtcgtcaatgtagaacgtctgcacatccggcttctcaacaatatcggaagtcgcgcagagtcacaccgccctgacaaacactccctcgattaggtttcctctcgtctctccccggacgtagatatagttgttcccgacttgattttctcggaacgtccgacaaacagcaaacatctaatagttctgcaatcgatccaagacacgagacggcgcgaaagctcccctgttcacggtacgtcgcacttttccgccagcgcgaaagcggcggaaaaaagaaggccttcgaagcagcgtcaattataacagttttcgaggactggagcatttctacgaatgttcagggtatggccgtgtagagggatttgctgcaacgcagaaaactcgacaagcagacaaaacccgcctcccgggatacgcgttggcaagctaacgggaaccctcatccctattgtctcgttgttcaccacgaagccgtcgttctcccttggtaatgagttttcttctttctaaatatttttgtttataccttttcgggtggcgtgcatttagcgccactttgatgctgtctacctgttttcgcgacaccgctgcttgttgtgtcttgttcgttgtcgtggcaagccgcggtcgcggcaacttcacacaaagggttaaggttcacctccgcctctgtgcattggaaaagtgccatttaatcgtttatacagcggcaagtccagatctgttagtcccttctgacgaataagaactttatggggctggttgtgccattgtcgggattcgggcattgcgagccattgcatgtccgtttcggctggcattccatggcggcgctggggtcttctgcatttcctcagcaagatctgttcaggcgaaaatcctcgagagaaatagccaattgatcggagggcggaaaagatgtgtcatttcaatgaatttttcggatcatcgaaatcgatgctcggcaaccggttcacccactacccgtcgccgctaccttgtttgagtgctttcgctcgcagcaaagagcttctacgacgtcattcttcgatatttgtgccctgcatttcatatgcagactcgcagtgctgttggcggcaagtggtcgtgtgctaggcccgcgtccccgtcgtttcccctccttttggcctccatgtagacaaggactcctgcccggattttatcccggaagggagaggtcggtcctgctctctgtttcgcttgcctttttctcccaa

SEQ ID NO: 4014 - DNA, 2098 bp, Toxoplasma gondii
gaactcaatacgtataatgtgcacaaactttagcggttctgtcaaaaagaggcaagtgaaatcacaaatagcgacgaaggcaaccctgtcttcgtttatgacatgcaaataaaagtatctgcatggaacaccggataggcgctgtagagctgcctgtgcacttctgcgtattgacgtggtgcgggtgttgcctgggcatgtttttccgcactgtttgtccgtgcatatactttgaaaaggtttggaccagattaccctgattgtctttgttgtaataataccaggtgttaagttcatacactggaacccaatgattatcgctgagcttggcggcagtcgctgcagggcacatcggacatcaagtgaaagtcgtgcagtggcaagcttgttccgaattcatacgtttgttgtgtgagtggaagcgttcagtgaacagaggagcagggaagacgaatgcgacgatgtagttgttgtcagtcacctattgagtgaagaccgggggaagtcatttgttgggagctgatattggaaatgtagacataaacgcgttttacgagacgcgcatctccaagagagaactgcaatcttgcagcatgccttcttggaatccctttttaagattgtctctaaagtttgctgaaacagaaacactgtggatactgatacacgttgcgttctatctctaaagtgtctaccagtcgcagggatgccggggacagcagggcagatctctccggaaacagagcaagatagcggagacgagcggctttttgcggattgtcagaatctgtggaagctcgtctaaacttgttctacgaagatgagagtcctcaaagtgcagaataaggtggaaaagtcatgacgatcacactttggctttcttagcagtctggtggggacggggtgcacagcacctcttaagaacttggttcatgtaccacgtaactagagtcacagtcggtatcacaggtttagagagactggataacaatgtttcagtttttcacttgaaagtgaagatcatccgtaactctgtcggaaattagaagcacgtttatctcgtgtgttgtgagcggtcagtgaggtcatgcctttcctctgaacgacaaacgcaaccagctaaaaatggaaaaactattctgtccgtcgtatctctgcaacagaaatgcatataaacttttgtggggccgatccatgtattccgtacggacaaacattgagaagaaacacgaaaaggtgtgtgtgcactttccgctttaaaaaaacagggaatgcaccctataatagcctgacaggtagtgtcgaacacagggatcttgtagtgaacaataaaggcacacgaaacggaatcaatggcgtgagcctgcactctccagaaaggcggtgtatatagtcttttggaaaccgatacttttaactgtcttcaacaaccgagagagataggatggtgtacagcagtctaatcaagaaccagcgattttggtgaagcaaacacgtaccacgtcgtgtacgttgtgcatctgctgtacattttctcttttggacaaaaaccacctaccaaaacaacaaagtccgactgtctgactgccgagatgcttccttcccgtaggccagtgtctcgtcgctctgtcgccccggagtagttttccgttaatgggcataatcaacgggatcttccaactatttgtatctagagagaacgggatgaacgctgacggtttgagctgtagtcgattcgatgggcattttaattcacgatccggtgccatcctacccttcgaagagtgttgttcacgacataaaattggaaatgacacaaagagcacggtagcagaataacctgtttccacaaagcttcccgaaaacatgaagaaaacatgtagtttcgcgcgtctcttgctcgccggtagctctaccacctcggcgtctctcgcgctgggatagccacagtccacatggaattttcgggcaaggaacggggattctccttgggttactcgctatatcctagtgatttcctcctttccgtggctcggttgcccctccgctttgtttttacaccacgcccttgctttacctacgaatcgctgtcggacca

SEQ ID NO: 4015 - DNA, 3909 bp, Toxoplasma gondii
gcagaagaagtgcgcgagacccacagggcggcgacaaagaaaaaggagaagaggaagagcacgagcagccgaccgcggaggagagagaaacgagtgtgcaggcctcgggtgcatcatacgaagacgcgtttccttctttgctttcctctccaactcgacagcgactcgagctgcaccatcggggcgaagaggcgcatgcgcgggtctgacaggaggggaagaaacggtggaaacagcaagcgtttaacgcagacaagccgcggggacaaggaaggctgcgatccttgtcttgccccgaaaaacattcttcctctgcctccccgtgttttgagaaagggccggcggaagcgaacagagcagagaagccttcggagtagaccgcgagcaactcatcttccgacggctctggatgcgcagcagatgctgaatggcacccagccggaccccccctcaagtcgccgcttgcgctggcctcttcccacactctgcgagacgccagacctgacgcctctccgtcggcagctcgcgcccagccgcaagaagaagaaggagagcatgtggatggtgagaaagaagccgcgactgaaaatgagtgatggtcattcgggtaaggcgcatcgcgacaagtccggcgagttcgcttcctgtcttgcggtcgagagaagccttgttcctctgctgggtcttcaccggatccgcgaagacagccgttgatgaaaaaaatgatcgcgaggtcgtctaaacgtttttcgagggcaagaggtacaggccgctgtccacgcagcggcaggtgcagcgcctcacctctccctccacctcctaggtagctttgacagacacgacagcacctggaatgctccgcagcagaggaagaagatgagcaagaggagaaagacgaagaggaagaagagactcgagaagaggaagaaggcgacgcaggggaagcgcgccgagcgacacgggggcgaagacagggccgatgatgaggactaacgagggcaggttgaatccaggatgaggcagcaggaagggcgcgagtttgcagccgaggcagctctgcgtcgaactggagttccatttttagtggcagagcagtggaaaaggagacaggaggcgcatgcgtcacgttggaaagaaacggcacgcaagcaatcggggagaaagagcagaaacgtatgtagaaggcggaggaaagtgtgtgttggagcccgggaggatcgacagcgccgggagcagcaggaagaagagcagagacacgcagaagaagacgcaccgtgagttgaggtcagaggcgttggctgtgatgacgcggcagccatattgactcccgcgatgtttctcgcccgttcactcttcctcgtcccttcggcgtttttttcgactcagtcaaagctttcctttaatctcttctctactctgctctctttgcagagcagcgaggaggagacctttgcgcctgggggtctcctgcctctgtatacctctccctcctagcacacgagttcggaccgacgaccacagcaaaagcgccaccccgatatttccaaccaaaaaactattttgaagtctgcatcgtggatcaggaagaaacgactgcaggttctttccttcagctcctctgcgtaaagttgctccgccgcgctgcgccttgtcggtccagtttttccgcagagtcggttctcgcccgctccccctgcgccgcgccgcgcgctcgaccgctgcggagaagctcgcgctactctttgtttaaaagagcagccgcagttactcccaacacgagaaagtgttaagcgcgggctctggcttcttttctgcgattatcgtgctctcgaggtgcccggcagacgtcttgaagcgcggcgtcctttgcggtctaggctgtcctagacgacggagagtccccgacagtctggtttttgctctttgtccgttcactgtttgtcttccgcactcatttccgtgatcttccgagctgttcggagcgcgaagaagtgcctagctaaaaggcaacacagagagaatgaaaggcggcaacgtgtcttgtcgcgaaacctccagatgtcccgctgccgtcacgctcgagcctgcggcgcggatttaggttcgagtgtgcctgcgcgcgaggcttcttctccgtgcgttttgatctgcgtcgcagtttcttccttctttctgtcttttaaggcaaactgaagcagagagaccgtctcgctgcttcttgcttcccgaagaacgcctccaaaaagtttccctgccttccttgttactctgtctcccccctcgcgcccgagtgcgcgcgggaacctcaagagtcaagcgcgctctgcctttctcgtggttctttctcgggttcctcgtcgctgcggaaaatccagagagcgagaaaattgatctgttctctggaaagctgctttctgcgcttgggagaggaaactcccaaagagagacttcttgtctcaccggttttttactgaaaagacccgcgtcgaaaccgggacgatgtttttggtcgatggtcgtggcaaaagggctagcttcccagcggttcttcagagcggcttcctataggattcctactctcgctgcgtccgtgcctgcgttttccgtcgtttaagaggtcttgcattctctcttttgtcgtgtttactcactagggattgtgtgcgtggaaatcgtcaatattattcgcctcaatgcgccagtttcccagggaacgaaacgccgggaagagccgtcctcaatcgacaactgtctactacgtatctctctggtcgccgctggaaacaaaccgtcgcagcctcgttttcgagaagaaagagagcacacccagtaaagctctgacagggaaaaggcgaaaaatatttgcgcggattctcatttgatgacgcagagagaaattccggtggtcggtttatccatgccgccatctagctggcccaacatgctttcgaggcgctccagaagcagaaaccttttccgtgttttcatcggttgttggtccgcctctttccctctcgcgtctctgccttttctttggtgtgttttcctcagggtttgcccccgcctgtcggtgtgtttcttcggtctaaccgactcgcgaagtcacgcgcatctgaaacgcgtttgacgctctagtttcgtgcctctttttctctttctctcctaagatttccaaaggttctcgctgcttttttgtcgcctctttgactctcttcttttgtgtgccgtctttctcgtcccgtgctcgcctttctcttcgccgctgcgtttcagccccgtcctcaaccggactttatagtgtctacgaagggtttccctcgaactttctcctgtacctcctctgggggtttcctcactttcttcccttttgccggtgtggaggcttcagcgtcaacgcttgacctccaccttgttcccaagtcgtcccgccttctcacgcccactgaatctttgcctggaagagtctgccgcgtctcttgttatattctctgtagaagcgctattttagaattcaaattgtgcaccttaaatcctagtcgactggacatactgagagcgagaggaaacgaaacagtttctcgtttgtcatagccatatatatatatatatatatatgtatatccttgcatcgtttttctgcggcgacggatgacgggtaattccgtttgattggggtagctctttcactcgcacatttttgtataggcaagccgcgtttttgcttcttctaacttcctttgtcagcgatgtattcgcctcagtggcctaccactgtggagtcccgaggtcgggaccgggagcgcatgcatcgtggggaaagggccagtcgtccttccgtagtttcttctgttcctccgcactgcgtggggagctcttccacatgttggccaggtcagtcttactcgccta

SEQ ID NO: 4016 - DNA, 4540 bp, Toxoplasma gondii
caaacacacgtaaccttcgaaatgcctgcgtcgagatttctcgaatttttcgcagataaaccggcgtcgtcatgggcagacgagaacggaggcgacgcacagtgcgatgtacgccgacactgacttcgctctacaagaccggagccgttctggaccagctgctgtgtccgggctctcgcctccagagcgaatccggagtcacgctgtgtgccttgcgaagtccgaatgccccggaaatacgccccagggggaaccggcgaagaagcgaatcgacagtcgctgcggccactgaccaagtctgttcccgccgttcggcccatcaactgctctgcaccccggcttggactttgccaagaggaacaacggtggatgtctgtctggcacagggccttttctccgcagtaggactggaagaaagaagcatgaagatggggatccgtttcatcgtcccctgacactcctgtgtggtggaagccgggaggaagtccagggtattttccttgcgacagaaatagtgctggagtggcacaaggttgccgcgatggcccgacacagtgacgatggtcgggagaatccgctttgaagtcgtggtttttctgcttgccatcccgagacttgacattgtccactcccgcgcgtacgtagcccggagaaaacgcgttcgaaacagcaacagcagactctggcggtaaagaacacgccccaagaccccgcgagggaacctcaaaaaaggcagactcgtagcgcaacatctcaataagatatagtggcactgagtgggaggagctagtcgctgcaacggcagaattgcttccgtcaagtgcaaagccatgtgcctagcaaaaagcacatggaaagagcttctgccagagcgcatccgcccgtcgatgaacggtgtgaactcccgcgacctcccgcggatcagaattgacaggaaatgcggcaaaggaaaaaaaggacaccataacacgcccccctcccatcaccagcatatcataaccgccctgacaaaacaaacgactagggttaaggcaaggagagaggggcaaacctcgtgaaaacgaaccacacaatgaataaaaaacttgcttcaattccgtgccaactggctggcagcggcgggacgactccgacattcgctgggccacccgtgtgtgtccaagctgaggcaagcggagaaacagcgagcaaaaagtttaggagatacagaaatcgcgcagagccacaggcaacactagtgtttcaaagcgacgtcgaccccacctcctgggacaacagtgagacacaacatgacttgtgcagacaaaaagtcagtcgacgaaacatttttccgagcaaccgggaaggttgatgttcgctgtcgcaagcccagaaaccagcagcgcgcaagcctggaaacacgaaaagaaagggtgcaagactaggaagagactttctctataaaaatcgcagcgagaaaaaagacgcgcatgcagccacgcttcggcgctcaattgcaaccgcttgaccgcccgccaccgcttgcaagaaaccgcgtcgattctcagggccgtagagcacgctccttcagagtcatgaagaaatccatgcagaacggaacattgcatggaaacaaagacataaaatacaggaggactgtgaggatacaaagttctgcggaagacaggaggtgcatatcgaggggctgttcaacttcggacactgccattggtgttctgcgctcgtggcatgtcgcgacagacagccagccgacggccggtgggatagccagggagcaggtggatcaggggccagacttgacttagtttaagtgatttctgtcgcagatgacaacgaggaaacgaaccccatttgtgacaggattctacgttgtttgcggagaggagagactccgtacacgttacagagggctcttcttaggtaccacggctggcaccgcggtaatacacgagccaggcgagggagagtttggcattaaatggtggaaccaggacgaagaattcagatatgcagcaagatttctagtgaactgagcaagacgatggacaggcagatgtgtgcgtgtcatatttcgcaataatcgttttgaaacattgtaggaacgcagtacgagatcgaaactaagtgcggccagctgggtgtcgttgaatgacttggcgctgaaactgacgaaggtttgcgtcttgaatgtcgttgtttaccggatccaagctcgactgtgttagcaatgtttctagcagacgcagtatatctcagaggcgattccgggctgtgggggtcgtctttccgggaagcagtgtctgacgcggtgcgtatgggctgggtaactggcgtcaagctcaccaacatattgccttattaatgcttacaaaatgtcggaagtgcaaagaaatcgtaagtgcagagaaagtacggagagaatctggggagtcagctacgcagtcagggaagtgaaagagttctcctttgaggctgttccggaatgagtgtcatcgaagttcttgcttctcggacgactccatagtaactgtggtggaaaagaactcttcctagattccgtcaatcggaactgcactacagttcatgaggttaatcgtgtggccgcaaacggattggagaggctaaactgatgccgcacgaaccgagctgtttgtgtgacgcctccacactcaaagggacgcaactcgatctacagcttggtgtcgagagcccaaaacggttctgtgaaaggacacatttcgcctcccaaattgttgtggatgctgaagcatagccggagctgctttgctgatcctcggatacacagaaaaccgtgtcgacaagcaatacccatttgctggagtctgctcactgcccccaaccatgcatcgacggttgctggaagctagctgtaaaatgccccctgcaagagtcgtaaagcgttaaaccaaaatacgattaagcgtaaacagacttacggccctgtccaaggaaagttgatgcaaattagcatgccgcgtggatctttctaaactggagactaatcagaaaaagtgtgacatatttttctttgttcacagtatgatttgatggctgattaagtaccaacgccggaatcaaccgttcaaagatgcatgtgactatttccaactagcggattttctatcaatcccgcgtgttccttccctaaaaagtagctcgctgccgggagaggttcctccgagtgtacttcccgatgtgtaccgcaacggacaggctgctcctggtctgagtagttctctacggattgtctgcagctcaagccacgcttggtcacacaaatatcatcctgtttactacacatcttatgtgttcgggggccagcttgcggcaagactgccgtcttaaacaaataccacaaaacttgaatcacctgcagactaccctcggtacccgtttttcagtttctacccgctatggtcctggaagaaaataacagctatgcctccgaagggactcttcgtccagcatcattgtggcatttgacatctcagtctctgtaataacacgtcaacggtcatgcttcacgaacgccaacacggaactctcactcaggagcctcagcaggctcacgccagtgaggaagatgcacgcgaaagaacggtgagacggaaacaatatgttccccacatgcgttgaagacgcatttctctttgcggtagagaggcacaagtcggctcaccctaattctacaggtgctgtggtcgcgtttgtaaaaattgctttctgccttctgctggcacagcaccctaaccgagcaaccatgtgaagactgcggatgtcacacggtttccgaaggacagcgaagatacccctcaaaaggtctttggccccatcttttgactggatggtatgggacacgacaacaagttactcgcgggaaccttactgctgactagattgctgacaacaacgcacaggacgccaggtggtcagcgtcggcgtgccctgcgcttccctaccaggatcatcaacgtgccggagaagcctaatcgaagaacgttcacggtgccgaaggtttgcaaagtcccctcgtcgatctgagattgtttatactgcatcactaagcgtttcgcacgtggatagcatcgaaacagggctgatgattttctctgcacagacatctgggctcctcgattcggaaagccgtgcgggcttacacattgtctgaattacagattacttatgtcgcttcatcactgctgctgcggaactagcgtatgagcaacaacttaggaaacaggttgttttggtgcccctcatggttcccctcctaagaaagaaggtgcagagggggttattttgggtcggtgacgtgcgttacttatactgatgttccgtggctacattgactaagcaaactgttcgctagctgcctgctagcttagatgtgaacagaaacatttctctcgcttccttgtcaagatccaggtttccctgattgtgggctctcgaggtctatgcagatgggcggtgtttttcgctaggtcgccttctttcctgtaaaaacgcagcgtcacca

SEQ ID NO: 4017 - DNA, 3744 bp, Toxoplasma gondii
tgtatcggtcactgtccttggttcttctgctgtggcatgagcatcctcgccggcataacccaatttatccaccagatctgaatcctctgttcgaccgttcttcagcagcttaacgactgcgaaggcgagggggcagtctaggttctggagaggattgcaacgatgctttctgccgagacacaaaacaagctggcagcgtttcttgcatacgcatgtgtgcgaatcctgaggcgtgattccagttgcctcctccggaacgttagtttgattggagaagaacgaaagaggtgagggagcctccattcttggttcagaaaaaagcgggaaaagcggagacggaaatgtcgcgccgcgcacgtctagccatggcgccataccttcccgatggccttcaattcctccgcaaggcggggaattctggcacccgaccgccgccactgcagacacactggtcttggagaggtttatggaagcacggcttccgtctgtcatacgattcgcttgctgaagatggtgctacagcctgccgcttccttgtccggttctgtgcagggtttgtgttcacttatactcgcaagcgcttctctgttcttctgtgagttctcggcagagtgcacagacccaaggaactagcactggtattaccggcagcggagcaaacctattggggttcctcatccggcgttttcatttgtgttgccacatgcgctgcccgattcgctggtcgtcctcttggggtctccgggcttctcgctagcttcccattgtcgacgctggcgtatgctttccccagtaaaaagaatttcgaagttctggtcgaaccaggttgacgattcttcgagtatttctggtttctcttttggggtgtgaaggcacggcgaaggggtctgctctctgaaagcatgtcgtcaggagagaaccacaagaaaagtgtgacggacgttgatcaagaactgcttcgctcccaatagtcgagtaggtatgtttgaagggaaaaatcactgcggacggccggttcctgatgctcactttatttttcgcaggtccgcttgctacacgcgagatgtgcaaccctaggcaaagaaagcaggttttgtctcacgggtcacctccatgaagaagcggaactttgaaagcacacagagaaatcagaaaacaccttacgatctcttaagcaagacaccacaagacaagctgagaacgatgtcccggcttccttgttaagactgaaattcacaccaaaaatttggaaaccagtacaacttttcgacgtcggccctccagtacactttgctagcttgcagtttcacgggctctgtaacatatcctgaatatattcgcaacgacgcggattcctattagtccgccaaaatacgtggcgaggccctacaatgaacagagacaaaatggtcatgattttcgtggtcaccagatgagcggcacacgttttccaaatggggctcgtggcacagccatgattcaggaaggaagtccatgctcgggatgagttagggttcgttctctctgcctttgcaacttccaagatcgcgtgatagtttgataatgagggagcaactagaaaacattttcgaagttagtagcccttgagactcgtgtctgtcaacatttcccagacacctgcctcggactacaagtgaagagcgcagtcgcacagcggtgtagcctgcggtgacgtggacgagttcgcttgtcaaaagataagcagcccctgaaaaagtcagctcagcttcttctgaagcgtcgtggcagtgccttacacgaggaatgtttgagagcccagcatagggatgtacgtacaccacacagtaggcaccttcgaactggaaacccagcccggctgaggtagcttttgtatatttggctcgcccgcagggcctacgtttctgtggagccgccccgtgacgcaaccatggatattccagatgttcttcccacattagtgaaggggaggaaactcgtggaagacttccactgggatcaacgggaagcagatcttcgacaaacgattagcacgatcgcgagtaagctcgcagagctgcacagagaagacgcccatcttcgacagaaaaaattcattaacgaagagcggcggaaaaggcgattgctcgtaacagactcttctttcccgagctgtctcatagagaggacatctgaagccgcccctgaacaaggtgcttcccacggggtgaaacccctgtccagcagtcggtcatactgcccgtcaacgctgtcccgccgttctatcgaagggctcgaatcgacatctgggagcagtcgctctcttgcaaccaactactgtggaacgcgtgccactgtggcaagtaggggctcacttaggtacgtatgggataagggaagtagagacacaaccctatcaacaacacacgttttaggtccagtcaaagtcagtgtctgaagaaggaacgaagccgcggaaaaagaatgcttgtaccactgcgtaagcgcacgcatttcgtggtctctatcgttgactgttattgtagctcgatagcgcaccgaactggtcgttgcatgtcccgtccgccggcggtctggtccgcaccacagggacggcccaggtgggttttacgtttccagttgtatttctatttcagcttccaagttgtttccaccagtgagctgcaacttgtcaacgagatgagtggcggtgtgaaggagtatccgatgtatgatgacgccgaaatcggtagattcgacggtgcacggaaatgattgtgagtgtggtacagcaggggatcgtttttccaggattggcaaacatcggagaggaaatggacaaagaaatggctgctgttccaaaaagctgccgtgacgatgacgacgtgatgacgacctccgaaatactagaactgtgagctgaatgtgcattttattcaaaacacacaaggctaatagattgctcagtggaaacaaaactgttgaatcataccttgcgcgaacagtcgcgttggctgacagtgccctggagcgcgaccaggcttcgaggatagaacagttccggagaaagttctgtatcccgtgacaagtcctggacgtacgtcatgagtgttcttgctcacggccactagctaaactgaaaaatgtgttcgcatgtgatatacgaaaagaaatcgtccgtgtcggggggaaaactcgggttgtagttacttcaccatatatacaataatgccgctaaaacactagagatgatcacggatttctgcatcgctcaaatgtgcagttgtcctaggaacagcaaaaataatttcatctcttctacgttggcatgatgagctccatgctcttatgatcatctattaaggcagaatgcaacctattgatctgcttggccgcgtccaccgacggaagtggcataagaggcaaacgcaactcaatgtcctcaatggatcctgctctaagttcttcgactctacggatttaccttggctttcgtcttccggcagactactagactgtcttttttcagatttcgccttagtgaagcagcactaccgactacagctagctcgctcgttttctgctggcattcctagaccgcgagcaaggccatcatccgctcgttccacaccgcctgctgcagacgatcacttccagagatccctgtcgagtttattgagactgacgtaatccactcacaaagccgtacaaccttgaaacatacgcatcgagattcagtccagacgagcgaatcttcggacaaca

SEQ ID NO: 4018 - DNA, 3866 bp, Toxoplasma gondii
catgtgtctcaagcacatgggcagacctttcccgattcacttcaggacagcaagtgtcgaaacgggtttgcatctgcggttccaaagcctcagccatcacaatcacttcctacactgcagctgtctgtccgaccaccaggcccttttggggtaggccccgagactttaggcgtgacgaataagcagcagattgggactgcagatgatattggtgctgaggggaaaggattttgggatgaggatgatttagatgagtggaacattgacgatgtgcctgttcagcctcgattcgaccgcgacggccccctccaggttcctcagcaggcaccgtcaagccaatcaacaagtagtcaattgcccgtcagccagccttctttagatagttcgtctgctagtccacaggccgctgacagcttcagtatcggtcagatgcattcgaaggattctgagaaaatctgtggcttaggaagtatagtggctagatctggacagggattgccagcaggcatgtggcaggtctcaacacagcaccaacagccacctgaggggtctcacgaaagtcttgtagtgatgccatcggcgcagcaacgcccagccagtgccggacaccgtcctatagaggatctcttcagctgagagacctctcggcgggaaaagtacaaggggttgctgctacatcggagtacacagtggagaggtaaaagtcgcctcccggttctgagaacccaaactgaagatgcgtgcagaccaggtagtgacacgaagacgtttcgttgtaccgttgatctccgacagcgatggcaaggaaccgagtcgataaagatcagtctgcacgaaaaacacccagtaccagatttttcgacgctgtgttcatccggtagacgctgcagcagggcagagaagcaagtgggtatacagttgcttcggcgatgagcagtcgaaccgactgtggctctggtatggaaatgccggtcatcgaagttcttttcagtgtattgtccttcgtgcgattcattaacgaatcaatgacgctcgtcgaggcatggttggcacacgttaaaatgaaaaaggaacattctatgagtttctgtttgtgtacgaggactcgtgtcatgcggccattcagacgtgttcctgtgacgtggagcgcgaagtcttttgtctgagatagttcaatcgggtaccgtgttttgcagttgatgaacgaaaacaagtgaatgtttcggccgagcgcgtgtgtatgacagacagtctaaatggagataagggcactgtccttgaataaagtgtgcgatggagttcactggtcgtgtgaggatggtgttgaaggccagactttcccttgcaagcacgtatgctatctttctaaataatcaaggtctgttgtttcccggggtggtgtagggagccgaatactgagttttccagccatcaaaatggttacacacgaggtactgttctcacgttcgttctgtcctttgtatagtctctagcgcaaaatgtcgatctcagtcgtgcagcggttgtggcgcatcagtaaaggcagttcgatctccctgcttaaatattggttcgtttgtggaaaaataacaaatcaaacgtacagctttgaaccccccctgttagtagtattgggcgatttgtgcagatagtcatgtttacagtggcacaattcaagggttgcgcaagtagccttggtcagtataaacactggaagagacagtctgtaccacggagttggcatactggacaggaatggcaaggcaagcggaaccagtaaagcgaaatgctacagagtttgtcgcttctgttgcgtcggcgacttgctttcttggtatcgtagaagtcgaagcaatttctagtttcgggctcgtgtgtaggacaagtcggggtggcggactaacgccgaacgtagagcgtcatccgacgtttccgcacacagctggggtttggtggacataacatgttctctgttgcaagagtgctgtcgagtaaatcacctaaccgcaggcaggcggttttgacgatgtccaaaggcttcccaatcgcgtttctcacgttctcaaaacttcatcactcctctccccattgtgaggtataggactcgaacaacctgagcggcgggttaccacttgtcttttaaaaattgattgaaacgtaaccccgtgttaccatatgagagatgctccccgcgagacatggcatgcagtgcatatatagagtttagaatttacttggtttcacagtttactgtacgttatgggactgccggaaagtgcaggtgtcggaaggtgcactggcaaatttcaacagcaccgcatgactgtccgtgcctcacgcaccaaccttctcatgctgaaagatgaggcacgaagctctgagtacctcggaatctcaaaaatgtcattcaggttgcaccactatgttggccttttggcatcgctctggcattcttcttgtgagcatacacagttgtcaaactagaatactacgcgtatccttcgggtgagcctttcacggatttaggcaactagtctgcctcaattcaaattccgtttatctctaacaaatcttgggacagaaggaagaaagactgagcaggcgtcatcacaggtgctgcgctgcgtatgtgttgcgtttattgtggtatcgagggacaagacaatcatgggacagctgataatccatataatttctttcgggtgtgattcgcatctggatgctaggaatataaacccggttcgtaacatgctagtggaccaagagcttgtgaggtcggttccgagagttgcataaccggcagtgactaattacttcattctcgggagagacggagctaacaaatgggaggatcttcagctgagtacccgcaacaggtgtgtggcgcatgccagtgccatgatcgactagattccttcgtagttcgtggttggaacacgtaggaacttaatgaatgtactcgttattcttttcatgggcatgcgttaacgatacagcaggatagtgcctgttagaggcagatggtgtgcccgctatccctgtatttgatacaacaccaggagatggcgtcatgcaattctctgatttctcagtgtatgtggaagctcctttagttgttgagtcttacaccttccacttcgccacgcgcatggctgtttggaaatgccagcaaacactgtgtgttctaaactgccagcggcgaaacacagctctgacggcggttgtgtgtctcttcgtgtgtgtgtcacgaacacaagttacacaggaaaacgcaagagcggcggcacgacaaggtcgtttttgggcgtgcttcggttgtgattcgtggtcgctatggctttcgcccgcgaaacaatctcgagtttttttcgtagcactgtttcgtacacactccgcagtatcgccgtctcaatccgagtagcctttagaaatttatgtgtgctcgcttcgaacgtgaatgtgactttctgcgtaatataatgttgttgcggcttccagtagttgtgaataatatctgctagatggatactgaggcggtgcccacccctgttgaccttcaaggagagctgccaagagatttggccctgtacagatatacggattctcggttgtgggttgatgtgcgcgtgtagccgccgttctcccacactttgctcgctgtatccgttttcaggcattttttgttgagtgaacagggaggaactgagaacacgagttttcagacggttcataaacacttcgcaaaattccgcaatggaatctcgacaatctggtccagcggaaaaaaagctggaatgttgtgctttgggggcattattcgttaaggaatacatcggtgcgcggtgtttcgcgtaccttctcgcatg

SEQ ID NO: 4019 - DNA, 2627 bp, Toxoplasma gondii
gtagaagctgtggtaccagcgaaacggcatcacgctgcaaccgtattcatttccggttcggggatttttccgtgtaccacggacgacacggttacgctaggcatatggcggatgcccgcaagagtggtgactagctgcacccacagtgtgagattgacatgtgcccgtatgtaactagttaagacgcattcgctcagctgcccggaggtaacaggtgcttcagtaacattaagagtgcctagttctcatgttcaaccggcttcccttggtctgactctcatttgcatttgtgccagacttctcgcaccacctcttcatttgtgttggtcgattttctaacgcgtcaaagcgaccacgtcggttgtttcaaacgctcatacgtgtttctgccaaaagtgtacgcacctttggctaccgaagttaagttggagttgcagcgaacaaggagaaacaggaaaccgctaacactacagcacctgcaactgcaggaaaaaagacctggttgccactggcgttggaaattcggtcttgtcccccccgtttctcgttcttgcaaagatgatccccggttctaaatagtgaggaaccacgggacgccgacgctgcgggctttgtttcatttaggttcgagacgggcgtgtcgtctgtctgcttgtgtcttaccagacctaactcctcgacaactctagtcgacagccccagttcttctaattcttggtgctgtatacgggcgaaatcgttggtgttccattgctttgcttgcggcggttgagtcgatagcccctgtttccgtcttgctgcagcccgctgttccaccacacttgaggatccaagactgtcgcacccttgtttcgaaaacgatctgtcttcttcccttaatcgacgctggaagagcccacaaaaaagtgtcttttcttctggcccgcggccatccgttacaccttcactgttttcatctctatggcgctcgttccagaacgctgctgcttcactctgtcgcagtcgccaccgttgcaaacgtgttgcccggtagctctcgcgtttgtcgggcatcgttggttgttcgctgtctctgtggttcggctgttctttgaaggaatcgcctttcctccaacattcctgtcgccgccacgcttgcggcgtttccagggcagctattgctgcgtcgtatgcccaccgtgcatcatcgattgtcagttttggtggagaaacagctaggtccggatgaagttgcttcacaagtttagcataagcctgtcgcagctcctgcacggttggatctttttttgccaagccaagcaattcaaaggggtcgggcggcagcgtccctcgtggccaagaaggcgggtgcgattcgaggtgcaaacgccctatgtttgccgaccttccgtcggaagacgccgaagacaaacgcgcgatccttccagtgagaggcccgaagttgtctggctgcttcgctgcccctccaaaaaaagctctctttcccgccagctgacgaaaattggcagcaatcgtgaggcgagtggcggcagcaaccaagctgcatcggttcatgctgccgaccctgccatctgattccctgttacgctgtcgctgtacagtggttgtggaagacctggagctggcagactgcaggttggacgtatccttcgaggccagaaacgctttgtgatgaaaaaagagcgaaccgatcacagtttcgtgagccacacgtccgaagcggtgcaccgagcagtgtcggggttgctagcggacatatgcacacgtgccgtttgaatcaccacggcacgaccataaatcacactaaaccgatttacaggagagccaaaaacgcggaaatgtccatgtgagaagtccagcaggcgtgcgtgtcgtgtatgcaagcgtcggagtgacacggagacgttcctaggtaaaagaaggcagcacacgacctttgtggaaaatattcttcgctgagcaagcgggtgtgccaagaagaacagatgcacagaacgtcgtgggacaatgcaaacacatccgaactagagaaagcgcctctcacaagaatggctacgcgaaacggccgcggttgcaagactcggccgccgcacatgcatgcgacaacttcttggcagcatgcatccagtagagtgaatttgaaactctctcgtcgacttgaggacctttccactctacatttcttcacagcgaagcgcttgactgacccttcgtgccgttcgctgcttgttttgagactgtcctggtttctcgagcttctgtctcaccggtggacgtccagagaaaatcacgcgcctcgtccggaagcagagaggtagaactgccagcaacttgctgttctgcgcttcgtacatcgtccccaacagtccagaaaggttttgctgcatcagaaacccgtctgtctgcgcgaccctgctgcatacaaccgtgtcgtgtcttcgatccgttgttgttctttgcccgcctcccgacagaagaaaagtatatccacgcgtcgccggccggcgttttcttttcggaatttctctgagcagtgacacgcatcatctgactccttctgcggacccagcgcaccctctgccaactacttcgcgtttgtggagcctggactccacagagtctgttga

SEQ ID NO: 4020 - DNA, 3080 bp, Toxoplasma gondii
aagttctctgcggtgcttgcagatcgcgagctgcttagagaggcctcgcctctcagagaggcagagaagcgcggagaagcagaagcgactgcttgcccttcgggagaaaagagcggcaccgacgagagagtcgggagcggccttttgtggaggtcgaatacagctggcgagacgacgcctgctggcggagacacgtttccgtgagcaagcgacgaagaagtctcctcgtcgtccagcgaaacggattcaaatgcactcaacagatcttccatggtggctgacaaccagcgaaaacgagtcccgtttgaaaagcaagagatcagctaatttaggaactacggaagcgcgaaaatggcgagggggagcgaacgcaggtggaatcagtggcaggaagggcgtctcgcggagaaggaaacgccctcgcaggtgcgaccgggggatctcaagattaacccccacagtccaggaagcctgaggatggaaagcgctccaccgaaagacacaggagaacatgggaaacagaactactaattgcgaactgtcgcaaggaatggcactacccaaacgatttggaactaaaatcgacaggtgcagaacgcagtctgcgccttctacctcgcaagaacttcggcgggcatcctaagcggcgagctccagcaggtggggacgaacaaagcgtttgccagcgatcaggacgcacagaaaaaagcatctgggcaacgataaagaaaagcaaacgatttcccaagaagtcccgagtctaccgaagacgcagtcggtctaacagccagttgatctcgcagtgagatggtctcagaagcagttcgtctagtagggttgcctcgacagattcaaaaaactcgagagcggcaagtcggtcgctctcaccatgagcaagcacgcaggtccggcacggagaactccacgccgagttcgcgcaaaaactggtcgccgagaccggagatttgaaaggcgagccaacgacggcggtatgttggaactatgttagagtgtacacatacgccggagccgggcacacggtgtcgtgttgcttgagaacgtttcagaacatcaactgtgcagaagtcgactcctggtgcatgttggtcgctatctcgacagcgcacggtcgaaggcaccggggagagacagcctaggagaaacagtggggagcgaacggcaaaaaatgacgcgaattcacaaaaactgggaagcaggttcttcgcgagcgggttgccgtcttttcaacgccaggttcacaaaggcattccgctgcagacgtctacggcgtcaacgcgaaaggagagcggcggaacggctgggcacagcagagtgacggaagtaaggaaatgcctcatttcttcggtctgcttcgactcctgcgaacagtagtgaaaaccgaggcgcgggtgcccggggtcacgggaaaagcgtcacggacctcttgaagaagaaggcttttctcctttttcggcggagaaaacagcaaaaaaactggctctctcgcaggcatccaaagcgactcggtgcgacgtcgaaaaggaaccgtggaaaaactcgacagggagaacctgttcccgggaagcttactcgaactctcagcttcctgatcgcattcgtttgcgcagtgtccgcagacccgccacgcaggctacagggcacagttttgctttcgacgtgcgatttgaggatttctcgagcttttctcagcgtcccgattttcccgattttccggctttttgcagggaattgctttcgcagcaggttcagcacgcggaaagaaaaccacaaggggattaaccaagaaagacgcgaagagcggaaccggcacggagtgttgcccccggacacataaagtagaaaaccgaaagccttcgcgcatgcaggcagaggatcgctgccggaacgaactccctctgacagatatctacggaggtcaaagttgacacgaaaacatgttggcgaaattgcattcaaggaagcgaggacgcggaagtgacctcggtacaatcaaggtcactgggtcgcaggctgaccgcgttcggcttatgttggagtgacaccagtcaaaaagtgtgttggcagtagcggcggaaaaacacaggcgtctggagactcccatgtctggatcggcagattgaggacaaagtctccataactgtgagctcacccagtgaattgacctgttctgctcgataagggataaaccaccttggttgcgagaaagcgccctggacaactggctcacctgttgcctcgccagaaaaatcagaccggaacccgactcggactcaaggggaaagagctcgcctgtcaacttatttgtccctaattcaggtccagcattccgattttccggcgtgtgtgtgcccggaacaatccatcaatatagggctgttggtctttgtcgcctcctgtgtgtctgcgtgcgtacgtctcgccacacgtgcgtgtacgggaagcgggtgcctttccactcgaagggaatgcatctgatatgtgcagatctttcgaagtatgtaagtgtatgcggaaaacgacatgcatgtgaaattgtctattcgtacccagaattctgtggactcgggtgcaacgcggtgtctcgtcgggattccgagaggtgcggacggagtgtgctaccaaggtggttccctgcggtcgtaaaatgccatttggagttccaattctcgacagagttttctaacccgagacttcgctgagggatgtggcattctgcgagccacactcttcgccacgcttatcgccagaagaggttcggcttgctggttccgtcccttcgctgcagacaccgagtcgcacgggagcgtgagtgaaagcgaagcgcgcggctcttcggcggcggattcccggaagaggcaggtgacaagacgacagttttcgtgtttttctcaaatgaaaccgagagaaatggcgacgagaatgagaaggtgatgtcgggagagtttcccgcctatcagaaatccccaaagaccgtgaaagatgtgagtgcatgcacgaacgctccgttgtgttcaccccccgcgccgggtgtacatacaccaggatttcgttgggggtta

SEQ ID NO: 4021 - DNA, 4086 bp, Toxoplasma gondii
gttgttgataccagttcacgggagcttgctcgttagaattgcaatacggcggttgagaaggcgaagcccctgcacgaaactcgagagccggaatctgagagacagcggccggcgaggtcccgtactgttgcacctgctgctgtggtggagagccggcctgcatgtcgccgttgcaggcaggggcagggtaatggtgtggatacgactgctgcatttttctagaaacgccgcgcttgactgtcgaattgaaggcggaatgtacacctctcttttagcctcttccctgcttgtctgggccggggacccagagatctcacgcaggggttacctcttttaagtgtctgtacagcgggtccgagacgaagtaggttgacgacgcggaaaaggacagagaaacgcttgcaggaaacagaaaggaagttcacaaacgtcagtcacagggcttttttaccgaactccttcttcagggttacacgcgactgggcaaagaatcggcactgtcgaaaaaactggaaccgactcactaccctgtacctgacacagtgcaaaaacgcacactgagaacaagaaacataactccgactcgtgactgctgccgaggacgtcgtgactttcagtcggtccggatgtatccacggaccatctgttgaccacagagaatagattaaggcaaaaaagcgacgaccgagagggaaaacgacaacctagaacagatgcgaacgaagatggagatgttacatcactagtttcgaccccaaggctcacgatttcggctcctccaggcgaagagcttcagacagaagcgcatgtgacacgaatctaagaggctgcatgtggtactccaaacggaaggatcagtatcaaccgtgcggaattcctgagccgcttgtcatgccaacacaagattcgtagtgggtctttacccactgaggacatccgagtggtataggcctctcgattacaggagtcgaatacaacgcgtatgcaaaaccaattcagagtctcacctcgagacacagcaagcagcaaaagtggtgtgacgaccgaaaacggttcgtttgaaggacgaagacaacaaaaagaagagagtttacggcgcccaggctggagataaagaagcaaaaactcgcctcgcgtctccaccgagagtgttcatcaccgagcgccgtagaaatcacagacaggctgcagccgcaagccggtgtagtggcaagagcatagcttagcgaggctggagaattgttgcacaaacagtaaccgacgccttgtcaaaccgggagacagtttggggaaaggaaacgagcagagactggtacagagttcagctctgttaattctgatgcgagtacgaatggagtagagaagtggattacattactggtgtcacacaaacgcacgcttgtcacagctcagtacatctcgctgaatcaatcgggtctagttcatttctctctgtctactctctggtctttttaccagtaacgaatccgatagttttgtaggggtaacaacggaaagcggtgcagataatccgattttctcgcccttcgccggtgcgagcgaaccaaacacacctcttgtctgacagtacgcacgaagatctcgcacagcgttttcgcttgtgaagcggaaacggtttctagtccagggaaaggcagagacacatcagagaccagagagaccaaaaggagagaagaaaacgctacagatggagatcgagcgtccgtggctcggtggccgcaaggttggtgcacagcaacaagaaaaccttaatcgatgtcgccctagtgactttttcccgcggggtgcatgcactagtgttacatagatgcgtgctcgagtgccagcggcgtccgaaccgcgttcgctggatgaaaattgttcacactagtaaacatacagcatccgacaatgagtgaccttctcgagaaacagctcagacggaaagctgcgaaaactcgctccgtcgcagggctgtcgaggggttttgctaaaagtggaaggcaaagggcgacgtcaacgggaaccggaacacacgaaccaggaacccttctgtgttgtccagatgcctaaggccaaagaaccatggttgccgaaggtggcggcactgctaataggaggatggaagtgcggtacacactcgtcagtaggagtgttggggttcttgcgggcatctgtcttgtccataaccagtggccttcgtatgtgcgtgagtgtttttgggttaagaaattctcagacacacaaaaagaactctgtctgtcgtgagccgccaagacactctgctgaccgtttatattgttgtttgtcccagggggacaataacgcggaatgtggacgttaatgatgagagacacgttgagaccctttttgacttcaaaatgatggtgtcgagcctgtctcatcgcgacgacaaccctgccactgtgattgatacccgggggtatctcttcagctaaactgtctatagcagcatgcactgcttctggcaccaatttctgcgtcataaatgttccagaatcagctgatcccagctagtgattgacccgtaatagaggtggggcaggcttgttactgcgtgagtactcaatctatctgccatcatctctactgaatgataggtaagtcgaacatgtctttggccttggaagctttgctcaccccccttctcaaatccgttagcggcagtgtgcatttcaccgaaacgcaggtgcgcacagtggggacactgggacgtggtgcttcaagtgtcagcctgttatataggagatgacaacacctgctaccctctgctcgaatctcagatagagatcctaaacgaatatgttacataagtgctaacaacccacaaacacacgatgttttggtgtgcttagcagtggcattcctgtactctggcagttctaaagacgcctagtcggacattttagctgtcgtacccatgcttgtgtgtgttcacttttataagcttcaattccttccagataccccggtggattgcatcagatgccagtaggtgcttttcagcgatgcaggcatctccctatcactaatacacgtcatacggtgacgaagtatccaacagaaaagaattgtgggaggaaacatgctcatggtatttctggagtacagagacagtgacgcaattctacgcatcgttgcaagagacttcacagcgccgcagtctacgccctgataaccagcgagcgccggcgacacatgtaacttgtcaggttcgagaaagacaaatgaaaaacgtggagcgcccaactgcgagtctgcagatacccttattccctctgatgtctgcctatgacactggcacctttacacgaggcctccacaaccggcatctgcgatgtccgggttgcaacgcatcagagcctagaagcctcagagttatactcctgttccacctcaggagaaatccacctggttcacgaactggaacgcccgccaacacagtaccctcgcaatccatacttggattcaaagcgcttataaactgtcagattcaccagttcaatatatggaagactcactcgcggctgaatcgttccacaacatgatgagcccaggcttctaatcagcttttctcagtagctaaaaaatgttatggtgcaacccaagtccatcgcctgcttccacctgcttctttggaagaggatgtgcctcgcgctctggaaaccgctgggatccggtattcacagtgacttcttcgaaggccggtgaccacttcttgcggagcaccgcacaagccctgcgtggctttgttgccgccacgagcatattaaacggcgcttcggaaaaactcttggagcatcagaaagacatacgcggagaagtggagaaatttcgtcggaggtgccaagtttttttcacatgccctgcatgcattttctcgatgttcctgctacagggtggaggcatgcacatgtgccatcgacgctgtacagcaggagacgacacaacaccaaagcgagaaaaacccaatgtttttccttcagtaaagaaattcctgcatacatacatattccgtcatttgtacttgtttgatcttaggaaagaggaatcgaggaggcaaga

SEQ ID NO: 4022 - DNA, 1405 bp, Toxoplasma gondii
gtacttgtcgacatgtgtagtgacataaatgtattattttgtacaacccaaataggtataaatatacatatatatatgcatatatttgaatttctacataaagatatatatatatatatatgtacttatatatatatatatatgtacttatatatatatatatatatgaacacctgcaaaaggtatccaagtggggaagcgttggtaggaggggcgacaggattcctatttcgcgtagaccctagagtcgaggtgtctacagaagagtgcgagcagcgttttctgtctctcaaactcgcatttctactggtcttgcgtgtgagaaagaatagaagtccagaaaccttggcctctctgctccgactttcggagctactcatgcaacaggagaaaaaagcattctcaagcagactcttcccgagattgtgctctgcagtgaggaagcgaaacaattatggggacaagaaagagagttagggcctcatcgacgcccgacaaaacgcggagttgggggtcctctctcacagttacgcgtgtttctttcgtttaaaagcttatggtatatacttcccagagaaagatagcatatacgtccccaggaatcctgtgtaacaatttgtaactggaagtctatcagttctccttcgaagttcaaaggccctgcagcgagactattttgaaacatctgcgtgctcagcctacgacgcctcacggagagtcggcgcctctcaggcagagtttctctcaaaagacggaaggtgacaccgtacgcgcatctgtttccggaggctctttggagtggtatcgaggagatgcatccaaagcgacgtctgacacaaaaaaagagacggagagaaggaaagagaaagagaaaaggccctcgagaccgcttcgcccgattcggatcgacacagagacagaacaacaccagcgagggacgcggtgcgagagaggccgcagctcactgtgcatgcaaagcaagaaagcgtatcttttctctgggttgtgcgttttctctcctctacttcgtcgaagctttcctttcgctttttctctgttttcttgattcactcccttctggatcttgtctcttcctcgatgcggctctccctgctctgacttcgctgtctcttctctcctctcgagtcttcaccgccttcgtcataaaaactccccgcgctcaaccacgaagtcgagactcccaagcaactctcaactttctctttctcttttcttcctctcttttttctctccgtcatcttctgtgaaaggcactgaaatgcagagtgtgtgtgcggcgccatatcactgctttgctctcctctttctctcctccacttctctttttcctgttttttccaagtttgccggtactaagagactcacaccttgacaagtcgcagca

SEQ ID NO: 4023 - DNA, 1351 bp, Toxoplasma gondii
gagagatctctagtcatgtgtaatgctttacgtctactagcgaggaaacgacggtatttgagagtctcgtttaaaactccaaaaatgtcataggcagatatggatgcgcacatatctgtgtctgctcagattgacaatttccctacgctgatggagagtttcttttttcgcagagagaaagacaaactgcgtagccgacgacaagttttcctgcaccatgcagagagattcagtgcccagtataagtttcctgtattgataaaaagaggaatgcatcatggtgcatgcttccctggttttcatgtagagagaggcggaatcaaatatgaatgccaagaagaaaaaggtattcgcgcatgcgttccttaggggtggaccgtgagcgagcagggcgactctcccatgtttttcttgttactttcgctaccgtacgccctcggaaaaaagaaactcgcgcctgtgcgcgttccaaccgcaatttcgcagatcttcttctacctggaactctcgattctgcaggcataaatccggtcacgtacgcctctgtctctatcgctttttttactttctgaacatgcgtttatccgcaagagtcttccacgttgggcgcgcctctccttctgtgcacacattccatctctagacatcctcacgtcaggcgccattcatgagtgccattgccgtcactctatgtcaataaaaaaatctacgtcaaggtgcattgcaccgttcttttcaaaagtctcgccagacacattcccatacagctcatatatcctgcatttatgcatatttatatatatatatatatatatttacatatatatacatatatatatttacatatatatacatcacttcagcacttcaggggggcattcaggaatgtaaatccatgtgcatatgcggacggcagttgaaagatgacttcgtctcttgcacagctgggagtccgaggcgcgcggtctgtgaggagatttcttcatgctctggagcggcccggggactcgcgttttcgtttttttcatgcctgttgagttcgtttttcgaaaaatgtggagcgaactcttctgacgcgtcacacaccgaactcgacgactccgaagtgagggaagaaagtggagagcattctgtgtcaagaaagaaagctcgattttcctcgctctcaaaagccggtgcgacgagcacacgcgacagctgagagcgcatgcagttttttgcgcagccaactttttcggaagttatttttctggaccggtttctccgtcacttgtcttgtttcgtttgtctcctttgaaacctttaaaagaacgggacagagaggggaaggctcggagtgcgagagagaaga

SEQ ID NO: 4024 - DNA, 5005 bp, Toxoplasma gondii
gagagcgaaaacaattcccactacacaaacactgacgataaggcgttgagttaaatgaagatcgtaggtttctccttcaacgagaaaggacggctgggcttttttgccaaacagctcattggctgtttctttctccttgccactacccgcctcctcctcggtggccacccctacagccgtcacgtcactaggaagtgaccagccggaaagatctctgtctcctgggtcggagttccttttttgcccaatgtatcgaagaggccggggaggtgacacatgaggcagtcggttacctctttcctctagcgtttcagtgttctgcttcggtgaagtgggacaatcaccgtcggagtccccgtgctcgcttccttgcgtctccgcctcatgtgagggccccaacgggtgagtgccacatgttggtcgcatcatttgggccaaggcactgtcgaacaacagaagttacggaaaagaacttaggagcgtaagagatagatatgcacaattttggtttgcgacgaagctcaaataaagggaagaccgaaatgcaatgtttcaaacggaatatatcggccaagaggggaccaaaaatcgagatacctgatataattaacaaaaacatcggggagagggaagaagacagagaaaacgaagacagcagaaagatgacacaatctacgatgacgaaggtagacaataaaatgagaagaagacgagagaaatacctgcaagagaatatccagtggtagaaggcaaatcttcacccgacaacgaatggataccgacccaggggcattgagcatcgaccaaacgagaaacgatgctcgaaatgacgagcaaacaaaaaagaataggccctaatccctatgccgggatgataccttagagattgagaaggccggagatgaagaccaccacaagcgtgaagaaatagagacagttgagacatgccgctaacacagtctgtcttttgtatgaaaaaactatcagagtgggcacctgtcgagtcaggcacacgccacaagcaagaaggctacccgactgatactatgacctgactatcaaacacaaagtcataacgcgaaaaaagggatctcgagtgtacgggcacagaggtacgcaaacgcagacaaactgtcgaaaaaaaccggaaggcagtgtgatcgaccgacgaacaagtccgcttggcattcgcacttatgcagtacgaggtaacttgctgtgtgtcgcaaaaaataccggaaaagatcaattcagaaagaaagctcaagaaaccgccaacaggtattcgccccgtttcttgagtgtatagcgctgtgggatattaacatgatcagaaaactgatgtgtgagcgaaaatcccggatgaaaaccacatgacaatttactggaaatagaaacgaaccagtgttttcgttcccgctggcgaagtgtttcagtcgaacgtcgtcgcgctacctcggcactcaaataaaccacgatcacatcgacgcccaggtcaaagcgttggagtttttagtacaatgcctaccgaatagtccctcctgaaagccacccgatactttctggtagctcgcggccatacggtagctagcatcaaaaacaacagggacaaaaacgtagctcgcagaaaccttgaattcgtcagtcagcccgccaaacgccaaatcgacgaagacctcaacaagaggaaggagatcctggacactgtgaagtacgtaccgtttcatccgggaaaaaactgaacactgatagaaacaccgtgcaactcccacagcttgttgtatacagacacgtgtagacattaggttcaactgtaaatatatgcacatacataattgtgtacatgtagaagtcaaaggtactcagagtgttgtttcgaaggaaagagcccgccagtaaagcatacagtaaagcgagatatttcacctacgagtccgcctgtccgccccgccaggcgcggcagtctcaggtgaaacagatacccggtgacgcaagagtattacgttctcattaccggggaggagcagtcgattcttccgctatggaagacaaacagcgagaacaaaatagacagcaacgttgttgtcaaagaggagacaacatttctcattctccagacgcggatctacccattcttactcgtgttcggcacgaaactagcttcattatcgttccaaaccatgttgaaagagacgggtatgtcagggtggctcccgcgagccgctcgcagcggctcctccgaagcgttcgctggcgcgcgcttgttggcaaggagattgagaaaacatggcacagacacgatcccgactagatggaggatgtcacacgagtgatacaagctaccacaaatgcttcaacttagtctaccagagcgttcgactttttggaagcatgcgccacagaaaccctccaaaggggaatcttctgtccttctatgctacatcactcgcctgcttcaacacgccgatacacgcacccggcagcagggtggttacacaacggtgagggaatactgctgccacgtgacgcttagttgtatggaaacatgatggcgaatacactgtcactgttttttcgccagagaatgcaggcgaggaaactcaagaaggagcagggacactagggggcttcttaaaggtaacgcaacaacctatgctgcgtaatccaggcagagagatgcagttcatcgttttccagctttgcgaactggtgatttttccaactgcagagtcattcaaaaacagttacgctctacagcaagttggtgaagaaacacagtagtgtggcgtgtacactacgacacctcgccactcgctcttcctctctcgacgatgcgtatccacgcgtttactacatgatgcttcgaattcgaaaagcgatgttctcgttgaactggagttctgagtgtttccctctcgcttcaaagagtaaaatggaagcaaatcagttgcactaaaggacatgtacaggatgaccagggcctggtgtctttatcaggcgacaagccgtcctgttaagcaacgcaaataatccccttcgcgaggattagcggattggaacggtttagcagaacgcaggcagagatgtggcggcgctgcgggcgggaaccgttttgggtcgcagcgtgttcttgtgtaccgtcgtaagcacaagttcctattcgtttcacgttgtcgtatgatcaaggcctccgctgatcataccagtccgttttctatcatcgtcttcattcggcttcgttggtagccatgtacacggcgaatgagtgactctaatgcttcggcgttgttgagacttaaggcgggaggagcgagcagtctcacgttccgctgatcgctgacccatcgagtataaagtcgacctctctactacaaaatgaaaaggcgcgatgtgatgtgaaactcgagggtgtgttatgtatgcatactcccgaggagaggttgggatggtttaccgctcgcacacccccctagaactgcctgtaagcgcaaatccactgcgaattggtcacaagagtgtgcttcaggcaatgcagtcacatatcattttctgctttatttctccccttctgtagcatgtgtccgtttctgcgtgtgccacatagacctgcttatcccactcccttcgtagaaaccgcatcggtaccctatattttgcccaaggggcatggcacatcggcagatacacccgaaagcatcaattttatccagcattgaactggatgaagacggagggctgatcatttatcatccgcctccgccaagtgtcgacattcattttgttctccctgtttttgtgtgaaaacgacatagcggaggccccccttttctcactattttgaaaggattatccgggaggaagacgacaccccccccttcccttctgccccccgcccccccaaccaacctttccgttcttagaggttttcacaatgtaacccactgcgtctttctgggcaagtatgggtgacatcggtgttcttccttctgcttttcctcgcgtaaccgattcttcgtgtttcgctcgtcgaaatcgcttttccgcccccccttttgcaagggtcgctcctgtgcaggacgctgcacacacgctgtcggggtcgccattgtctgagatatccggattccttggtggttaagtgcgtagattttttcatcaagggattgacgtctgttgcttcccgtgcttctcttctctttcccgctacacagtccactttctgaatttcatgtgtttgtcatactccctctctcgtcaccacacttgctacgctcccgtcaggaaaaatacctgcaacgaacaaaccgctgtcgtgagctgctggtggcccccctccaaggtttgtggtgcatcacaccgcagtgtgtgttacgtgtcgcttgtcaaggtttactcgaacccattcacctctattgttttccttgttgaacgcgggaatacaggagtgcttttgtaatcaagagggcggaaacgtcggcagcaaacgggagataacccgctgcgacttcaagtgcagttctgtccatcctgggatcagttaacgaagttcttgtctgtaaacctgaggaactagagaagcatcgtcggcgaggtcagttttccttcatcaaggagtgggctgtcgaggtttcgactctgtatcttttacctccgcgagaaaacgaacagctcccgctggttcgttgtcaggatgtctctccttcctcggacgaacgcacagatcgctcgaacacccatttgtcaatttcctgccttcgcatcagttcagcggaatcggtgtctctggaagtctgtgcaaatcccctcgcgcggcagcagcagctaagtcttctcaagagaagcgacagagctttcgtctcgggcgcagcaacctgcaacacaccaagattgtcagccctccgctgagacggcttcgcgcctctcgcttcctctgcgcttcctctcctgctttccgcgtcttatcttcctctgctttcccaaaaattttccgttttctccacgtcga

SEQ ID NO: 4025 - DNA, 2921 bp, Toxoplasma gondii
cctcttcgcagtccacaaagtgaaacgcgtctgacgaagaaaagaggaagagcgacgcgaagaccgcgggtccggaggcgaaggttaaaaagctacagggctgatacgcagattccgtggctagacaaaagaagacgagagctggacgggtgcagagagacagttttcataaaaacgataaatccgcgcaggggagatctctgcgatcgcgggtcttctttgatcgggatcttaagatccacaagaaaactttttccgtgtggaagccaagaggagacagacagagcacacacgcaagagctgcgggaaagggcgagaaaagttgtgaatcgcggttaacaaaagggaaggaaagagaggaagggaggcacactgacgatgagaaagagaaaagaggcgcttcgcggacgcaaagttgacgggaggaaatgtccagaacagcttccacttttccttccttgaccgacggaaaagaagcaaaaaaaattctcatgcgctgtcgactttgcaccaggggaccggaaccgtttgcagatgtgcgtgcattttaacgtatggatgcgacttcgcattcaaacgatatgcatcagtacggatatagagcgtagggaaaaaaagaaacgggagaaatgtgcatagttggacatgcaagcagagagagccctggtgcaacacggggcagtctggaaacgcggcagacggagatcagggggaactggcgcgagaaaacggcaattgacaggcagagaacagacaacgaaagaaaggaaagaacgaaagtgctgagacttttttgaagccagcgagaaaaagggtgcttgacatgtccaaaggctctgctctgtaggccccctcaaaagacagaagcgaagggtggttggaggcgcacgacgcggccggagagaaaatgcgtttgccgcaaaaggcggggaaaaggtggaaaggaagccgcacactcctttagtggaagtgatcttgaatcacaaggaaaacgcggaaaatatgacgtacaaggagagtaaaaacaacacggccgggactcatgtacagaaccgtctgtcaaatgttcgattctgtcggtctagcgaaggcgaacctaagtccgcacattgaagcacattttgcgcatctgcgcgtgaatgagctcctcgaaatacacacagtttctgaaaaattccacagcggtacacatctgcttacggaaaaggattacagaacacgcacaaacccggcagagtgcacagtagggcggtcacaaaaggagtaacagtaggcgcctgccagcgaaaagaagcttccctcccggcgaaaggcgttttgcatcaacggacaagacgagaaagcgaagggaaagaccaaaaagtgactgggaaagagagcgacggatgcaaaaacgtcgcctcgtcgtgtctcacatccgggcactcgcctcgcgctcgtcgcctacacgcaatatggtcgcagaaactgggagttgtttgcaaccaagaaaaaggggaaagttcacacttcccggcgcctctggcgacgtcacacacctgaaagatttctgctgactcagggggaagtctgcctttccgcgagtagggggaaatgatatcgggagaggcgaggcggcctcaaagtgtatcgccctctatgtcgtccccttgggtacaaatgttccagaagaagaaaacgaaagaggaagcgactgcagtacaggcagacaaagaggagggcatccgcaactggacgcgttccataaaataccaagcccttgaggggcggcagtggagactccggttcccggtcttgcgcctgctagttggtttgatgtctcccgcgtcgtcgaggccgcacggaaatgtgtgcttgctgctcacgaaacgagaaagatactaggcaggcacggggaagaacgcaacacttgagctggtcagatacgcgtaagaaaaaaggtttcgggtgtctgacggtagcagaaccccgcagaatccccacgcttacagccgtctccctactagccgctctctcggcgtctcaatccctgtgtggtatcgttagctttttgcttcggattagaaaacagttggtcctggggatctgaaacctttgcgcttggcgaaagcaaagagatactcattctttccttaccctgtccatttcggtctttttcttattcaacgggcgtttttgtctggtagcttttgctagaaagtcatcgtagggggagaatgtatttccagtcccgttgtgctcacgcgttacagacaccggcgactgacgcaaacggattccaaggaatctagaggtggcattttgaaagcgcatgtaaacaggggagatttacactgtagtcagtgtatgctgcgttcgcctgcatatctctggaagtttatctacgggtgtgaatagctttgtaaggcaaagtggaaacacgtattcagacagcgtggatgttttttagacagatccttgctccgctgtgaaggcttagaaaatgtggattttcaagcacaaattcttacgcagctgaaatcagtgaacttgaagaaccgtcatgccatcacccgcgtctcgtctccaagaacatagcatctccgtagtagtttcttctggttgttagtacaagtgaaacactaagctctgtatcatggctacagcatagtcggtatggtatgagaacggcgactggagatcatcctgtttcgtatatctgtttttggctccccagtgagaagctctgagaagcgtggttcgacatcgggaggctgtggctggacgatttcttcctgcagttccgttggatgtgaagatgtgcctaaatcccgcatagacaggaaattgtgtatgtgtttatttatgcgcgtatgtattcacggtcggatccactttgtcggcttcatgctagcgtgcaagcacttgtatagatcttcgga

SEQ ID NO: 4026 - DNA, 1579 bp, Toxoplasma gondii
atgaaattctaacatgctcagcctttagcggaaatcatcgagcatgcaaatccgtttttagaaatcacagcagcgttcacaccacctgtggactcggtcgaggaagctttcgcgccgcgttttttgcgatggacggggagcgaaggttctcgtctacctgccgggccatttcgagtcttagattcaatggaaattctttttgagaattttaggtggacgagaggtcggaaccgaccactgaagagaagtggagacgcgcacagaacaagcggtctactggtaatttagaatttacgatcgagataccaaacgtttcggtttgttcatgtcggaggcgcagcagagagaggaagttcacacgggcggaaacggtagagaaggcagggattctgtgacagctccaggtttctctcgttcgttctcgctgaaaagagcgaaggtttccggtcacttagcgaaggcagacgacgtgcatttcacctaaaaatgtgtatcgtctttgttagaatcctacacctgagcactgatctgtaaagagcctgaatctactcgagagcatcccctctataaataagaaccgacatcctttttgtgcgagtcacatctgcaagtaggcagagaggaagacgaatcgcatgtgtaaggagaagtacgttttcagttcagtctaccaaagagcatggctcggtgaaagttgcaggttcgaacaaaagcggtgctttcaaccaggttattccatagagagatggacttgggtgtgcacaacatcaagaggaggttttctgcgcaacatccgttcttgcagatagacaagaatgggggacaggggcacgtttttttaacggaaatcaaagaaatgtgtgagaattcgaaagttacgtcgaaaggccgattggttgtgacaaactcgagcggcgtccgcgaagtctttcttgcatgcgcgcatgcaccgccctgaggaaaaaagggcccaccttggacgtccgccgttttggaaaagatttcgcccgtaaaacgcccgtttctcctcggtaatgagaggcctcctaaaaatcgattcttgcgtctgcaaatgtcaggcgacaaagagagaggacatgatctgagcagacgaacgcgttttcgtcggcgcgagcatgcatcgtcgtctcagaaaaagaaaagatttctccttcgcaggcgtagcgcgttcttgctctcctgccctcaacagtccctccgttttctctttttccgtcgcagttcttcgctcgccttcccggatcctcgctcttgctgcttgcatggctctgtctgtgctgtccaggaaacgcgaaaggcaggaagttgcctcagcagacgagaagtctttctttctgagaagccgaggaactctcgaacttgctctcttctcttcgcgtctgtctttgcctccaacgcaaagtcggcctgcttctgctgcggagtttcttctctgcagggtgacaagcagcgaacgaaacgtcggctgtgcatgcatttcgtccacatttaattaccgattcgttctcttctccttcgcgcgccaggcggttttattgcctctgcgttcttccgaaga

SEQ ID NO: 4027 - DNA, 2332 bp, Toxoplasma gondii
taggaatgcgttactaagataccttaccgtttggtggcgaacgaattgattctgaccggctacaccggcggaactggaacctcctgtagcgtgtgtatggcgctgcagaccgtgagcagcagtctgctgaaaactctgattgcctgaccttgtgtatcaggtctttcggtactgcccatttctcaaacgtgtctgttttggcacaactatcggacggacacagaacagcgtcctctattatctgcaggtgtgtttgactgggtgggtttttcagcaggggaccacgcatgctaacacttcaagtcaaataacatgtttgcggcgctacgcctgcctgcacctttggttcacgaatatgctatgttgccgccagccgtggggatcgttcacacaaacgcatttctgccttgatcgtttgagaacgttgcagtgtgcggtctgagctgagcagccggctaacgggtgtgttgccttgcactccggggtacgaaggaaagccaaacgaaaggtgtcacagatttttatgaaaatatagaagtggatctaggtggtgggtccccaaaagcgcgcctctccctgtagtatggatatctgcggtagcatcactggtgttgctaccatgtaagagtgctgagtctcaaattctgtttcggtcaagcatgaggactgggggcgttctagcacttacctcagtgacagataggctacgtcttcttttgagataaagcaccctgtttctcgtgtgatcattcaaggagaaaaatcgagcaaacttgttcgcaccacggcgaacttcctctattaacagagtcacatttacattggatgcatgacgtgcactagttgcgacccgcggtagcttaggcatgagcaacacgcctgcgccatatggtagcgccgaagcagttgccattaccgtgaaatggttatctgttcgtttcaataatggaggggttccgttgctgcttattaggctgtggccgcggcaggatcagtcactgtctcgtaccacatgggcagtaccctttcactggaatttcgtcgtccctttactggcgaaactcctcttcctcccgcttttcagcccttacctactttttccatcctttgtgccctccagtctttttcggcatgtgctcttcatgcgcaatactttgcgtgatgcatgcgagtcgcgctcagttccctggggaagcaactgatggctggtgtcataccaggtgctaactcgaatgctgtcttatctattcttgctgaacagatagttatcacagttccactgtgtcaagccgatattttcatctacgttggtgtcggcaaacaatctcatgttttcgtagccattatctgccactctgaaccggacggtgacgcaggccgtctgcagcaatttgccgtagacctagggtaaatagacattcccgatcttgatccccatcaaacactcgttttctgtacatcaattttttcaaattctggcattttgatgcattgcagcgtggtaacacatcaacattcgtagcaatggtggacttggcagacttttcattgattgtgcgtaggactcattcgaccaatgcatgaggtgcaacccctagcaacgaccgagtattcactggtctgccccaccgagtggcttgtccagtgtcggatcaacccacgaacagctctcggtttctttctggaaaatttttggagtggactcatgcaatggcgactccgcgaaagtctgccatccatgctatgaaaacaatcaccccaaagacactgctgagcaagcgcgctgtttgcttgtcttagatgtagttggcgacttgcacgaatctcgcaacagcgaacgccacgttgttcccagcgagtacccgaagctcagggtgcgattttgctcgtctgagtcttcctcactcctttaaagagctctgttcatagtcgaccaagttcgtttttctatttgcgggaaacttctgacctctctgatgcctcctacgcgcgctcctcccttgctgccattctgaggtctgtctgggtgacctctctactccttcatttgtatagtcttttctcgaagtatctttcctatatgtcggggacatcgtggtgtacgtattggctttgtccttgatctctggaacaacttcggctgtgatgctttgcgactcgtagcgcgcgcgaaattccccttttccggctcctcgtgcgtttgcccgccacttgcaatctatcgtacggttaccgaatcttcttgctcatttcgctctgctggaaggattaattccggcactttttcactagaaaccttctccccttgagggaacaaaacccgtgtccaaaa

SEQ ID NO: 4028 - DNA, 2318 bp, Toxoplasma gondii
cacgagggaggtatacacaagcatcttgtaatgcatgtgagtttttagagtcttgttccagattcgggacacgagtgaagagtttgtgttcaaaatactagaacttctacggaggaacagaaaccaaacgtctgaaaaaggagacgaaggagaagaaaaggaagtccatcgcggcttggtttttccaggtcaacggaggaaaaaggaaagaacacaagtcccggagtcgagccgcagtttagaagcagcggcagtgtatcttgtgttttgattcccgttgagagtttctttcatttccttctcgcgtctgtcgaaccaagagtagccggcaatatcttgccgttctagcgcacaaaaaaataagagaggctcttgacacctgaggaaaaaggcacgccaaggaacggtgaaaccattttagaagtttgaggaaacccaccgcgtatgcagcacacactgagaaaagacggttgctcatctggagtgaatgacaaacagaacagcagttggaattcaactaaatcgcgtaccagcagtcaacatcatacagcgcgtgatgaactgatgttggtagacgggatttcagaaagtccgcggcgaagaatgtgatatcaagtgtctggtagggaaacaggtgcaaacacgacccgcatgtccggttgaaaacgcggcaacaaaaaagaccagcagagacccgactggcaacaaaaaagaccagcagggatgcagaagcagtgggctaattattgtcacgcgtatagccagagttttggaggcgatgtggtcgttttctgtccgtgactacgggttgattttagtgatctgggttatgtttctctctccacgacattttgtacaatagcaggcgaaatcgtttcccaccggctgtccgagggatctttccgcgaccttgtcgagattcacaaaagttaggagcgcaagctgccacgtgctgaggtagttatgccgatcctttgtcatttagatctcactaaggagtgtcctaaagaccacatgttgctctcaaacgtcgaaaacgcgccagaactgctgcatttttcgtagggccacaagggatttcgccatgcgatacctctgtggagtcgagtttcttcattctgtaggtagtttcacaatgtgcctctgtcttcagtatacacacgctctgcgttcctggaacccgggagccttcctctcctttttcggatttgagctgttccctcttggtgggtggtatatgttctgctctctttattggctgttatgttctttgaaacaatgttcgacacctctgcgtatcctggcaataaccgtgacctgggttcccccagtgcggccctaactcgctttctacagcgtgatgccgctcgagttcccttcttggtcctgcgtttacacagtcagagacagatctgaggcactggtttactgcgtgatccacttcaatttgtctgaaatttcctacatatcttcactgcaaatagagccgcgccaggaataagtcagctttgttccggaattgcaggtcaaccaactgttctgcagtcgggattcacatgttttggcgcgtaagatgcaagctggcttcatcgctcgtgacttggagccgaaatggtggaatataaggctctgaaaaaagcggggaactgtagcacactactactgacggacaaatccagacctcgggggctctgacagatgatagtattttgctctcgttcatctgaatggaattcatcaggctggtctcacataaggcattgctttttttcaagctctcccggtgttcgtgataccgccttaccagttctggtgtggggtctttcgtcaccatatctctctccaacgtacattttccttcagtatcagcctctgggacagctgcgctcgactttcgctccgcagtttttctccacaccaaaacgaggcatcgatgtgtcttgtttttttcgaaaaagagaacttgaatcaaagggagaaacagcttttttcatggtccatcttttcgttgagctgcctgagccgctccccctgaaccaacgtaggtcaaaagatgtgcgtgtacgagactgatctataacctgcgtgcttcttttctctgctttgtcgctggcatggtttcagattgctctttctcgtgcttgtcactaaacttgtgcgatccaactctgtattcatttttcattcattgtctggtccttgcaaatgcgtatgcgcggcgctttctctcttacatcatttcaaaacaaaccatccaaaacatcctgttcatgtctcacttttgtcctgcctgctccacgctgaaaaaacagtcagga

SEQ ID NO: 4029 - DNA, 2590 bp, Toxoplasma gondii
tttcgaactctttcgcgggaagcggcatgcctttgggagtcgggaacccctcgactttggtgttgacgaggaaggtccccatgagtttcttcgcgtccttcaaactcaagtacctgaagcgaagggagacctccggctcccatgtgtgtccagcaccttctcctgtttttcctgcttgtttttccatctttcttttgatgagtgcgacggccgcattcgagctggcggggcgactttcccagaagacgtcttcgccagtctctttcagcgccttcttcaggtcgccggggtcccggcccgcttcgtccgcctgctctgacggaaaagctttctcggagacgagaaccgaatctcgcacgatgtgacgcatgctgtgggtgaggtgccgaaagaaattcgccttccacagctccatgtcttcgctgtcagccagcaggaggcggagcagttcccctgcatcttctgggtgaccacgcaaagtgcctccgtcggatcgtcgctctggcgcggaatcgcggtcccgcggcgcgctttctgtcaggttgccggaggtagcgactacctgctctgcaacgatgctggcaaacaacgactccacggactctggagaaacaaacgcgttcaggacgtcctccgcgctgaaggactcgcgaggatccacggatgtgtcttcagaaagcggaaacaacgagtcgtccggggtgcctgcggctcgtgtgtacatacacccgagaagaaggattgccgcgagcgcggcgacgggcagcggggtgcccagaacgcgaaaagactttcgcccctccattttttccatggtgaaaaaaagctgatggtgcaggactgatattccgtcaatcttgtttttgaagacgcaaaacctctgggttttcgccgtccgtaaaagcaagggaggaaggatgtatggagggcctagaacaagtcacgttgccgcgcgtgccgttgacagacaccgaaaaaaaaactcacgaccccattcaaaaagagagtttggatgccagaatcctacgagattctggaagtgtctgtttctctgtttctgacaggagagcgaaagcacggcgtccgcgcttggtgccacaagaccagcctgaaacaaacgggaaacatcaagaagccaaggaagcgcagaattgcaaatcaaacaaacgaccatgtgagcaacaaagaggaaacgcttgcgccacggtctctcttcactggccacacaagaacggctgtacctctgagaacactaaaccgcgccacttaaaaactgtggattttttggcaggctcttcgctctttccgccaactgtctcaatgctcacgccagttgtcttggcggctttccgtccagcagcagtcgttgcgagtgttacctaacttgatgctagcgcgaaacaaaacggacagcgtgaggttgaaagtgtgtgtgtctcaacggcaaacagcggctcaacggcaggcgattccctcgaacgttgactttcgacgataccaggcgcacttgtcgtctggaccagctggctacactcctgtatattatggcaacgctgaaaaagccacaaactccccgatttgcagatgctttcgtcctgtcatgttgctgtctgttgccttacctctcagcactcgcgtcaagaacaagcgttcgcaggagagacacgcgcggttggtttttccggcgaaagtcgacggttgtcggcgttcagctgggcacaaaaaggcgcttcatccggaaaggaaaacgctgagaagccgtaaaaggaagcaaccagaccgtttcctgtcccgtcactcaagttcaccgagaaagccggatgagtcagcaacgcgccgcaggcacaccggccccaaaacgcgaaattcgtatataagccgacgcgcgtccgaagcgccacaactctgaaggagggcatgcagccccgacggccggttaagaagcctactctctcacaggtcgcaaagacaggcaagaaacgcgagaccttcaaacaggtatcttcgcgcgaatttgtttcccgcgtaacggtagagaaggcacgcagacatgccttttacgctaaatcgtcaacccaaagataggaactggatgttaggtagcctctcaaggtcggggcgactaggagtgacgcccgaacaggcgtttcagcgtcatgttttctctcccgtcgacagaaacgtgaacatgcccaatacatgctctttagaaatccgttagttgatggattgaaacggagcagactcagaattttctcggatctgctgtccagacaacccgtcgattttccgccacaggtttctccgtcgtgcatgcgcgcgcaattgtctcaactactcgttctcttttctttacctcatactccctttcgcctccgtcgtttgtttcgttattccttcctctggtaggtttttctgtctttcagttagtgtgccgtcgccctccggtttgtccacgcttgtgtttcgcccgtcgtctcttccgtcccctgacagtctcaacccctcttgaagtcgcctcgcagttgatttccgcttttttgtagttgtcctctgggattttgcgcgacgtcgtttagcctgtccagca

SEQ ID NO: 4030 - DNA, 1396 bp, Toxoplasma gondii
aggagaggaactgaaacgcagcttactttgggaatgagatggttgtgtttctctcctcttccattttcgtaaagagctgccctgagcccacatctgcgagtttcgatcgcagtgaaaatgcgtccagcttccacgtagatcgccgccattttcctcgagcgcgcgcttcctctttgcttttataatgaacaagaacgaagggatctgcagcggcttcttactccgagagatatggcttcgaagccatttctgagtcggtctctacgggagaaaaacgcttcaaagataaccatttgtttcgcttttttttgaacgcttagtaaagtggaggtgtcgaatttccagccagcgggctctccccgatctgttttatttgacaagaaaaaaatagtcgattctctcctgcgcgacgactttggaaatcctctgagtttcggactgccttcaccgccgctgtctgatttctagaagatgtctcgtccgagcctcgctctcgagtgtcgctcttgccccttgccctggttgcgtccttcagcgagactccacaagttttatctctaacatctctcgtctcatccagaggcggaagaagaatcggcgagcaggtctcttgtctcctgctgtctttcgtttctttcgcgtgcctcctgccctctttccatcgaagggaagtcgttgacgaaaaggacgcaaggagagagcactaagagcaaaaaatcgggaagaaaaaacggtttgagtgaggaggaaacacagtcttgtgtcggagattttcagaagaaatttgcggctgaagcgcgaccaagtgagtcaaattccatttgaggcgaaaaaggggcgtataaggagaaggcggcgtcaaggcgagagaaacgcgacgcgaaaaaaataaagggagagcggaactcactcgaagaaaaagaagattcaattggggagacgtcacaagttggaaaaacacctgaaaaaaatgtggtaaaaagagtcgcaaagaaatacgcgtttttgcatgcagctgtgccgtgcagcctcagggaacgacagtaatctccgtttttctgctaccccacagaatctcgcaagtttggagttcttttctctccaacactgttgacacacgcttctcctggcctctttttgagacctcatctgaccttcgttgcgcctctcctttttccaccttctgcctcgccgccagccaccgtccttcttcgtagtcacctgttccctgctctcggtcgaagtctccttctttttcgtttcgacgctgctgcgtctctaggccctcttctccccatcagcctcgttggttttccccaccgacgtttgtccggtttttttcagttcacctctcctctcttcttcgccttctcacgtcgcgctctgtctccttgca

SEQ ID NO: 4031 - DNA, 492 bp, Artificial Sequence
  5RT70constitutive promotor
ccgggccccccctcgacggtatcgataagcttaaccacaaaccttgagacgcgtgttccaaccacgcaccctgacacgcgtgttccaaccacgcaccctgagacgcgtgttctaaccacgcaccctgagacgcgtgttctaaccacgcaccctgagacgcgtgttcaagcttgcctgcattgggtgcggttggtgatcctggttggaccggtggagatgcgcgcgcacgaaggggatgtgtcagaaacattttgtttgttctctgtgaacttttagatgtgttaaaggcggcgaatattagcagagagtcctccttgttccattctctcttgaatttcgccctttccttctctttgcgagtgtggtagagaacaagcactcgttcgccgtccctgacgacgcaacccgcgcagaagacatccaccaaacggtgttacacaatcaccttgtgtgaagttcttgcggaaaactactcgttggcattttttcttg

SEQ ID NO: 4032 - DNA, 1384 bp, Artificial Sequence
  DHFRconstitutive promotor
aagcttcgccaggctgtaaatcccgtgagtcgtcctcacaaatcatcaagcaggtgtcctcagggagactgcctgactgagttatgctaattcctttctactttggcgtggtcacgtgtaaccatatccgaatcatttctctagccctacgaacaggtaagagcgctagggatgtccgtggagtagtgtgcttactcgataatattcagttgggactaccagcgaggcgctcgctttgctcacgcaatgcctgagacagttgcagaatgaatggtaaccgacaaacgcgttcatatgcgttttcaaacttagtagacgcgtactgtctgaaactggcggtcacaggcaccagataacgcccttggcatcggcatgtctcgtacagaggtccgtatgtagtgccacgacttctaaatccggcgacaggctggtcttttgtcttaccacgtattagcccgcgtgcgatttctcggagcgcacctgttcaacactagaaaacggagtttcctgatcgagaagccaccacctttccagaagttgaacgctagcatgtcattcgattttcaccccccgcgtagttcctgtgtgtcattcgttgtcgagacaactctgtcccgccccggtgctgttccatatgcgtgactttcccgcaattttttcagactttcaggaaagacaggctccggaacgatctcgtccatgactggtaaatccacgacaccgcaatggcccccagcacctctatctctcgtgccaggggactaacgttgtatgcgtctgcgtcttgtctttttgcattcgctttccaaaaaagagagccatccgttcccccgcacattcaacgccgcgagtgcggtttttgtcttttttgagtggtaggacgcttttcatgcgcgaactacgtggacattaagttccattctctttttcgacagcacgaaaccttgcattcaaacccgcccgcggaagatccgatcttgctgctgttcgcagtcccagtagcgtcctgtcggccgcgccgtctctgttggtgggcagccgctacacctgttatctgactgccgtgcgcgaaaatgacgccatttttgggaaaatcggggaacttcattctttaaaagtatgcggaggtttcctttttcttctgttcgtttctttttctcgggtttgataaccgtgttcgatgtaagcactttccgtctctcctccgtgctttgttcgacatcgagaccaggtgtgcagatccttcgcttgtcgatccggagacgcgtgtctcgtagaaccttttcattttaccacacggcagtgcggagcactgctctgagtgcagcagggacgggtgaagtttcgctttagtagtgcgtttctgctctacggggcgttgtcg

SEQ ID NO: 4033 - DNA, 1205 bp, Artificial Sequence
  MIC2constitutive promotor
gcagcggtaacaccttgttgattcgcgcctagcacgacagaaggaaccaattgtacggataggcgaggggagaggacaacgatgtagtgttgttcaaagccacaaataacgtgattgtgcattttccatgatccaactggtatgctctactccaccgcgggcaagttgcaaaacatatgccaacgagttggtgcacggcaggatttgccttgtgaagcaattgtggtcggcacgaacctcgacaatgtgttgagatatgcaaacacgaacgagtggatccattgctaggcgtgaaacggttttctctgctgttgtacgccacgttccgctcccatgtcctactgtttttcagagcagtggagtgtgtggtggccgagaggtagcgccctttgtgtgccacggtaccaacgtattgtccttcggcattcctgatgcgaagttgttttggggtattgccagccttgcagatataacgaagaggtggtggatttcggtacatggtcaaaaaaagccgtaatgcaagtttacaccaggaacgggtcgtgtgggaggccgtcagcgctacgcgagtcctgctgtgagtggacttgcatccgcagttgttggagacgttcgttcagcagttctgactctgcgccgaatacgacttcgtggtgaataacgacgcagccagcacggttattgcgacatgcagaaagacaactgctgaaggaatctgttaaccagtagttgaatgtaactcgtgcttcctgagcgacgttgccggcactgttactcgtacactagcttcataggctacacgagcactctatattgaacgcatagtgttcgtccgtgccagtgagattgattaactctaaatgagactgtacaagctgacgactacattcgttatgtcaaaagagcgctcgcttgcttcaccacaacgctttctttgccaaaacttgtaatttaagacactctacccacaggagataattcctttgtaacgcagaaactgaaaataacaagtttgccatttgcctaaaactagcagaaagttacctcagtcatctgcgtgccgcagacgcgctcaaccagtgttacaacagcgtcgaaagcgcttgcttttgtgcagtcacctgtcaggtctacgaaacaccgacagccaaacaaatcccacattgagtacgtacccgtgttactctcctttcgtctcctccttg

SEQ ID NO: 4034 - DNA, 1858 bp, Artificial Sequence
  MIC8constitutive promotor
cctggtggtgggcggaaaggaacacggcgccactccactttctgtggataaacaattctcgtaaggaatttcttacatttcatgtagatagcaagggaaatggaccgtcccccacgccacccagtcccatgattccatggatgggtgaccacattcaaacctatatgaagaaagagcatggacagtcaaatcatgcttaacgagactgattgacgaacgcatttcgttataacggtaaagatcttcatccatctcggctaccgtgcggtaaaaacagaactgaaaacttgaacgccggctcctagaaacgtcggcatctcgagaaccagggacatgtatgcacgaggaggcatcacgagtgtgacagaacacgacaaatatctggccttggcaaattccattgaacagcctctggcatgatgtcttgtattactcgattgtttctccactccacacaatttgtccactgccttctctccgcgagtcagcagactgataggttcgtgcactcgtagctagggtactggttgaccaatggccaaaatcgtcctgtcgtgcgaactatcggttcactcgtaacggatttggtggcggcctgccttcagaaatcgctggggcaagctgtcgaaccaggaccgctttttgtggctccctactcctctcttagatcaaaatctatttttcaatttcaatttaatcacgtataaacaaacaacacttcacccactgcaacacttcactacaacagcagtgtttggtattcgtcagacgaatcatcgctggaatcctgtggaacacttcgtagcgttgacagtaccccacataacacaatcacagtttcgcttctgagtggagaggactataaaaattacatgttcccttccttacaatgtccttcttacccatgcattaatcactttgatggcagtcaccaggatatcaggatggctagtgcaggtttcagcctgttccgtgtagaaataacgatgactataagtaaacattttgaagccctcagttcttctcgaaaaaaaacgtatgaatgccttctcaggggtggcttatacatccgtaccaggagtaggtccttcagttacaagggcgaaagaatctctccggaagtgctttgtatcgacaccgttgtgagtctgcgtcgcatacggttacttgcagaaaatacaggagagagtgacggcgaaacttatgccattgctccaatttctgtaaagcttgagttaatttagtcacctcacaaagcagcaaattcctaaggaatgtacggcacttccggtgtggtgttacaagcacagcacggttcacgaaataggaaccctcgacgtggaaccctctgcgtgtcacgcaaacgcacgaacatgcagcttgcgtgtcacttgaatggcatactgcttttcttctcatgtagccgcagccggagtaattcgcatgaataagcggtccagttgctcgaagagacatttcagtgtcggttcgtgtaccatacgaatgatgacagacaacctggcgtggtgtcatattacgcatcccctcgatttgattcgacagcgagtataaaaccataacggatagaggccgaggaacagcgacgccacgagtggttgtacacggaacagcccgggacttcgagtctgtgccagttttcttacatctttcctgcgactcttttgtggccagttttttatgtgggcaagggggaacacacttttcccttatggaatgcaggcaattactgtagctgttgcagcaaatgcagagccccatttatttcatgggcgagggttctcgtttacgtcaataagatcaccgtattattcggctggtcgcggtatctttcgtttcg

SEQ ID NO: 4035 - DNA, 806 bp, Artificial Sequence
  SAG1constitutive promotor
aagcttttacatccgttgccttttccacggtccgtgatttcatgtgcgtgcagcttcaaagactggtcgttgcgactaataagactgcagtgacaggtcgaatggtgggcaccttgctgatgactatctactgcaaagtctgagacaacgaacgaaacttcccacacgaggcatttgaaactgacggtgtctaggtaatatgcactgcaagacacggtactggggcctcgctgaattaggggccgatctcgttgccctatcagtgctcacagtgccgcaacgtaacaccagggcaggttcttgacagtggcaacaatgtgcgacgggcgtgtgaacgtttcgtagtcatagcgctagcacgtacctagccacatggtcgtgaggagctttaccatgcgtctagaaggtggatgcgggacacgccttcctggcctttggctcccgagacgcgtgttctaaccacaaaccttgagacgcgtgttccaaccacgcaccctgacacgcgtgttccaaccacgcaccctgagacgcgtgttctaaccacgcaccctgagacgcgtgttctaaccacgcaccctgagacgcgtgttctgccgcacaatgtgcacctgtaggaagctgtagtcactgctgattctcactgttctcggcaagggccgacgaccggagtacagtttttgtgggcagagccgttgtgcagctttccgttcttctcggttgtgtcacatgtgtcattgtcgtgtaaacacacggttgtatgtcggtttcgctgcaccacttcattatttcttctggttttttgacga

SEQ ID NO: 4036 - DNA, 639 bp, Artificial Sequence
  TetO7SAG1 inducible promotor
attaagttgggtaacgccagggttttcccagtcacgacgttgtaaaacgacggccagtgagcgcgcgtaatacgactcactatagggcgaattgggtaccgagctcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgaggtcgacggtatcgataagcttcaatgtgcacctgtaggaagctgtagtcactgctgattctcactgttctcggcaagggccgacgaccggagtacagtttttgtgggcagagccgttgtgcagctttccgttcttctcggttgtgtcacatgtgtcattgtcgtgtaaacacacggttgtatgtcggtttcgctgcaccacttcattatttcttctggttttttgacgagtatgca

SEQ ID NO: 4037 - DNA, 716 bp, Artificial Sequence
  TetO7SAG4 inducible  promotor
attaagttgggtaacgccagggttttcccagtcacgacgttgtaaaacgacggccagtgagcgcgcgtaatacgactcactatagggcgaattgggtaccgagctcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgactttcacttttctctatcactgatagggagtggtaaactcgaggtcgacggtatcgataagcttacgccgctgagactaactagaaagaagtgtgcaacagttcatgagggacaaaaggaatgtgatgcggttcgcttgaagaaggaatgtttaagcacgtcaacaatacgccttggcgaatgttcatgactgttcatgtggttcatcggatcatttgaaaacatcgtgaggctggtacctggtcgcaaacgtcgtagtgtagtaccgacaataacgtcgtcgttcaaggggacgcagttctcggaagacgcgtcgcagcatactgcaactgctttcgtctgtcttcaaccatgca

SEQ ID NO: 4038 - DNA, 498 bp, Artificial Sequence
  TUB1 constitutive promotor
  misc_feature (290)..(290): n is a, c, g, or t
catgcatgtcccgcgttcgtgaaattctctgcatcagcggagtgatcaggaatcatcgtctcagcgggatgacgttgcggagcaggccggctcgcggtgggcagtcagatgccgaaggcgtaactcaggacggcttgcgctcatcgcagaacaggggtggtgcctgcattgggtgcggttggtgatcctggttggaccggtggagatgcgcgcgcacgaaggggatgtgtcagaaacattttgtttgttctctgtgaacttttagatgtgttaaaggcggcgaatattancagagagtcctccttgttggattctctcttgaatttcgccctttccttctctttgcgagtctcgtagagaacaagcactcgttcgccgtccctgacgacgcaacccgcgcagaagacatccaccaaacggtgttacacaatcaccttgtgtgaagttcttgcggaaaactactcgttggcattttttcttgaattccctttttcgaca

SEQ ID NO: 4039 - DNA, 485 bp, Artificial Sequence
  TUB8 constitutive  promotor
cccccctcgacggtatcgataagcttaaccacaaaccttgagacgcgtgttccaaccacgcaccctgacacgcgtgttccaaccacgcaccctgagacgcgtgttctaaccacgcaccctgagacgcgtgttctaaccacgcaccctgagacgcgtgttcaagcttgcctgcattgggtgcggttggtgatcctggttggaccggtggagatgcgcgcgcacgaaggggatgtgtcagaaacattttgtttgttctctgtgaacttttagatgtgttaaaggcggcgaatattagcagagagtcctccttgttccattctctcttgaatttcgccctttccttctctttgcgagtgtggtagagaacaagcactcgttcgccgtccctgacgacgcaacccgcgcagaagacatccaccaaacggtgttacacaatcaccttgtgtgaagttcttgcggaaaactactcgttggcattttttctt

SEQ ID NO: 4040 - DNA, 5228 bp, homo sapiens
agggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggaaaaaaaaaaaaaaa

SEQ ID NO: 4041 - DNA, 6194 bp, homo sapiens
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 4042 - DNA, 6449 bp, homo sapiens
gagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 4043 - DNA, 1141 bp, homo sapiens
ccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgaaaaaaaaaaaaaaaaaaaaaaaaaaaaaaaaaaaaaa

SEQ ID NO: 4044 - DNA, 1911 bp, homo sapiens
cctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgct

SEQ ID NO: 4045 - DNA, 2608 bp, homo sapiens
tccttcttcattctgcagttggtgccagaactctggatcctgaactggaagaaaatgtctatccaggttgagcatcctgctggtggttacaagaaactgtttgaaactgtggaggaactgtcctcgccgctcacagctcatgtaacaggcaggatccccctctggctcaccggcagtctccttcgatgtgggccaggactctttgaagttggatctgagccattttaccacctgtttgatgggcaagccctcctgcacaagtttgactttaaagaaggacatgtcacataccacagaaggttcatccgcactgatgcttacgtacgggcaatgactgagaaaaggatcgtcataacagaatttggcacctgtgctttcccagatccctgcaagaatatattttccaggtttttttcttactttcgaggagtagaggttactgacaatgcccttgttaatgtctacccagtgggggaagattactacgcttgcacagagaccaactttattacaaagattaatccagagaccttggagacaattaagcaggttgatctttgcaactatgtctctgtcaatggggccactgctcacccccacattgaaaatgatggaaccgtttacaatattggtaattgctttggaaaaaatttttcaattgcctacaacattgtaaagatcccaccactgcaagcagacaaggaagatccaataagcaagtcagagatcgttgtacaattcccctgcagtgaccgattcaagccatcttacgttcatagttttggtctgactcccaactatatcgtttttgtggagacaccagtcaaaattaacctgttcaagttcctttcttcatggagtctttggggagccaactacatggattgttttgagtccaatgaaaccatgggggtttggcttcatattgctgacaaaaaaaggaaaaagtacctcaataataaatacagaacttctcctttcaacctcttccatcacatcaacacctatgaagacaatgggtttctgattgtggatctctgctgctggaaaggatttgagtttgtttataattacttatatttagccaatttacgtgagaactgggaagaggtgaaaaaaaatgccagaaaggctccccaacctgaagttaggagatatgtacttcctttgaatattgacaaggctgacacaggcaagaatttagtcacgctccccaatacaactgccactgcaattctgtgcagtgacgagactatctggctggagcctgaagttctcttttcagggcctcgtcaagcatttgagtttcctcaaatcaattaccagaagtattgtgggaaaccttacacatatgcgtatggacttggcttgaatcactttgttccagataggctctgtaagctgaatgtcaaaactaaagaaacttgggtttggcaagagcctgattcatacccatcagaacccatctttgtttctcacccagatgccttggaagaagatgatggtgtagttctgagtgtggtggtgagcccaggagcaggacaaaagcctgcttatctcctgattctgaatgccaaggacttaagtgaagttgcccgggctgaagtggagattaacatccctgtcacctttcatggactgttcaaaaaatcttgagcatactccagcaagatatgtttttggtagcaaaactgagaaaatcagcttcaggtctgcaatcaaattctgttcaattttagcctgctatatgtcatggttttaacttgcagatgcgcacaattttgcaatgttttacagaaagcactgagttgagcaagcaattcctttatttaaaaaaaaaagtacgtatttagataatcatacttcctctgtgagacaggccataactgaaaaactcttaaatatttagcaatcaaataggaaatgaatgtggacttactaaatggcttttaattcctattataagagcatattttaggtacctatctgctccaattatatttttaacatttaaaaaccaaagtcctctacacttgatttatattatatgtggctttgctgagtcaaggaagtatcatgcaataaggcttaattactaaatgtcaaaccaaactttttctcaaaccagggactatcatctaagattaattacagtaattattttgcgtatacgtaactgctcaaagattatgaatcttatgaatgttaacctttccgtttattacaagcaagtactattatttctgattttataataagaaaatctgtgtttaatcaactgaggcctctcaaccaaataacatctcagagattaagttatatattaaaagcttatgtaacataaaagcaagtacatatagtagtgactatatttaaaaaaacagcataaaatgcttaaaaatgtaatatttactaaaatcagattatgggataatgttgcaggattatactttattgcatcttttttgtttaattgtatttaagcattgtgcaatcacttgggaaaaatattaaattattaacattgaggtattaatacattttaagccttttgtttttaaatttcttttcttccagagattgtttaaaaataaatattgacaaaaat

SEQ ID NO: 4046 - DNA, 3810 bp, homo sapiens
ccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctagggtctgcggagacccgatccgaggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 4047 - DNA, 3655 bp, homo sapiens
catacaggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactccggctccagagactgctgtgtattgcattcctgctacagtgcaaagaaagggaccaaggttcccaggaaatgtttgcccagaatggaagatgaggaccaaggaggcggaggaggaggaagaagaagaggaggaggaggaggaggaggaggaggaggaggaaggcagccatcatgggagcctggtagagggagatccagctacagacaactggacaggagagagagaaaacagccctctggattctccaggatggcagccgatgtcactagaagctcagggctgatgttcctggttggctattgccaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagttggctaggaaccaaaaaggctgtgctcatgattaaacacaaacctgaaggtatttcctttatgtccttggaaacaggaaacgagttgtggttttcgccagcattcttgtaggagagaatcggggaaggccccgaactgcccccgggcagggagagcccctcaggcctgttggtttacagagagacagatgttacataaccagctccgttgatgcgtggtcaccagtgaccagagaagctactcgatgcaatgcatctgtttcagatacagaaatatagagaagatatttattgaaatttaagttattgttatttattaccgttcactaatgaatttctcttttttcccttatttattaaagtttcttttcaaaggtgccaaagtatatgtgctcgcaaaatgcaaagaaaggtgacaaaaggaaatttgaattgggaacaagggtccatgcttttcaaagtattaaaaagttttttgccaggcaaaaatcacttactttacctttttaagaaaatttgtcattaattttccccagatttcagcatttttcccaatttttatttgtggagcatctcaggcaagccccctttcctggagcagcgtgcagagaccactggcacttgactttatttcttccttgctccattgctgaacagaaatgtcgtgggctccacttcctgttgtctttaagctcttagtcccctccacgtatacctatctgtactatgcataaccatatgtagaaaaggttcagttccttttagtaggtagtcctggatttaatgctgacctaaaagtaatgtcgacaatgctgtcaggtagctgccgttctaccgactccctccatccctgcccacccactgccctcccgagaatatgctggctgcccagtgcagcccgggagacacaggggccttccagaggtagggtctaccaggtcctgtacaacccctgggctgtcaccgggggtcaacagctgctgctcctatatacccaaacacctgacagctccctggggagcagatggctgagaagggtgctgaggaagccatattgggaccagccacagccacacacatggagcctcatacttaggagcgtgctgcctttaaatgaaggtggtcggggccagtgcagcggctcacacccataatcccaacactttggaaagccaaggtgggaggatctcttgaacccaggagtttgagaccagcttgggcaacatagggagaccctgtctctacagaaactttaaaaattaggcaggcatgatggtgcacacctgtggtcccagctactcaagaggctgaaggaggatcacttgagtccagaaggtcgaggctgcagtgagctgtgatcatgccactgcactccagcctaagtgacagtgcggtaccctgtctcaaaaaaaaaaaaaaaaaaaaaaagaggttggagcaggaggaagcataggggcgggaacagccacctcctccatgccctagattgtgaatttatcgggcagccaacacatgtatgacacactaggccctgtattacagcttgttacgcatttcataaaagggattttcattaaggagataatctattactacctaccttagtggctactagtataaaactatgacagatttagcaattaaatgaaatactggcctccatcaaataatcatagtaacaagaagcagcagttaccagacatctgatccccttcccccaaaatacccaaattcttcatggttctgcccttctctgtcctttctgctccccttgctcgcctgggaaatggaggaaaggccttccctctcacactgtcttgggatcttgctgagaattcagactgctcgaaacagtgacaaaccccagccatccagtcattcgtggagcacaatttggatgtggccccaggggcatctgtcccattcagagaaccttggcagtgcgatggccactgttcccaggcttcaacctcagtgaccccccccaacaactccccatggagagtccctgcccaaaaaagctgtaggatccaaggggtgtcaatagctcgttcccggcatcacctacacaccacaagcaggttttaatggaagcaagttgctccaccaaatccacaaaagggtaaagtttgtgatttttctttatcattgcgatcaccatctgataccgtaaggagtgcacttgtttggaagttctgacttctctgatctgtcttggtcgtttgtgttataaaaccaaagttctctacagactttatttttgtacaatatcattttgtaactttttacaaataaaaactcatttctattgc

SEQ ID NO: 4048 - DNA, 4354 bp, homo sapiens
aaggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttaggaagttgtcctcatgaattagctagcattagcataattaccgacgttgcatgctgtgaggaggctacaaaggccaggctggtgtcggaagtaataatacatatagaattccattctaataaatgccattagtgtataacatcaagttctgtgtaatgaggctatttccaagtctccaaagatggtcactgtaacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgcctggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttacctaaaaaaaa

SEQ ID NO: 4049 - DNA, 4521 bp, homo sapiens
cacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4050 - DNA, 4123 bp, homo sapiens
agagctaaataatgtctgacccgggcgcaaggcgcagcctggagctccgggtccccgccgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4051 - DNA, 3998 bp, homo sapiens
agagctaaataatgtctgacccgggcgcaaggcgcagcctggagctccgggtccccgccgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4052 - DNA, 3916 bp, homo sapiens
agagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4053 - DNA, 4042 bp, homo sapiens
aatatcaagtatcacttaattagagatttttaagccttttcctcctgctgtgccgggtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4054 - DNA, 4174 bp, homo sapiens
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagggatggtaataaagtctcttagtggttgaaaatgttatttcttacaaaagtggagaacatttgcttttcaataccagagttttcagccatttctgcattctgacctattgactggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4055 - DNA, 4016 bp, homo sapiens
agagctaaataatgtctgacccgggcgcaaggcgcagcctggagctccgggtccccgccgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4056 - DNA, 3827 bp, homo sapiens
aatatcaagtatcacttaattagagatttttaagccttttcctcctgctgtgccgggtgtgtaatccgggcgataggagtccattcagcaccttggacagagccaacggatttgtccgaggtggcggtacccccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4057 - DNA, 4057 bp, homo sapiens
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4058 - DNA, 4755 bp, homo sapiens
cacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggttatatgctagatcttgggggcaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4059 - DNA, 3976 bp, homo sapiens
acacggctacctgctcccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4060 - DNA, 4028 bp, homo sapiens
acccactttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4061 - DNA, 4125 bp, homo sapiens
aatatcaagtatcacttaattagagatttttaagccttttcctcctgctgtgccgggtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4062 - DNA, 4338 bp, homo sapiens
attattaaagcggtagtctgccggcgctgataagcaacaagttccccagcggtcttcccgccctagcctgacaaggcgaaggttttcttacctggcgacagggaaatctcccgagccgaattcagcttcgccggagccccaggtgtgacctgcgtagtgggcaagggagcggtgtgcaggctgagtttttttttttacaggggtaccctgaaactcctcactttctctgggaactttcagtgccaggacccagtaacgggcggttagaaggcagccctaggaaacacctgctacatagcagggcagttgggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatgttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4063 - DNA, 3774 bp, homo sapiens
gtaaaccaatagcccccatgctctgtgcgatttcattgtgtgctcgcgttcgcaagctccgtagtgcaggaaggtgcgggaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4064 - DNA, 3928 bp, homo sapiens
cttccaccccgccccctcctccagcctccatccctccctcattctatctcttcctctccgtcgccctcgctcctcgctggatgcttctttctgggttttcttttttttttcccttctgtcctccctccccgcgagtttcgggcgctggcttagagggttcccgctttctcaagggaaggggagctgccgagaccgcgctccgctccccagccgggccggatgcctcactgagcccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4065 - DNA, 3764 bp, homo sapiens
gtaaaccaatagcccccatgctctgtgcgatttcattgtgtgctcgcgttcgcaagctccgtagtgcaggaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaa

SEQ ID NO: 4066 - DNA, 3648 bp, homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4067 - DNA, 3423 bp, homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4068 - DNA, 3310 bp, homo sapiens
gtcggatgattcaagctcacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4069 - DNA, 3591 bp, homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4070 - DNA, 3480 bp, homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4071 - DNA, 3572 bp, homo sapiens
aaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4072 - DNA, 3255 bp, homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4073 - DNA, 1368 bp, homo sapiens
gaaatgctctcctttttcctaataaagctttccacagaagacaaactctgtacacaaaaaacaagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagttaaaaaaaaaaaaaaaaaa

SEQ ID NO: 4074 - DNA, 1435 bp, homo sapiens
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagttaaaaaaaaaaaaaaaaaa

SEQ ID NO: 4075 - DNA, 3050 bp, homo sapiens
tttttttgcttctgccccagatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagatc

SEQ ID NO: 4076 - DNA, 7595 bp, homo sapiens
agaacccgccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacaactcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttattgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacaaaattgccatataatatcttgtcttttttgggggtgtgaattttttgcattgttctggtcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgcattgtttggggtttggttttatgcttactgtgtctctccaccccattatcagagtaatatatgctcattgcataaaatctggaacatgtgaaaactggagatgaaaagaagcccagcatttgagacatacccactgctgacatttgtatatttcctttcattcttttacctgcctaaagacatatatgcagatatggacatatttagctttacatacatgcagactaccacatataatctatatcttgtttttttgatctaacacaatgttagcttggttttttatgtcattgacagttcttgattaacagctgtaatggctgcacagccctgcttcattaatttttttttttggactgaaatgtatgtaccacgttccgcttatccattcatccaccagtgaccacttgggtcatttctaccttttggccattgcaataatgttgctgtcaacaaggatgtacaaatatctgttcgagtccctgctcttaattgttttgggtatacacccaacctacattaatctttaatcacttaagatgttggggtttgtgctgggaggtaaccaagtgactctggagcagcctcaccctagctacagagggaaactgactcttccctctctgcccaatcttttgccgcctgtcaggttcccaagctgtccataccttactgtgtgaagcgctttgggtataaactcccaaatagaggctcagccccttttcctttcccaagtccatcctgcaggttatagctcttcagaggaatctcttgaattctggcctgggatctgggattaaagtagaacccagggtgtcccttggggccttaggcatagcccgttgtggtggaacctgccatcagccccactgcactcagtggtcccctggtacttcaggacagtttctctcttctgcacatgagaacttcaagcagagaggactgtcagttgttgccttcacatcaccaatcgtttggccataatggccaagagccctcactgctcttgggtcttgcctttccacatgttactgaaagctcccgttggtgtccctgtccactaactcacctgatgggacagatgccactttcctctgagtgtctgataaaacacagtctgttgtggggagcccacgctcaagggttttctttgggatcagagtttcccggctattactccatgccctgcctgacatcactgtcatgtatggtgctaatcaccaaaggatgcccttgtttgattctggattctaggtgatagtccttatcctctgatgggggaagagtttgggtgggagagaacaaaccgacaagttggttccagatgaggtggctgggagccaaccctcaggtacttggctctgagtaatgtgacggcccaggcaagagggctcccactgccaatgaggaacaaaagctcaaggtctagtagtgtattcagcacatgctaggaaacaagagttgggacgtggacaaggagaggagcaaaggccaggggttaactgcttttggtttttcctctataaaagtcagggactatgatttatatgggtgagaaggtttggagtaggactgaagctgccatttacaaaccccttgccctaatttattgtagttttgggtgtgtttctgaaagaaccttttgcaggtgatttttattcagtactcattaacttacagcttttatgaattcacatcttctacactattgaaaaacataagtttgtattgtgttaagtgcagcatgagttattatatgaataaatcacattaaatttgcaaaaaaaaaaaaa

SEQ ID NO: 4077 - DNA, 1437 bp, homo sapiens
agaacccgccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcaaaaaaaaaaaaaaaaaaaaaaaaaaaaaaaa

SEQ ID NO: 4078 - DNA, 7639 bp, homo sapiens
agaacccgccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacaactcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttattgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacaaaattgccatataatatcttgtcttttttgggggtgtgaattttttgcattgttctggtcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgcattgtttggggtttggttttatgcttactgtgtctctccaccccattatcagagtaatatatgctcattgcataaaatctggaacatgtgaaaactggagatgaaaagaagcccagcatttgagacatacccactgctgacatttgtatatttcctttcattcttttacctgcctaaagacatatatgcagatatggacatatttagctttacatacatgcagactaccacatataatctatatcttgtttttttgatctaacacaatgttagcttggttttttatgtcattgacagttcttgattaacagctgtaatggctgcacagccctgcttcattaatttttttttttggactgaaatgtatgtaccacgttccgcttatccattcatccaccagtgaccacttgggtcatttctaccttttggccattgcaataatgttgctgtcaacaaggatgtacaaatatctgttcgagtccctgctcttaattgttttgggtatacacccaacctacattaatctttaatcacttaagatgttggggtttgtgctgggaggtaaccaagtgactctggagcagcctcaccctagctacagagggaaactgactcttccctctctgcccaatcttttgccgcctgtcaggttcccaagctgtccataccttactgtgtgaagcgctttgggtataaactcccaaatagaggctcagccccttttcctttcccaagtccatcctgcaggttatagctcttcagaggaatctcttgaattctggcctgggatctgggattaaagtagaacccagggtgtcccttggggccttaggcatagcccgttgtggtggaacctgccatcagccccactgcactcagtggtcccctggtacttcaggacagtttctctcttctgcacatgagaacttcaagcagagaggactgtcagttgttgccttcacatcaccaatcgtttggccataatggccaagagccctcactgctcttgggtcttgcctttccacatgttactgaaagctcccgttggtgtccctgtccactaactcacctgatgggacagatgccactttcctctgagtgtctgataaaacacagtctgttgtggggagcccacgctcaagggttttctttgggatcagagtttcccggctattactccatgccctgcctgacatcactgtcatgtatggtgctaatcaccaaaggatgcccttgtttgattctggattctaggtgatagtccttatcctctgatgggggaagagtttgggtgggagagaacaaaccgacaagttggttccagatgaggtggctgggagccaaccctcaggtacttggctctgagtaatgtgacggcccaggcaagagggctcccactgccaatgaggaacaaaagctcaaggtctagtagtgtattcagcacatgctaggaaacaagagttgggacgtggacaaggagaggagcaaaggccaggggttaactgcttttggtttttcctctataaaagtcagggactatgatttatatgggtgagaaggtttggagtaggactgaagctgccatttacaaaccccttgccctaatttattgtagttttgggtgtgtttctgaaagaaccttttgcaggtgatttttattcagtactcattaacttacagcttttatgaattcacatcttctacactattgaaaaacataagtttgtattgtgttaagtgcagcatgagttattatatgaataaatcacattaaatttgcaaaaaaaaaaaaa

SEQ ID NO: 4079 - DNA, 2550 bp, homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgctctttgtggtgtggtgggctctggtctgttctgctcggtgctgggcctgggagcaaagattcccatgcttggctacagatactgacagctggcctctgaaggagggtgaaaacttctgcttgacagttccacatccatagtgcatggtctgatgagtgcggttgctgacatgggtttcttggtaagctcctgaggtaatggcagcctc

SEQ ID NO: 4080 - DNA, 2259 bp, homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgctctttgtggtgtggtgggctctggtctgttctgctcggtgctgggcctgggagcaaagattcccatgcttggctacagatactgacagctggcctctgaaggagggtgaaaacttctgcttgacagttccacatccatagtgcatggtctgatgagtgcggttgctgacatgggtttcttggtaagctcctgaggtaatggcagcctc

SEQ ID NO: 4081 - DNA, 1330 bp, homo sapiens
gcgcgggtggcggaggcgattgaagctgctggcccagcatgtggtgcgcgagcccagttgctgtggtggccttttgcgccgggcttttggtctctcacccggtgctgacgcagggccaggaggccggggggcggccaggggccgactgtgaagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagtttttttcaagtgaattttctgttttcactctatattgtagctctctttggtatcagaaatggtcaggcaggagtactcgtttttcccattggaagaaaacccacttaaacctacttaaagaaaatagagagatcaagaaaccgtataagtatagccaatgtttggcaattatatcaacatttacattgttaattgaaccaagctcaaggtctttttcattccttacagtcacatatcagacaagtttttgatggaagattaaagcatattaaaaacactcataggcaacttgg

SEQ ID NO: 4082 - DNA, 5307 bp, homo sapiens
gggagcgcgcgcgccggtgcgggtgcgtgcgtgagcgtgctcgtctccgctgccgctgccgctgccgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaccccaaaaaaaaaaaaaaa

SEQ ID NO: 4083 - DNA, 2214 bp, homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 4084 - DNA, 5154 bp, homo sapiens
gcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaacatcgtgctgtttttaatttgaaaaaaaaaaaaaaaaaa

SEQ ID NO: 4085 - DNA, 5579 bp, homo sapiens
gagagcgaccgaggagagaagagagcagagcaatacaaaagcagcctcggatctagccggagctgcaagcgttaaggggaggcggagagtgacgcggtttgcgtctggagcggctccttggagtccacagcatccaccgccggagcctcgccttcctttctccctctgcagacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagaaaaaaaaaaaaaaaaaaaa

SEQ ID NO: 4086 - DNA, 5467 bp, homo sapiens
ttcaaattctcccaagctggaggtagtggagcaaacaagatcagcaacaatgagggagcagctgcaccactttgtgttactctctgatggccagcacagggctgcaagtagtggctgcaaaaaccagacaaatagatggaaatccaggaactagaggaaattcaggcctgccaggggctctgggaagtgtttgttactctctcagaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagaaaaaaaaaaaaaaaaaaaa

SEQ ID NO: 4087 - DNA, 4411 bp, homo sapiens
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaatt

SEQ ID NO: 4088 - DNA, 1734 bp, homo sapiens
ccggcgtcggcggcgcgcgcgctccctcctctcggagagagggctgtggtaaaagccgtccggaaaatggccgccgccgccgccgccgcgccgagcggaggaggaggaggaggcgaggaggagagactggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaaaaaaaaaaaaaaaaaaaaaaaaaaaaaaaaaaaaaaaa

SEQ ID NO: 4089 - DNA, 10241 bp, homo sapiens
ccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaattt

SEQ ID NO: 4090 - DNA, 5144 bp, homo sapiens
ccctgtccctggctcacgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtgggaaaaaaaaaaaaaaaaaa

SEQ ID NO: 4091 - DNA, 1822 bp, homo sapiens
gccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcaaaaaaaaaaaaaaaaaa

SEQ ID NO: 4092 - DNA, 3955 bp, homo sapiens
gcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcaaaaaaaaaaaaaaaaaaaaaaa

SEQ ID NO: 4093 - DNA, 4082 bp, homo sapiens
gcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcaaaaaaaaaaaaaaaaaaaaaaa

SEQ ID NO: 4094 - DNA, 1552 bp, homo sapiens
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaaaaaaaaaaaaaaaaaaaaa

SEQ ID NO: 4095 - DNA, 3519 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4096 - DNA, 3677 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4097 - DNA, 3608 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4098 - DNA, 3554 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4099 - DNA, 3626 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4100 - DNA, 3519 bp, homo sapiens; identical to SEQ ID NO: 4095

SEQ ID NO: 4101 - DNA, 3554 bp, homo sapiens; identical to SEQ ID NO: 4098

SEQ ID NO: 4102 - DNA, 3488 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4103 - DNA, 3422 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4104 - DNA, 3626 bp, homo sapiens; identical to SEQ ID NO: 4099

SEQ ID NO: 4105 - DNA, 3392 bp, homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 4106 - DNA, 3608 bp, homo sapiens; identical to SEQ ID NO: 4097

SEQ ID NO: 4107 - DNA, 3392 bp, homo sapiens; identical to SEQ ID NO: 4105

SEQ ID NO: 4108 - DNA, 3677 bp, homo sapiens; identical to SEQ ID NO: 4096

SEQ ID NO: 4109 - DNA, 3488 bp, homo sapiens; identical to SEQ ID NO: 4102

SEQ ID NO: 4110 - DNA, 3422 bp, homo sapiens; identical to SEQ ID NO: 4103

SEQ ID NO: 4111 - DNA, 3897 bp, homo sapiens
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttcaaaaaaaaaaaaaaaaaaaa

SEQ ID NO: 4112 - DNA, 1885 bp, homo sapiens
ttcccaggccaccatagcggctggcggagggagcgcgcgccttgctggcctggagggggcgggggccgtggcggctttaaagcgcccagcccaggcgtcgcggggtggggcggctctggcggctgcggggcgcagggcgcagcggccaagcggggtccccggaagcacagctggggtgtctccacctacgactggccgcgcgccttttctctcccgcgccagggaaggagcggctgcggcccccgccgggcggaggcacggggggcgtacgaggggcggaggggaccgcgtcgcggaggagatggcgcggcacgtgcggtgacggcacccgagccctgagggtcccagccccgcgctccgcgtccccgggacagcatggagcgcccggagcccgagctgatccggcagagctggcgggcagtgagccgcagcccgctggagcacggcaccgtcctgtttgccaggctgtttgccctggagcctgacctgctgcccctcttccagtacaactgccgccagttctccagcccagaggactgtctctcctcgcctgagttcctggaccacatcaggaaggtgatgctcgtgattgatgctgcagtgaccaatgtggaagacctgtcctcactggaggagtaccttgccagcctgggcaggaagcaccgggcagtgggtgtgaagctcagctccttctcgacagtgggtgagtctctgctctacatgctggagaagtgtctgggccctgccttcacaccagccacacgggctgcctggagccaactctacggggccgtagtgcaggccatgagtcgaggctgggatggcgagtaagaggcgaccccgcccggcagcccccatccatctgtgtctgtctgttggcctgtatctgttgtagcccaggctccccaagcttccctgcatcttggtccttgtccccttggccacactggagaggtgatggggcagggctgggtctcagtatcctagagtccagctgcagaaggagtggcttttcctccaggaaggggcttctgggtgtcccctcatccccagtagcctctttcttgcgtttctttttaccttttttggcactccctctgaccccgcgatgagtgttttggtggcagaggtgggatgagctggaaaggtatggaggtgggagaggatggggctcttctgtctgtcctgcttcttcaggtgagtgcaggccaaggcgggggtgagatggctgagcttccagcgccttctgtcctgcctgcccagtcccttcactgctttcctgccccaagatggcttgcttttcacaaataaagagaaagagcagctttagccttcttggtggaatcccaggcagtgggagcagaatcagaactgccagggaagggaagggggacctgggtctcaatgggtctcatttgagtctcgcgggctgtgcagatgccctgacagagtcggtttcctttggcggcattccctttccctcattcagcacttctgctgggaactccctgactattccgctgctgcaggaacccagctagctggccaggtggggaggggctggggaccggccaggaaggaggggtgacttcatcccagagagacccgagttcccccagcccttcatcaccaacccgctcctgcaggagtgagtcttacctcccctggccctcctttctggctcagcctgcagcgactgtgaggccacagctcctcagattcactgcccgctgtgtgccagtactcaggcagctggagagaagagaaggcagcagcagaggcccccgccctcaccccagccatctgcacttgtaccatttgctctgtgctgactgtggtcctataaattcatgagaaataaactggttctgtgtgcaaaaaaaaa

SEQ ID NO: 4113 - DNA, 2859 bp, homo sapiens
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattattaaaa

SEQ ID NO: 4114 - DNA, 2988 bp, homo sapiens
ggcccttccggggctgcgcggctcccccgcctcggtgccggcaaaaatgtgcctagtcacggggccgctctcgggggaactgaggtcgccttcgggctgggacccggagccccttcgccgcgccccaagacctccttgagtgcgggctgcgacgcgctcaccccgctgggccgtctgtgggcgcggctttgcgaagtcatccatctctcggatcactctctggcagccttgagctctcttgaaagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattattaaaa

SEQ ID NO: 4115 - DNA, 2967 bp, homo sapiens
ggcccttccggggctgcgcggctcccccgcctcggtgccggcaaaaatgtgcctagtcacggggccgctctcgggggaactgaggtcgccttcgggctgggacccggagccccttcgccgcgccccaagacctccttgagtgcgggctgcgacgcgctcaccccgctgggccgtctgtgggcgcggctttgcgaagtcatccatctctcggatcactctctggcagccttgagctctcttgaaagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattattaaaa

SEQ ID NO: 4116 - DNA, 2972 bp, homo sapiens
agcgtggccttgggaggcggggcggagggggacggacagggcagctcaagacgctgaggtggtggctgcggcctttgaacaagtaagtgagccaccctcggagacccccgcgctggggacgggaggccggcgagcctcgggacctctgaaagccttgaggaggcgcggggacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgaaaaaaaaaaaaaaaaaaaaaaaaaaaaaaaaaa

SEQ ID NO: 4117 - DNA, 2884 bp, homo sapiens
agcgtggccttgggaggcggggcggagggggacggacagggcagctcaagacgctgaggtggtggctgcggcctttgaacaaacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgaaaaaaaaaaaaaaaaaaaaaaaaaaaaaaaaaa

SEQ ID NO: 4118 - DNA, 3183 bp, homo sapiens
acagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgaaaaaaaaaaaaaaaaaaaaaaaaaaaaaaaaaa

SEQ ID NO: 4119 - DNA, 2780 bp, homo sapiens
acagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgaaaaaaaaaaaaaaaaaaaaaaaaaaaaaaaaaa

SEQ ID NO: 4120 - DNA, 3781 bp, homo sapiens
gagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggtggatcacggggtcaagagatcgagaccatcctggccaatatggtgaaaccccatctctactaaaaatacaaaaattagctgtgtgtggtggcacgtgcctgtagtcccagctacttgggaggctgaggcaggagaatcacttgaccccaggtggtggaggttgcagtgagccaagattgcaccattgcactccagcctggcgacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgagccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaagcctgacagctagcaggtttcaggatccatctgccaagttagtgaaaggctggagcctcaaatcatacagatgagggtcattttctcctccttagcttcttggagtttaagagttgaaggagtcctgaaaagtaatgatagagcaagatgaagctatcagaactgaatttggacttcctctgggaaactacacctagttcatctgaagtgtcacgtaaactgcagaaagtttccaatgctggaaacttctctcatactatcgtgccttcctactcagaagtgcctgtgccctgctcagctgtgactactgacctcaggacctcactggacaaggcatgtggggacccttgcaggagccctggtaagggtacaatgatcctattgttttttgtttttgagatggagtctcactctgtctcccaggctggagtgcagtggtgcgatctccgctcactgcaacctccgcctcccgggttcaagcaattctcctgcctcagcctgctgagtagctgggattacaggcacccactaccatgtccggctaattttgtatttttagtagagatggggtttcgccatgttagacaggctggtcttgaactcctgacctcaggtgatctgcccacctcggccttccaaagtgctgggattacaggcatgagccactgcacccagcctgatcctattgttgcactatttatggagcaacaactttgtacaaagaacaagctttgtacagagaacaagcttggctttttctcccaacgccgaggatgctgttgatgctgccacgtaatagcataattttgggtgtcctcaaggacagaacttccactttgaataatggaagttagaacaatgaatttcacaggggaataaatattaatgactgacgtgaagaaaatatgccattgtttattccctcctgcatcatttccataatttgcttttgtactgtcaatttagaggaaatgtgtgatgctggtgttttgtttggcctgtttgtttgatgctgggggttttatgtgttgtaccctttaccccttacattgtgtaatttgaaagtggcaaacaaacctgcagtaaaagtccttgattggcatcttcattcggatgatggagagcctttgtggtagtgtttgcttatgtgaacagcaggcctttcagataagagaagtggcttttccttggtgatgaaggggtagagattgagccatggggatggtttaggttaaagaatgcttttttttggccatcatgaggatctaacaacagagtagaaggaaggatgccctaggtcagcatgcagggtggtgggagggctttcatcttccttacccaagcctctcttttcacttttctagaagtccagaagttgttatatgatgaaatagcctcctttaacgtttatttctgggtgccaacggaggcccattcctctaacattctcataatttttctcaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaaca

SEQ ID NO: 4121 - DNA, 1052 bp, homo sapiens
agagagcgctgggagccggaggggagcgcagcgagttttggccagtggtcgtgcagtccaaggggctggatggcatgctggacccaagctcagctcagcgtccggacccaataacagttttaccaagggagcagctttctatcctggccacactgaggtgcatagcgtaatgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagcataaa

SEQ ID NO: 4122 - DNA, 2798 bp, homo sapiens
agtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattacccccgctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccacttaaaaaaaaaaaaaaaaaa

SEQ ID NO: 4123 - DNA, 2877 bp, homo sapiens
gctttccgcggcattctttgggcgtgagtcatgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtcacactgtttcaaaagttaaaaaaaaaaaaaaaaaa

SEQ ID NO: 4124 - DNA, 5643 bp, homo sapiens
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 4125 - DNA, 5710 bp, homo sapiens
cgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 4126 - DNA, 5619 bp, homo sapiens
cagcccgccactgccacccggccccgtgcgctcattggtcgggatgtgtcggctcagcagcctccaacttctcccgaatcccactgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 4127 - DNA, 5665 bp, homo sapiens
ccgagcgcccaggaccctgcggccgtggaggaggcgtgccctgggaaggagccgctactgggacctgaagagtgaggggagggagaggggcccagagggtgacctggaggagggctctggaagtcacgtcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 4128 - DNA, 3011 bp, homo sapiens
taaactagtgccggacagacgaaggcctagcacatgggctacggagccctagtagattccagtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaaaaaa

SEQ ID NO: 4129 - DNA, 3062 bp, homo sapiens
taaactagtgccggacagacgaaggcctagcacatgggctacggagccctagtagattccagtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaaaaaa

SEQ ID NO: 4130 - DNA, 3108 bp, homo sapiens
taaactagtgccggacagacgaaggcctagcacatgggctacggagccctagtagattccagtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcgatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaaaaaa

SEQ ID NO: 4131 - DNA, 2504 bp, homo sapiens
ttattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcgatctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatc

SEQ ID NO: 4132 - DNA, 2195 bp, homo sapiens
ttattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcgatctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatc

SEQ ID NO: 4133 - DNA, 3670 bp, homo sapiens
cgcagcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaa

SEQ ID NO: 4134 - DNA, 993 bp, homo sapiens
agctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtccttgcagaattatagtgaataccaaaatggggttttgccccaggaggctcctaaaaaaaaaaaaaaaaaaaaaaaaaaaaaaa

SEQ ID NO: 4135 - DNA, 931 bp, homo sapiens
tttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaaaaaaaaaaaaaaaa

SEQ ID NO: 4136 - DNA, 2419 bp, homo sapiens
gcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttt

SEQ ID NO: 4137 - DNA, 2824 bp, homo sapiens
gcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacacatctc

SEQ ID NO: 4138 - DNA, 3897 bp, homo sapiens
actcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcagtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcgtgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaaaaaaaaaaaaaaaa

SEQ ID NO: 4139 - DNA, 1272 bp, homo sapiens
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtggcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacataaaaaaaaaaaaaaaaaa

SEQ ID NO: 4140 - DNA, 3488 bp, homo sapiens
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaaaaaaaaaaaaaa

SEQ ID NO: 4141 - DNA, 1182 bp, homo sapiens
tgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatcaaaaaaaaaaaaaaa

SEQ ID NO: 4142 - DNA, 1349 bp, homo sapiens
agttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacgatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatcaaaaaaaaaaaaaaa

SEQ ID NO: 4143 - DNA, 2321 bp, homo sapiens
gtcctcaaccaagatggcgcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaaaaaaaaaaaaaaaaaaaaaaaa

SEQ ID NO: 4144 - DNA, 1354 bp, homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacctagcttttctgaatttacaataaaaactattttttaacgtgaaaaaaaaaaaaaaaaaa

SEQ ID NO: 4145 - DNA, 5987 bp, homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtgcatgcactacagtttaaattatggtgtacctaatgtaacccctaaatattttagaagtatgtacctatagttttacctcaaaaaaaccagaaatctctaaagaccagtagaaatattaaaaaatgatgcaagatcaaaatgattagctaattctccatacataatctgcagatgatcttctttggttggcatttcaggtgtggccatcacccagagttaaataacacctaatctaggtgtttacatgtattcattatcctagttatttcatgtagtttctaattcttaaaggaaagagggtaatagttctatttgtgtaatttgtttcctccaaacttaaggccacttatttacacaagatatttgtagatctattttcctaaagcatttcttaagtgctcagatcagtatctaattgaagaagtttaaaagtgttttggtcattaaaaatgtacttaaataggttaaatctaagccttgctgctgtgattggcttctagctcactgcctttaaattttaaaaaatttaagaggaaaatttccaagtctccaaagttttataaatacccttcatcaagtcatgcattaaagtatatattggagaaaaaaataaaaatacttttctcaacctggaagattttagcctaataaagcttttttgaagtaaaagacaacttgtaaaaggaaagaaactagtttgtctcaactctgtattcatttattttttttttgaagtagagtggaatctgttgaatcagatattttatcaagatatgtttattttttcttatttcattttacaaagttcactcctaatgccatatgtaacagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaacttagatgaacaaggtccatgttattttaggtggtagaacagggtagagtcatgtcattatttgctggtggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaattaataagctgcctattgagtggtatagctgtatgcttacccaaaaaagggaacactgtggttatgacttgtattataaactttctgtagttaataaagttgttatttttataaccatgattatattattattattaataaaatattttatcaaaatgaaaaaaaaaaaaaaa

SEQ ID NO: 4146 - DNA, 1369 bp, homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacctagcttttctgaatttacaataaaaactattttttaacgtgaaaaaaaaaaaaaaaaaa

SEQ ID NO: 4147 - DNA, 6002 bp, homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtgcatgcactacagtttaaattatggtgtacctaatgtaacccctaaatattttagaagtatgtacctatagttttacctcaaaaaaaccagaaatctctaaagaccagtagaaatattaaaaaatgatgcaagatcaaaatgattagctaattctccatacataatctgcagatgatcttctttggttggcatttcaggtgtggccatcacccagagttaaataacacctaatctaggtgtttacatgtattcattatcctagttatttcatgtagtttctaattcttaaaggaaagagggtaatagttctatttgtgtaatttgtttcctccaaacttaaggccacttatttacacaagatatttgtagatctattttcctaaagcatttcttaagtgctcagatcagtatctaattgaagaagtttaaaagtgttttggtcattaaaaatgtacttaaataggttaaatctaagccttgctgctgtgattggcttctagctcactgcctttaaattttaaaaaatttaagaggaaaatttccaagtctccaaagttttataaatacccttcatcaagtcatgcattaaagtatatattggagaaaaaaataaaaatacttttctcaacctggaagattttagcctaataaagcttttttgaagtaaaagacaacttgtaaaaggaaagaaactagtttgtctcaactctgtattcatttattttttttttgaagtagagtggaatctgttgaatcagatattttatcaagatatgtttattttttcttatttcattttacaaagttcactcctaatgccatatgtaacagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaacttagatgaacaaggtccatgttattttaggtggtagaacagggtagagtcatgtcattatttgctggtggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaattaataagctgcctattgagtggtatagctgtatgcttacccaaaaaagggaacactgtggttatgacttgtattataaactttctgtagttaataaagttgttatttttataaccatgattatattattattattaataaaatattttatcaaaatgaaaaaaaaaaaaaaa

SEQ ID NO: 4148 - DNA, 2102 bp, homo sapiens
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcgagttatcagtttgaatttcaacactgcctgagacatccctctggggaaagtgaaagagagggtttacttacctactgtcttgagctcacatacctcaaaatctactactgtgtggcacctgaaaggagttgaatgaagcttagcctttcattagcaatgttaattctattcaaccagcacctgcttccacagaaattctgtccaaactatcatgaagtggtgtgacaagggtatatggacccagaagataatacaatataagaagggatcactggaagcttgaccccatgcacattttggtgaaaatgtgcctagaatcaaatgtgacacgtaggctggaactgagtaccattcagaataggatctgaagagatcaaagcaatggagaccaccaaactgtcttgaaggcatgtctatggaccttaagtccatgtctatgttttcagctcttctcacagcataaaagggcattgtccttacttttgcagtggaaaactgaatggctgacaagatggaagagtaaccatttcagcattgtatgtggtttcatttttcttagttatctggctactgaatagccggatttttcagttctgtcagaaactctaaatttccaaaaatctaagtgaaacatggatgaaactctgttagaaaattgttaggattttggagtatttggggagggggactactggaatgctgtccaagttttatactaagatatcttacctgtttgttattaaccaaatatttttaaaaatatttcctccataaatattcatttaatattaggttgatatttatcacataaaaagtaaaggctactgttagctaattgtcacagagaaggatttgttttctgttgttagtgaatttgaaatccttgactttatgtgctacagccagttccatctctgtttgtaaattcttactttccattccatatcatattctgttccctataacctcttcattgttttcttttcttttaaaaataataaacttttctatgatcaaaaaaaaaaaaaaaaaaaaaaaaaaaaaaa

SEQ ID NO: 4149 - DNA, 1929 bp, homo sapiens
agtttcccgggagagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtgaaaaaaaaaaaaaaaaaaaa

SEQ ID NO: 4150 - DNA, 1696 bp, homo sapiens
agctgccaaattcgccaactagaggagggagaggcggagcttgggtccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtgaaaaaaaaaaaaaaaaaaaa

SEQ ID NO: 4151 - DNA, 1375 bp, homo sapiens
gcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacaaaaaaaaaaaaaaaaaaaaaaaaaa

SEQ ID NO: 4152 - DNA, 576 bp, homo sapiens
gcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattcaaaagtgaaaaaaaaaaaaaaaa

SEQ ID NO: 4153 - DNA, 1646 bp, homo sapiens
cactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgg

SEQ ID NO: 4154 - DNA, 665 bp, homo sapiens
gggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaaatgtgaaaaaaaaaaaaaaaaaaaaaaaaaaaaaaaaaaa

SEQ ID NO: 4155 - DNA, 2770 bp, homo sapiens
gaccggggtcggggcagggggcggggccgagcgggagaccagagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccatcctctgccttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttctttttctgaaaa

SEQ ID NO: 4156 - DNA, 1927 bp, homo sapiens
gctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctataaaaaaaaaaaaaaaaaaaaaaaa

SEQ ID NO: 4157 - DNA, 3690 bp, homo sapiens
aatcggtccaattctcggccgggaagtctctggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaa

SEQ ID NO: 4158 - DNA, 3480 bp, homo sapiens
aatcggtccaattctcggccgggaagtctctggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaa

SEQ ID NO: 4159 - DNA, 2751 bp, homo sapiens
tcacatcacaacgacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgaacagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggaaaaaaaaaaaaaaaaaa

SEQ ID NO: 4160 - DNA, 1141 bp, homo sapiens
agtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaaaaaaaaaaaaaa

SEQ ID NO: 4161 - DNA, 1919 bp, homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaaaaaaaaaaaaaaaaaaaa

SEQ ID NO: 4162 - DNA, 2680 bp, homo sapiens
cgcagaggcaccgccccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacatggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctctgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactgaaaaaaaaaaaaaaaaaaaaa

SEQ ID NO: 4163 - DNA, 1641 bp, homo sapiens
agagggcccgctcaccaccccgtaggccccgcccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaaaaaaaaaaaaaaaa

SEQ ID NO: 4164 - DNA, 1263 bp, homo sapiens
gactctcgcgagatccctactggctataaaggcagcgccccggagagctcttgcgcgtcttgttcttgcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaagctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttaaaaaaaaaaaaaaaaaaaaaaaaaaaaa

SEQ ID NO: 4165 - DNA, 1237 bp, homo sapiens
gactctcgcgagatccctactggctataaaggcagcgccccggagagctcttgcgcgtcttgttcttgcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtagctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttaaaaaaaaaaaaaaaaaaaaaaaaaaaaa

SEQ ID NO: 4166 - DNA, 1043 bp, homo sapiens
gactctcgcgagatccctactggctataaaggcagcgccccggagagctcttgcgcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttaaaaaaaaaaaaaaaaaaaaaaaaaaaaa

SEQ ID NO: 4167 - DNA, 2242 bp, homo sapiens
cacagcggggcggggcgcggggctgagcaggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaataaaaaaaaaaaaaaaaaaaa

SEQ ID NO: 4168 - DNA, 2635 bp, homo sapiens
cacagcggggcggggcgcggggctgagcaggcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaataaaaaaaaaaaaaaaaaaaa

SEQ ID NO: 4169 - DNA, 2529 bp, homo sapiens
cgggccgggcggggcgcgcgtccttccaggcagctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaataaaaaaaaaaaaaaaaaaaa

SEQ ID NO: 4170 - DNA, 3540 bp, homo sapiens
ggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacgtagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaaccaaaaaaa

SEQ ID NO: 4171 - DNA, 742 bp, homo sapiens
tccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 4172 - DNA, 1222 bp, homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 4173 - DNA, 1606 bp, homo sapiens
aaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaaaaaaaaaaaaaaaaaa

SEQ ID NO: 4174 - DNA, 5518 bp, homo sapiens
tgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4175 - DNA, 5569 bp, homo sapiens
tgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4176 - DNA, 1592 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaa

SEQ ID NO: 4177 - DNA, 2377 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgaaaaaaaaaaaaaaaaaa

SEQ ID NO: 4178 - DNA, 5425 bp, homo sapiens
tctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4179 - DNA, 5620 bp, homo sapiens
tgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4180 - DNA, 1643 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaa

SEQ ID NO: 4181 - DNA, 6145 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4182 - DNA, 1694 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaa

SEQ ID NO: 4183 - DNA, 1638 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaaaaaaaaaaaaaa

SEQ ID NO: 4184 - DNA, 6012 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4185 - DNA, 6154 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4186 - DNA, 1987 bp, homo sapiens
tttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaa

SEQ ID NO: 4187 - DNA, 2374 bp, homo sapiens
ggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaaaaaaaaaaaaaa

SEQ ID NO: 4188 - DNA, 1740 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaaaaaaaaaaaaaa

SEQ ID NO: 4189 - DNA, 6003 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4190 - DNA, 6027 bp, homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaaaaaaaaaaaaaaaaaa

SEQ ID NO: 4191 - DNA, 2104 bp, homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaaaaaaaaaaaaaaaaaaaaa

SEQ ID NO: 4192 - DNA, 3231 bp, homo sapiens
cccggccgggtctgggggcggggcgtttgcccggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcaaaaaaa

SEQ ID NO: 4193 - DNA, 4286 bp, homo sapiens
aatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaagctggc

SEQ ID NO: 4194 - DNA, 2090 bp, homo sapiens
ggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaaaaaaaaaaaaaaaaaaaaaa

SEQ ID NO: 4195 - DNA, 1975 bp, homo sapiens
aactgtcactgtggagaggagagagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaaaaaaaaaaaaaaaaaaaaaa

SEQ ID NO: 4196 - DNA, 2651 bp, homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4197 - DNA, 2588 bp, homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4198 - DNA, 2591 bp, homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4199 - DNA, 2404 bp, homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4200 - DNA, 2331 bp, homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4201 - DNA, 2724 bp, homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4202 - DNA, 2271 bp, homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 4203 - DNA, 5983 bp, homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaatattgttgctactgtttgcttttcaaataatctggagatcgttggctatggcaacgtgctgccacctaattagagaatgcctgtaaatgtaggctgaacacttctaacatgagaaaacctaagtatcctaaaaaaaaaaaaaaaaaa

SEQ ID NO: 4204 - DNA, 6158 bp, homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaatattgttgctactgtttgcttttcaaataatctggagatcgttggctatggcaacgtgctgccacctaattagagaatgcctgtaaatgtaggctgaacacttctaacatgagaaaacctaagtatcctaaaaaaaaaaaaaaaaaa

SEQ ID NO: 4205 - DNA, 4544 bp, homo sapiens
agcacaggcacgtcccgggggctccagcttctgctcagagcgcggagagccgggccgggcgggcgcgcgcgcaggactcgggccgctcgaggggtccggccggacggtgtcgggagccggacccgtcggcagaggagcgggcgccgcgatggctgagggcagtgccgtgtctgaccctcagcacgccgcgcgtctgctgcgagcgctcagctctttccgcgaggagtctcgcttctgcgacgcgcacctggtcctcgacggggaggagatcccggtgcagaagaacatcctggcggcggccagcccgtacatcaggacaaagttaaactataatcctccaaaagatgatggatcaacttataagattgaacttgaagggatatcggtaatggttatgagagagatcctggattacatcttcagtgggcagatcaggctaaatgaagatacaatccaagatgttgttcaggcagctgacctgctgctactgacggaccttaaaaccctgtgctgtgagtttttggaaggctgcattgctgctgagaactgtattggtatccgtgactttgcactacattactgcctccatcacgttcattaccttgccacagaatacctggagactcatttccgagacgtcagcagcacggaagaattcttagagctgagtcctcaaaagcttaaagaagtgatttctcttgagaagttaaacgttggcaatgaaagatatgtctttgaagcagtaattcgatggatagcacatgatacagaaataagaaaggtccacatgaaggatgttatgtcagctctgtgggtttcagggttggactccagttatttacgggaacagatgctgaatgaaccattagtacgagaaattgtcaaagagtgtagcaatataccgctcagccagccgcagcaaggggaggcgatgctggccaacttcaaaccccggggctactctgagtgcatcgtgactgttggtggagaagagagagtttcacggaaacccacagcagcgatgcgatgcatgtgccctctctatgaccctaacaggcagctttggatcgaactggcccctttaagcatgccgagaattaaccatggagttctctcagcagaaggatttttgtttgtattcgggggccaagatgaaaataagcagactcttagctcaggagaaaagtatgatccagatgcaaatacatggacagcattgccacctatgaacgaggcaagacataacttcggaattgtggagatagatgggatgctgtacattttgggaggagaggatggtgaaaaggagctgatttccatggagtgttacgatatttattctaaaacctggacaaagcaacctgatttgaccatggtcagaaagatcggctgctatgcagctatgaaaaagaaaatctacgccatgggtggaggctcctacggaaagctttttgagtctgtagagtgttatgatcccaggacccagcagtggactgccatatgtccactaaaagagaggaggtttggagcggtggcctgtggagttgctatggagctgtatgtgtttgggggagtccgaagtcgtgaggacgcccagggtagcgagatggtaacttgcaagtccgagttctaccatgatgagtttaaaaggtggatctatcttaacgaccagaatttatgcatccccgccagttcctcttttgtttatggagctgtacctataggagccagtatttatgttattggagatcttgatacaggtaccaattacgactacgtgcgtgagtttaaaagaagcacaggaacctggcaccacactaaaccactccttccatccgaccttcgccgtacaggatgtgcagccttacgcattgcgaattgcaagcttttccgcctgcagcttcagcaaggcttattccgtattcgtgttcattccccttgaggaggaagcagagcagagtgcgagatcctgacccaagagcaccataacatagctccgaaagggagagcagagatggcagctgaaactcactctgtgctgggctttggtatggtaactctttggtggttttatgatgcttacaaacttgagctttagctcttgtttgggagaacacgtaactgttgaaaaactacctgggaggagtgagttcctccagttaaatgtggctgtagatgttggaggctagggaggctagtaaatatcaaaaggaaaagggagtgggaattgctatcatgtaaaatatcaaagttaaaatactaaggtgcattttccctgaagggaactcatgtctgactgctgtattcaaatacgtagctttggtaacaaacaaaatccgtatatgcaaatcaacatatccaaacatgccaagactgcttttccactgcacttggaaggatatattatgcctaaccctgcccaacaaattaaggtttgtgcctaaaatgttagattggactgtatgccagttagtctccatttattcctagtactctgtcctaagaatctttttaaaactatatcatgatgaattgaaatgaagataaaattgctcttttgtaactttatcttagtaatgtaaagattcagtaaattgatgagtcaggttgcagccctcatgtgaactgaaagaagttgctcgcttctgtgttgacttagatcaagacacgtcacgcatcctttctggggtagtacctgtggagccgggaagggtctcctgcagtgccattctgccttctcaatgagcaaaaccattttctaagtatgaggatattagtgagtaggagattttataaaagaaagacctgagtcagacaaataataaaggtctgctgtggctaaaaaagcaaaaacaaaaaagctatccagacaaaatacatagggatcagaaactttttcatataacctgtctgaaagcacacaaagtcttgtttactactgtttagggtttgaaaacttgtcttagaatgcgaatctgtgttaagaatctagtctttgtaatagaagtttcccagtggcattcactagtgagagttttagacaaattatgttacgagtaaagtttggctggtagaataaactacctcaacttaatttcattctgttcatagtagagcaaattaatcttttcctccttccctcctttcctatctctcattctcacctcaacccactttaccccacttctcattgggggaaaaatgtctttcgttcgtggaacgtatcttgtaagatattttgttttccacttgaattacaccaccctagtgtgaaatcggggacttcaaagtgcttgattccttcctaaattgaattttatgcaatgtcaaatttctaatcaatttaatatacagtacttcatttttaattgttttctaaaaaaaaggttttttttttccttttggaatatggctgtaagaagcagcattttgtcttattaacacatgtataaaggtatcctttggttttaagtcgagaacaggaatttcttctagaaacttcctgtatggaacgtttatatgcaattaacatgcatatgaaaaacatcacttacgttctcccacccatagacataaaaaagggtgacctgtgattttttttcttatacctgctggaagtcagtacaatgcgtcaaaagttgctgaaagatgctgtgcctatggggttctagagagtgttgagtgtggtacattaactctccattttagccagaagatacctgataagagaaggtgtaaggtttttatcttatatgccagaggcaccaggccagatgtgccgcacagtcatgtaattcaatcatgtttaatatgtcagtcaaaaccaaattcagaattgttttgtgtaccagtcagctgttgtctgcacattttcgtagtgacagtgtggagatctttttaatgaaagcaaactatgtggcctctgcaaagaaaggaagatttttctttttacaactagatattagttttagaggaaggaaatagctgaaaaactaaatttgctttggtgaaatgtcctgtacagaacagtaccttggcattcagcagctgtaattggggaacattaaaacagtaactgacatccagttaaagccacgatcgtcagcaattctccttttttaatttctgatatttaaagttttttttccagtctacaccaggcctctccaaggagacagttcattatttaggagtgaatgtgttcctcttgcaatattatcagtacctgcatgacttggtaaattcattttataaaaatagtgttttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctccaacattaatcatgactcttttgtaaattacagttatttcagtattgtaaaataaatgttgactcatttcatgcaggtttgtgttttaa

SEQ ID NO: 4206 - DNA, 830 bp, homo sapiens
ccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaattaaaaaaaaaaaaa

SEQ ID NO: 4207 - DNA, 1545 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaaaaaaaaaaaaaaaaaa

SEQ ID NO: 4208 - DNA, 1634 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaaaaaaa

SEQ ID NO: 4209 - DNA, 1641 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaaaaaaaaaaaaaaaaaa

SEQ ID NO: 4210 - DNA, 1538 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaaaaaaa

SEQ ID NO: 4211 - DNA, 1580 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaaaaaaa

SEQ ID NO: 4212 - DNA, 1484 bp, homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaaaaaaa

SEQ ID NO: 4213 - DNA, 1790 bp, homo sapiens
atggattaactcgaactccaggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagccaaaaaaaaaaa

SEQ ID NO: 4214 - DNA, 2310 bp, homo sapiens
gaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaa

SEQ ID NO: 4215 - DNA, 2189 bp, homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 4216 - DNA, 1371 bp, homo sapiens
aagcagctctggtgctgaagagagcactgcctccctgtgtgactggagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 4217 - DNA, 1053 bp, homo sapiens
agaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgagctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 4218 - DNA, 1433 bp, homo sapiens
tttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 4219 - DNA, 1545 bp, homo sapiens
tttcctgtggtgggttcacacgcagctagacacagctaacttgagtcttggagctcctagagggaagcttctggaaaggaaggctcttcaggacctcttaggagccagtgtgaaggtgaaggaggaagcagatgcctgttcatatggaaacaaagacctggctgtgaagaggggaggcggacaccaaagtcctgacacttgggcgggacagaattgatctagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 4220 - DNA, 1715 bp, homo sapiens
gaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggaaaaaaaaaaaaaaaaaaaaaaaaaaaaaaaaaaaaaaaaaaaaa

SEQ ID NO: 4221 - DNA, 886 bp, homo sapiens
ctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtaaaaaaaaaaaaaaaaaa

SEQ ID NO: 4222 - DNA, 3837 bp, homo sapiens
gccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgcgggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatcagcaaaaaaaaaaaaaaaaaaaaaaaaaaaaaa

SEQ ID NO: 4223 - DNA, 3652 bp, homo sapiens
gccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatcagcaaaaaaaaaaaaaaaaaaaaaaaaaaaaaa

SEQ ID NO: 4224 - DNA, 3572 bp, homo sapiens
gccccgcgacgagctcccgccggtcacgtgacccgcctctgcgcgcccccgggcacgaccccggagtctccgcgggcggccagggcgcgcgtgcgcggaggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatcagcaaaaaaaaaaaaaaaaaaaaaaaaaaaaaa

SEQ ID NO: 4225 - DNA, 498 bp, homo sapiens
agttccccaaagataacacagctttgcacagtggatgtttacttgctggtggtcttatctaagatcaacattggcagctgtgcccggagaggcctccagggtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtaaaaaaaaaaaaaaaaaaaaaaaaa

SEQ ID NO: 4226 - DNA, 501 bp, homo sapiens
agttccccaaagataacacagctttgcacagtggatgtttacttgctggtggtcttatctaagatcaacattggcagctgtgcccggagaggcctccagggtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtaaaaaaaaaaaaaaaaaaaaaaaaa

SEQ ID NO: 4227 - DNA, 384 bp, homo sapiens
agttccccaaagataacacagctttgcacagtggatgtttacttgctggtggtcttatctaagatcaacattggcagctgtgcccggagaggcctccagggtccagttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtaaaaaaaaaaaaaaaaaaaaaaaaa

SEQ ID NO: 4228 - DNA, 1374 bp, homo sapiens
agttccccaaagataacacagctttgcacagtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtaaaaaaaaaaaaaaaaaaaaaaaaa

SEQ ID NO: 4229 - DNA, 1371 bp, homo sapiens
agttccccaaagataacacagctttgcacagtggatgtttacttgctggtggtcttatctaagatcaacattggcagctgtgcccggagaggcctccagggtccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttagaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtaaaaaaaaaaaaaaaaaaaaaaaaa

SEQ ID NO: 4230 - DNA, 1602 bp, homo sapiens
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 4231 - DNA, 1494 bp, homo sapiens
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 4232 - DNA, 1593 bp, homo sapiens
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 4233 - DNA, 4491 bp, homo sapiens
acagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 4234 - DNA, 5211 bp, homo sapiens
agccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 4235 - DNA, 5276 bp, homo sapiens
agccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 4236 - DNA, 3697 bp, homo sapiens
gccaggctgcggagcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcctccctgcaaaaaaaaaaaaaaaaaaaaaaaaaaaaaaaaa

SEQ ID NO: 4237 - DNA, 2058 bp, homo sapiens
aagatgctccgtggaagggagccgagcggtgggcagaggctgagtccccgataacgagcgcctcacatttccgtggcattcccatttgctagtgcgctgctgcggccgcacgcctgattgatatatgactgcaatggcacttttccatttgacattctctctctctctctccctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaaaaaaaaaaaaaaaaaaaaaaaaaaaaaaaaaaaaaaaaaaaaaaaaaaaaaaaa

SEQ ID NO: 4238 - DNA, 1910 bp, homo sapiens
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 4239 - DNA, 1898 bp, homo sapiens
cggacctccacactgagccatgcccacccccgacgccaccacgccacaggccaagggcttccgcagggccgtgtctgagctggacgccaagcaggcagaggccatcatgggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 4240 - DNA, 1817 bp, homo sapiens
cggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 4241 - DNA, 2941 bp, homo sapiens
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaaaaaaaaaaaaaaaaa

SEQ ID NO: 4242 - DNA, 1940 bp, homo sapiens
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagccctctactttcttcttgccacctttttgtggcaatattaaagtgaactgctaatagtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaaaaaaaaaaaaaaaaa

SEQ ID NO: 4243 - DNA, 1852 bp, homo sapiens
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaaaaaaaaaaaaaaaaa

SEQ ID NO: 4244 - DNA, 1995 bp, homo sapiens
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaaaaaaaaaaaaaaaaa

SEQ ID NO: 4245 - DNA, 6492 bp, homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 4246 - DNA, 1207 bp, homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcta

SEQ ID NO: 4247 - DNA, 2423 bp, homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 4248 - DNA, 1340 bp, homo sapiens
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggagaacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaaaaaaaaaaaa

SEQ ID NO: 4249 - DNA, 2564 bp, homo sapiens
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 4250 - DNA, 2583 bp, homo sapiens
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 4251 - DNA, 2400 bp, homo sapiens
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 4252 - DNA, 2174 bp, homo sapiens
acatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 4253 - DNA, 2324 bp, homo sapiens
atcacatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 4254 - DNA, 2113 bp, homo sapiens
agggacgcctgagcgaacccccgagagagcgggcgtgggcgccaggcgggcggggcactggggattaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaaaaa

SEQ ID NO: 4255 - DNA, 2083 bp, homo sapiens
agggacgcctgagcgaacccccgagagagcgggcgtgggcgccaggcgggcggggcactggggattaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaaaaa

SEQ ID NO: 4256 - DNA, 5360 bp, homo sapiens
cacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttcaaaaaaaaaaaaaaaa

SEQ ID NO: 4257 - DNA, 2915 bp, homo sapiens
agaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaggatcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgttaaaaaaaaaaaaaaaaaaa

SEQ ID NO: 4258 - DNA, 2912 bp, homo sapiens
agaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatggatcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgttaaaaaaaaaaaaaaaaaaa

SEQ ID NO: 4259 - DNA, 2906 bp, homo sapiens
agaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgttaaaaaaaaaaaaaaaaaaa

SEQ ID NO: 4260 - DNA, 1556 bp, homo sapiens
acttgtttcactttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaa

SEQ ID NO: 4261 - DNA, 7204 bp, homo sapiens
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 4262 - DNA, 7415 bp, homo sapiens
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 4263 - DNA, 7366 bp, homo sapiens
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 4264 - DNA, 5162 bp, homo sapiens
ccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtgccatgctcagcggagatgaggctctcccatctgtaggggccgtattaacatgcacactctaaaagtgcccttcgtttctccagcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 4265 - DNA, 5188 bp, homo sapiens
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 4266 - DNA, 469 bp, homo sapiens
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaa

SEQ ID NO: 4267 - DNA, 4875 bp, homo sapiens
acacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 4268 - DNA, 847 bp, homo sapiens
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagggcctgcagggagggatccagcaggtgactcttcaggctgatttgcccatcccagatagaagccgggagtgttctttcaaaggtgtctttaccttagacactcaataaaatggtaacacagtgaaaaaaaaaaaaaaaa

SEQ ID NO: 4269 - DNA, 3626 bp, homo sapiens
attcctagggccgggcgcgggggcggggaggcctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcaca

SEQ ID NO: 4270 - DNA, 3989 bp, homo sapiens
attcctagggccgggcgcgggggcggggaggcctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcaca
